United States Patent 7,868,149 (PLANT GENOME SEQUENCE AND USES THEREOF) - sequence listing, part 80

SEQ ID NO: 42833 - DNA, 10574 bp, Oryza sativa
ttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgtggaaggtggtactcaactgcccagaaacaaatcaatgggcactggtacatgaaatagtcagagtctcgattgcacatcaagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttgtatgccacatcccagtgagcatgtgcagtggcagtactctcaaaaaggtaggccactgtcttctccatgtctggctcattgtagtaccaaggagtgaagctttgcctccacttaggccttccaaccggtagtcttaaccacatccatatctgaatcaatagcacacaaccactcatgttggatgatggtgcctgacgacaacaggcctcacagagctgtctatatgtccacgccaacactgctgagccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtctctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactaggggagcatgagctctgactcggagcggttgaagtacctgcattagcaattgtaaatcaattagttaatataatgtcaaatacacgctaccgatacttattgacggagcgtggggctcctcaccgggagaccgcgtaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaatcagtcccctctctcagtgggctaggtcctccttttatatcttaaggggataccacatgcaccatttctctcttttttgtgggacttaccctaccttttcataaatggacggagatttgtatagttgccgtccgagtcatcttctgatgagacgacccacaactacctccactttcgccgggagcaggtgcgacgtggaatcgtggctgtctgctgacgacatgaccggtgtcagacccgtcacgtcggtcattcttgtgcaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgtgttacatgcggcgtgacacgctcagccaaaccgcaataaatgtggttaggtgagccccactgtgctcacctaacccatacacgcggagcaaaaacccacgaggggtcggggtgcctcggccctcggggccgaggcgggtgtggcccgaccccctcggggggactaagaggagggcgaacacatcaccctcgggcccgacgtccctcgggggtgccaggccacgtgtgcgattgtgtctgcctcaaacctctagtcatgatactcctgatcccatgttaccgacagtagcccccggcgttatgccagggcgatcgccctctttaagggaaacggtcgggcgtgacgccactcctaaggcctggtgacaggtgggaccggtctccacaattgggcagaaacccaacggtcacaaaccacgcacatcggcaatggtaactcggctgtcaacaatgagcagtctcttcaagactgccacattacttgagtagcacacgaatcttgacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctctttctccggcgccatggcacggggctccgctctgcttgatggtagcgtgctgccgccttcccgcatcgtgagtgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctctgtcgtcggattgcgccgctccagcgacgcgctcggggcgcctgggagtacaccgggtccgaagacttcacaaggacccaccagggagtgagatgggactgggctcctgaggacttcaagatattggtccaacgggtgctgaatctcaactccgtagaggcggccctcattccccgaggaatcctccccctctgcagcgatccagaccgcgcctccatcctgaccattatgatggcggttggggcctcagaggagcgagctccaaagggccacgacggcgcgggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgtaagatgggggagacagaaccatctcggggaaacctcatttcccctccaaagtggtcgtttaaccgacctcctcgcaggttcatctctcacccatcgtggctgtattcattctctcaacgcgagttttcactcacccaccttgttcgtcttctggttttttttcttttgtttcagcgagatcccgtcgcgtccctcccgccattccaagtccggccagtctgaggccgaggatccggcggccgcagaggccctcaggcgggaatctgaccggcgagaggccgtggatcgcctacgggaagccaaggaggccgcccaggaggccgcccgggctcgccaggccgaggaaaccgctcgggaggaggccgcccgggcccgccaggccggggaagccgctcgggaggaggccggatttcgccaggacgaggcgatggcgacttccgaggcaactcgtgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaacgggtccgggggacatccccgagtccggcacttccatcggcggcccgagccgcgtggcatcctctccaaggcggctcttccccacgccttctatcgccccactgaacgcagagccccttctgcaggccttggccgccgcaaacaccacggtgttggatgggttaagtgcccaggtagaggtcctacaggcagagcgggcggagctcgacgccgcgtgggcgcgtgtcgaagaggggcgacgctcggtggaggccatggtggaggtgggccgtaaggctcaccgccgacacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgtgaagaggcccttgaggcgcgcgccatggcgctggaagagcgcgcctgcgtcgtggagagggatctggcggaccgcgaggccgccgtcaccatccgggaagcaacgctggcggcgcacgaggctacctgcgccgaagaagagttcacgctccgcctccgcgaggacgcgctcactgagcgggagcgagctctcgagggggccgaggccgcggcgcaacagctggcggtcagcctgtccctccgcgaggcagcgcaggaggagcaggcgcgtcgcaatctggaaggtgcccgcgccgagagggccgtactgaaccaacgggccgctgagctcgaggcccgggcgaaggagctggacgcgagggcgcgcaacggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccagcatgctttgggacgccgtctcccgcctagatcgcgccggtcggcaagtgggcctctggagagggcggaccgtaaagtatgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgttggatgagttccctcctgggaccgaggaccgcgcacgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgatccaggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggctaggccgggaacgtggtgaccgagggttatgggtgacccgattgtgggtttttgccgattcccccccggagttcaccacgcctcggggcacggctcggttctaggccccgtttggcgattttagccgacccgagcctccgagggcaggattgaggacgagtgacctatttcaagtcaagatttttcaaaaggaaaaaacagcacagatacagcctttaggaaattgaaactgcttttattgaagtactgagaaaaaaaaaaggaaataagaatgtgcatgtgtggcagcccccggccaaccctacacgcccgagggggtgcggggttggcccgagcccaaaacctgacacccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcaatacatggtagcccgaggagacctcagagtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccacctggggcccgcctaaacggtcccaggatatcgagtccccagacagcaaacggccacgaaagtggtatggtctgcagggcctgggccagctgatggatttgcttggcgtggaattgacacgctctacatcgccggaccaggtcgaccgcatcattaagagctgtcggccaatagatatcctggcgaaaagctttaccaaccaaggtgcgcgaggcggagtgggctccgcattctccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggtaagcctttcttcaaaggcacccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagaaacagggatccgtcgaactgcatcacccagtggacggtgtgaggcagctgcgaggggtccgtgctggcctcggggatcgagatgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggcaatcagaatagcgcaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccatagtggcttcggggccgtcctgggggtcgggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgcgcagagggtcaactccggtcgtcgggggccctgggccaccgttcagctcgggagcctctcctccctgctctctcccgggccaagtcggcacagggtggggaggcgtgaaatgagaattgtcctcatcgcgctccacaaccaatgccgcactaactacttgcggggtcgccgctaagtagagtaacaagggctcgtctggctccggggcgaccagaactgggggagagcttagacatgccttcaactgagtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactctcaaaagtttccgctagatctgagagtaaagtttcctggttgcgcgtctttacaatcaagtcatcgacataagcctcaacattacgtcctaattggctacccaaagaaattcgagtagtacgttgaaaagtaggacctgcattttttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggaagacctcacggatgaatccggcctccagaagtcgcgccacctcctcgcggatgaaggcttgacgttccggggcctgccgccgcactttctgccggaccggccttgcacccggccgcacggcaagacggtgctcaatcacctccttggggaccccgggcatatccgccggtctccatgc

SEQ ID NO: 42834 - DNA, 34476 bp, Oryza sativa
  unsure (1)..(34476): unsure at all n locations
gtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcgggcttggacgcagcgacgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggatacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaacgccggggatttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggcgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgccggctcggccattgggctgaacaggaaaagcttggcgcacacgaaagagtgcgagagctcagaaaatccctcgcagagccccctacctggcgcgccagatgacggagcgtggggctcctcaccgggagaccgcgtaggcccccctttgccggttcggccggggactcagggtgagattctaagctctctatatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaaatcagtcccctctctcagtgggctaggtcctccttttatatcttaaggggataccacatgcaccatttctctcttttttgtggggacttaccctaccttttcataaatggacggagatttgtatagttgccgtccgagtcatcttctgatgagacgacccacaactacctccactttcgccgggagcaggtgcgacgtggaatcgtggctgtctgctgacgacatgaccggtgtcagacccgtcacgtcggtcattcttgtgcaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgtgttacatgcggcgtgacacgctcaacccatccctattccagaaggcaggtaagcncanctgtgctcacctaacccatacacgcggagcaaaaacccacgaggggtcggggtgcctcggccctcggggccgaggcgggtgcggcccgaccccctcggggggactaagaggagggcgaacacatcaccctcgggcccgatgtccctcgggggtgccaggccacgtgtgcgattgtgtctgcctcaaacctctagtcatgatactcctgatctcatgttaccgacacttatgcacaagtgaatcaatgccgattcataccctccccgcctcgatcgcagccccacgatgacgggcctcgtagtacgcctccaaggctgggtaagtcggcggttgtccctcctcagccatcctatatgaaaaagtaataaattcaccgttagttaccaatgtgacatatattaaaagaaaatgaatgcaagaacatgagtaggacaactatgttccttacctacccgtgatatcctccacgtaccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctagtagtgcaccatgggcatgtgttaggtccctaaactcaggaatgtccggctttctcctaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctgtattcatatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttccaagcaaaggtctcttcttctctccttccccctccaagtcttctcgtaccaactcagtcttacttgcaccccctccacgacgagaataatgtcacaaaattcttctcaacgtaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgactttagttcatctagagttgggtgggtgggaaacaaaatggtcttcaatgacatatcctcaaactcacatgtgcaccaacataaggttccaccactctaccaccgtagtaaacacgaacaagtctatccatctacaccaaaaaatcaaatgtaactttgcaacaaaattaaatcttcattcctaaacgtagtccaaaccgacatattataaccaatgcacaacttaaattgtcccaaagctactactccaaaaaaatatttaatccacctacaactatcaataagtttactagtgcattacacatcgaaatattacaaatactccgtcatacaacccaaacctccgtcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcataaatttgggtaaaaaaggggttctagggttacccaccgatctacaaattcaaccaataaaaacgaaaaaaaaagaggggggaatgaaggagtctacctttctcttcgatttccacaaaaaatcccgcgaaaaacggctttaaattgagtggatttgaggtggagaggtgagggggagagagaggggaagaactcctgcgctgctgctcgggctgggacttggcgaaaatgggagtggggaggagaaaggtggtggggcccacggggtttaagggtcggcccacagaggaggggcgcgccagccgtgctggcgccgtggtatgaggggcggcgccagtgtggctggcgcccccattctgcccagtcagcacctccacgacagccctagtgccacggtggcacgggcacggcgccagtgtggctggcgccgccatgttggggtacggcgccagccactctggcaccccaaaaaggaccatttccggtttaagttttcccaggagtctatttgtaaaataagttttcaaaaaggaccaaattgtaaaaattttagattccaacacagcaatgtaaaagtccaagcattggcttttattctagatgagaaaacgaatggcgtgttaagagatgttttgtcttgataacaactcctgttaatgttgtcgacatatttagtcaatcgatggcttagtttcctattcgtagaggtcgcagttgtaattggcgctttcatgactagaaacaggccggcgccgcgacgaaggttctaatttgatttctgacccttttttttctgatcgaaacgccgttgatcgatcactttgctttatctgaccacgcgcacgacctgcacggcaaagctcctgcctatagctgtttattattccctgtgtgtcgagttccagtccaaacacgcgagcgagaaaattcccttgctctgactcgtggcaaggaattcacgagtgtcgatgatcatttcgttgtcacggcgtacgttaatctggaagagaataccgtaactctgtaagagacgagagtacatgctacgggagtgtttgagagcagaggaaaaggtgagatcgagaaagatatgtaaaacgagctaatctattagcatatgaataatagagtattagtgtataattaatagagtagtttgaaaagcgtgcacgtgaaaaacgacttactaccgaacgcagccccggcaggtactccaaagtatcagtagcatgtatacatcgcctgaccgaccaccgccgtgtaatgactactgtaatgaattgaggcacagttagcaaaagagctcaatatatacatcgggtatggacggagacgtggtacgtactgtatacaagttataagactgcttgtgcgcaaaacgccatggctggcagttaaggccgtgcagctcccgcggagatggccagcaaaaacgcgcgttgacacgcagcagcagcagaagcaggaggaggtacgtacgctgatggggggtggtgaatgatggtcccgatcgatcgaggcgaggcggacatgcgtaaatccgccccgattccccgtgatcgtatcgcgcggcggatacgtagtacggtgcagtgcaggtggcggcgaaagcgacccgaattcagcgtggcggatgccggatgggacatcgcgcgcagtgcatatacggctgaattgtttcgcgttgacatgcagatgcaggtgatcgatgcggtgcgacttcgtcgtcgagatcgatcggtgtgggcttgggcttgtcggttcgatcgctttgcatcatgctgtaccccaaccagggttcccttttaccattttcggtgcgacaccgtggtaacccgaaaactgcatgataaccacgagacataactgattttaaaaactaaaaagatcacaatacatgataaccacgataatcatatgataaccacgtggttttgtaaacctgacaccaactggaagcttaagtaactaatttggatcgcaccccgattccggccgagtccgattgatatggtccagagagagacgccgccgtgcgagcgtgaccaccaccactgcatgcgtcgcatgattggtgcgtggttccgtcgaaaatgtcagcagaggaatgctcgccgagatccaacttctcacaagcagagcaaccctcctccatgctgtgttgaccgtcgagtcgatatatagtacacacaagaaaatgttcggatcccttgtggtttcgatcgttttcaccacttgctttctgtgagactgtgacggcggcaatcctgttcttttgagatcttttacattgctccaactaaattgcctccatgaggtaagagcccataataaatcctaactgttcaatactagttatatgttaattgacgttttggacaagattaagattaaacttttacaactttgaccatcaataactttaaaaatatttagtttaaagaaactagaaaaaacatatatagatttgtctttcaaaacactataataaaagtaaacatgtatttatttattgtatatattataatagaaaattaattaaggttaaagttatatcttgtagagcgtgtcattgtccaaagcgtcaattaaaatgaaaccgaagggagtaaacatcttttttatctaataaaatatactgtctccttattaataaatcggagctactccaacaatcattgtccttcctaattaatcacccatgacccattcatccgtaacctagctaccaaaaatcaaggaagaaccaaacattctgagtttccatattccaaatatctaagtgaaaacagagaaaaactatattgttagaactaaatataaatgtaaaaataagttttctaaattggcagtgtattctaaagcctcaaactgaggctatgtgaagcataacctgtatctattttaaagtttttgaacctgttttttaaaaaaacaactgaaactttgtttttcaaattataatttggatactcaaatttcaatttgaaatcggaacatgtcttttatatttaatattatttcgaattttatattcagttaaataaatattaagatattccttattaggctgtaataattatctttaataaaatttgcatggcaataaattatgtctcctatgaggtataagaccaatattagccatgggatcatggaacaatggacgatgcatagtaaattggtgtaggataaaaaagtccgtttgttttttgttgcactcatgcggttgcttataagcttattaacatcatataatcccaggtgctttcgagaagaaaaaaacatcatataaatcccaggtgaggtaaggttacgtgtgtggtggtttgtaatgtagcgttttcaccttgcgagaggttgcagtgtgatgcaacacaaatatatatttttaaaacattttctggcaagtgtgctgctcaggaaatcttctcttttctccatcccgtgctgccgtgcaacgtatgtcaacggacggtgtcaagacaaagattaattagattatgacatgcccatacccgataccaagaggcactcgcttgacctctttaatcgacttgtcttttctcacttgtcctatactgcaatttacgcaagatggaaggtcgttgtaacgtccattgtacttgattttcagtgctgtttgcagaaagccgggtcgataaaatggctgatttctctcttaaggataaaaagaagctagtaaatactatataatggaaaggaatcgatgttaattttgttacagtataagaggacggtaagcaaatgttctgaagagtcgaacgcgagactgccatttgcaccgtgcgcggtctcttgatctctctttttcatgtcgttaatttcgtcaatagattatgacacccgtgccatttcagcgttgacagctgccgacatgtgccatttggttgtaccagtttaatttcgcagctggttggcagctgtaaattttgctgtcaccataaagtccaaccgaataactgatcgaaactacaatatggagacatctcacatcctcttgtagaggggtagaaatgcacggccaactcagaacatccgtgcagcctcaacgagaggcgccgctgctgcaccggagagaattcagtagtgtgtggttttgttgcatttaactactccaaagactaatcctctcttgcatgcaattagtacaattaagtcaatagtgattcaggcaacagctagctagcagatataaagacggttctctgttcttggctgttttcttccaaccgtctcatcccgctgttatgctaatccaggaatagaccgaaattaattaaggcagtaatcacccagatgtgaaaaagaaaccaactgttccaacttccaagtggtctgttttggatcgaacagtgattggatcatgagctatgaccctttgaaaacttaatcattaaaaataattaaaaaagaaaaaaaacacaagtgtcaaggaattcagatttggcgcctcttttcatcgccatctttgaccgcgcaaacgccgtcgttcgcgaactcccccctcttaaagcccccaaccccctcgtctcgccactcgccacgacgcgacgcgacgcgacacgggagcaagcagcgcgcgcgcgctactccgaaccgaaggcccacgcggcgccatgctgctgggtgccatgagcggcggcggcgtcgtcgtcgccgtcgccgtcgcctacgccgccctggccgtggtggcgctgcggatggcgctgtcgtacaagtcggcgctgtacgcggtgcggcggctgtggcggtgggccgacgagtgggcgcaggcgtaccagtaccacgaggtgccacgcttcgcgtgcgacggcggcggcgccgagaacccgctgttccgcaaggcggcgcagtacgtggcggtgctgccgtcgctcgaggacgccgacgccgcctccgtgctgtcgtccgcgtcgaggaccaacggcggcttctccctgcagcttgggccaggccacaccgcgcgcgacgccttcctcggcgcgcgcctcgcgtggacaaaccggggcgacgtgctggttctgcgcgtgcgccgccatgaccggacgcgcgtgctgcggccctacctgcagcacgtcgagtccgttgccgatgagatggagctccggcgacgcgagctgcggctgttcgccaacaccggcgtggacgggagcaccgggacgccgaggtgggcgtcggcgccgttcacccacccggcgacgcttgacacggtggccatggaccccgacctcaaggctcgcgtccgcgccgacctcgagaacttcctcaagggccgcgcctactaccaccgcctcgggcgggtgtggcgccggagctacctcctctacggcccgctgggcaccggcaagtcgaccttcgcggcggccatggctcggttcttgggctacgacatctacgacgtcgatctctcccgcgccggcagcgacgacctccgcgcgctgctcctgcacaccaccccgcggtccctcatcctcgtggaggacctcgaccggttcctccagggcggcggggccggggacgcggaggcgagggcggcgagggtgctgagcttcatggacggcgtcgcgtcgtgctgtggcgaggagcgggtgatggtgttcacgatgcgcggcggcaaggagggcgtggacgcggcggtggtgcggccggggaggctggacgtgcacatccacttcacgctctgcgacttcgaggcgttcaaggcgctggccagcaactacctcggcctcaaggaccacaagctgtacccgcaggtggaggagagcttccatggcggcgcgcgcctcagccccgccgagctcggcgagatcatgctcgccaaccgctcgtcgccgagccgcgcgctgcgcaacgtcatcacgaagctccagcacgtgtccggggcggcggcggcgccgcggccgccgcacaggcggaacacgagctggtccggcgcgggcgggccatgggaggagcaggccgcgcgcgccagcgcggacgcggcggacggcggcgaggaggcgatcacggcgacggcggcgtgcggggtgttcgcgaaggacgcgccgatgagggagttcaagaagctgtacgggctgatcaagatcaggagccggaaggagggctccagcgggttcatgcccttgcacggcggcgaagcgccgtcgccggcaaacgggcggggcagcgagcacgacaaggagcggtgattaattaggcgatggtagtagaccccgtcaaacaagaaaaatatttttgattttttgtccgtgcttttttacttcgtgttaggctagtaggagtactacgtagttgtagttagttcactttttaattgtggatggaagaaatcaaacacgaaatggaggatgataatgggattgggtgatgtacaattgtacatgaggattgtttggttttaacagggtataaaacaaaagagatgggcaagttgaaattcttgaaaattgcatgtgaaatatgtctagttggaatgcaaactcccaactcccaaagtgctcgcaatcgcggcacccgcgcggctccggcgtagtcagctctgtcctggcgcgcgggagacagcgactcgtcgtcggcgtccagccagggcgagcggcagcagctatcatggagtgcgtgccatttgaaattaggccctctttatttcccaaaacaaaaattttcatgctgtcatatcgaatatttggacacatatatgtagtattaaatatagacgaaaaaaaataattacacagattatatgtaaattgtgagatgaatcttttaaacctaattacgtcatgatttgataatgtgggactatagtaaacatttgctaatgacagattaattaggtttaataaattcattttcctggcggaatctgtaatttgctttgttttaatgcttcaaatgtatatccatatatccgatgtgataattaaaaccaaaaattttcctcaaccaaaaaatagtgcgtctccagccaagccaaccaagccagcgccctgctgctatagcttacaaggtgatagctgcggctgcgggcaacgctatgtcgctcgccaaccaggtccaggtcgggggatgatgggtgggcgtcccactactgcacctgctaaacactattgtgccaatcttggccagcttgttgcttgttaggcacaggcgccgccgtttatatgatgagaccttttatagtgtttgcatttctaaaatggcatagatctaatggctcataataaaagataccttatgaaaggtatcagagatagaaaggtactaaggattaaaaggtaattgataatagggcaattatgtttaacaacgtatggacgtaccgaaaggtacggtgtaagtggatttgaaggtaccacaaggtaccgcgcaagtagtttttaaaggcaacgtaaaatatgatttatgtggtggggacaaaaattacattctcttctattcggtttccaatcttcggcgttctgtttgcgtcggtttccaaactttggtccgatttacgtggtacatatcatattcgcatgatcttgataattatttccaattagtcattaatttacatagcaatttggtgatccatcgtttgatgaatgtaatcaaagatcaaaaggacaacaaaatgagaagatttacgcacctaacaagaacaaaacaagttcaatgagaaagatttgcgaaaaaaactaaaccaatcgtctgacagatcgagaccgtgcggccgcttctagctccggcgaacataggcagtcctggaccacttcctccgggtcctcttcttccgccgcccctccctccaaccaccgcctccggccacacgtccaccgccggccctcaattctccacctttcaacttatcaaagaacacgtaaaccttacatacgaacagaacgtatctaagaacgatgcaacgcaacaggctacgagctaattccttcgataccttctcataccttttcatatgtgtaaaagacacatttgtcattctaatatcatcatatttacattaatgccacctattacaatattttctttccataccttgcccctcgcagatcaacggctcacgtcgccccacctccttgtacctcgcaaacatcgtaaaatccctcttatatgatagggaaagaaattcacttcctattggcggcgattgaattgtttcttaggagtactaaattcttgagaaatttctacttacattcaaaacggcattactctctctctctctctctctctctgaataggagtattaggagtaggacagtaggagtactgatgaatgcgaatcatgcctggctcgatgctggactgatgatgatgagtttaggtgtcgggttgaaagacaatgatagccgctaattgccgctggcctgtacaattccctgttttgattacgagatctctttgtattattgtgcggctgacaggaagatcgatgcacgagtgtatggtccttctgcctttgggttcttggctaccatttgtttcgcttcattcttcctacggagatcacgcgtgtcagcacagctgttccagctcgcgctcgggaggttttcgtctggtgatctggaaagctcactgcctaattgatgtactcgcagttttcctttttctttttctaatgcattttaagggacatatcgcgtatggtccttcgtaatggatcaaatgctaatgctagaagtagcaggagtactggagtagtaaatcacagcaacatgaggtatgctactacagtaaaaaaacattaagagagtgctccaatataatgatttcttaaaataaatttatttttgaataaatgtgagttaaaactgaacttcaacaagcgaactccaatgttgggctttggggaaccttaccatgatgtggaaacactgaaacagaggtcctgtcagtgcaaactggacaatcgcaagaggctttttccccggttataccggaggagccacccggtggccatatggatttcctggcagtagttaccatgcagtcctagtagctacggagtactgcatttgatctcaatccggatttccttcggacaaacctgaaaagccgtgagtgcaagattgcttgtcaggcacatactgacctgtccttctccgttttttatcctgaattacacagcataggccctagggtcagaccactccaggcctacctagttttatcccaccgttacattctaaagtgcagatatgattttccatgcacaattttaaccgtctgttttatttaaaatattttttaaaaaataaaatataggttacgtataaaacactatttatattttatcatctcataataataaaaatactaattataaaaaaatttaaataagacgaataattaaagttggacacgtaaacttatggttgtacttaaaatgggataaagggagtactccactcctaagactacgaatctggacaaacttctgtccaaatttatagtcttatgtcacatctcttaaaatcccttatattatgggacagagagagtattacgagtaggttttcacttgtttgcatgtactcctgggcacttggccaggaaggcaggaactcaggatgcaatgcagtcacggacatgatgagctgatgaatctaatgccttgctgctgggctggacagtgttaggtgttgacggtgaggcttgaccgcttcccccatttatagttggttcacacggccatccagctttcataaggcatcgcattcatacaggtcagctgggggcgtatttagttccaaaataattttttaaacttctaacttttctatcacatcaaaattttcctacacatataaacttctaacttttccatcacatcgttctaatttcaatcaaacttccagttttaatgtgaactaaacacagcctgggtgcaaatggcactccagcaaaccacaatggtgaacgctcggcaggtatatgccatgacaataccagatgataaaacggcaaaatcttttgaagaaagggcaaatttagctataatactgacactgtactaattaacaacatataaacaatatattctggtggtctataaatacaataatccagtctcgcagctcattggttctatactatattggccaagattggcatccatggccatctcaattcttaatgataagtgcggcccgaaatactatatggataccgcagtctctcataaccaccttacactagtcccccgaataaataaatataatcccaagtaattaagtagatcgaacaaatatacacaaacatacataaacccaagctggccatcatcgagcagcctttgttgctatgcatctcaaagagctctcatctcctcaacagttcgatgcagattcccaagtcgaatccatggcacctctcagttttcctcccttcctaaaagcgcacctcaaacaccttgttggaatccgattagccaagcctccaggcatgagccagtgcaggcaaaacttttagtcgcctgaatactgcttgtactaataaaaagaatctggctcaaccttaacatgtcaagcattgtccacctccctagtgtcgattatttcttcgtgacagtacagtatttttagctcttcttgtagctgaaagtgatgatagagatccatcatatataatgattatcaaatgtacatggtgtccatgttaggattaaaattgactaacttcatgggtgccatgtttaatgttcactattgtcctatatatttataaaataggttttgccccctcccccacaatttggcatttttagtaaagtaccatatggtctaaatagaatgatccttattgtaggtgacctcaggtgtcaatacagtgaagaaaactaaacagacatgacttactgacctggacatgttgcagttttgttgtgatcagttcatcggttaatgaaatcattctgcaaggtagaaaggtatgttactgcattgatcatcaggcaaccattggcatgaaaaatagatgttttaataacacgcgccattttttctttcgccaggccagcggaataaatgccgatcaatttttattaagatggaaggagagccatgttacgaacaacaacagagttgttgaggcaacttgccctggtcggtcatcctacagactaaggacctgcacattttacagctcgccgcgatttacaccggcggcgctaaagcgagcatcactatctagactactcccactgccttaaacgtgtcatgttcaagtcttgatttgagcataaaacagagcataaacataatactatggcagctatatccaatagtttgaggtttgccagtttggttgagttatgaatacaaggcaatgttttggtagctggtaacattgaataccaggttggaaattcatccaaaagattaaactgatggagaacaatgaactcttcacaaatgcttcaatccatgcacccctctctaacgtggaggctccctttggattcacacatgttgagttgcatatgacttatgagttgcatgcaccagccagcttaatataaagcttaagttgatgaggaaaactaagaaattcacttgtacttcaatggtacaaggtggtgacctgagtccgtgacgactgggaaagcatggttacggtagaggaatgggcataagcaccacggatgtaaggatgcaattaccacccctaaatatcagttgcaagtaacaaacctacctagattgcaattcaaatattttgacaagtaatgaccgttctccctcggaaatagacgtttcaacctgccaaatgattgtgagcaaactttgagttaatgaacatttggtagcagtattgagaattctttgtacagactatgtacagactaatagaaaagaatgatatgtgggaaaaattttgacaccaagctaataagcttcttacctctgtatcaccatccatattaccaagtctatactgtgttgctggagaaaacaaacgatttaatcgtaaataaaggcgaaaaaaactttcagcaaatacagaggaaagtatttaccgtcagctttctcattctgttgcaagctacttaggaggtttgtgatgagatcctaagtgaaggaaatggagaatgtttagtttgccaaaaactcaaaatactgcaattaattatactgcccatacttagaggtcactagattaagctactcccatacttgctgaaatgtggtctgctgtacaagattccgtagatggggaatcagaacggacgcagatactgaaccattgcagagttccttccgctgatgactattcgactgcagcatcgatgggggaaaaatgttatctattgtgaacaatcttaaagcatggagaaggcacaagggcagtggaaactgtataagaacaagaaggccattgcaattgcatgagctgcactagccagagatatatagttctgtagcaagtgtcactgaaaagaaaatactaaaatgatatgttaaaagggttgaaccttggttgcctttctaaatcatctagtggctcaaaaatcggagataagtgtcttaaatgatatgaagaatatactactagtattttcagaaaacattaagatccagacaatgacatgacaatagaaacagaagtacagaacaatgcccttaatcaaaccctagtattcaaaacttgtaaggttttattcagatgcaggaaacatttcactaagaaattcccaaccagcattctctccaagaaaaaaaaaacagtttttgtctgaatatcaaatcacagtaagtaattagtttctacaagttggtacattattgacattgaaaagcttaccattggcttagcatccaccggccaatgaccaacgctggctgattttctcagtgaagatccctgagcaactcaagtcatgacacttgatggctggatgtgggttttgaagtagtgtagactgtagagtacaacagagctttcaataaaatggatagggcacaaattcttacctcctgtaatttgcgtgaaatgccgcttgttggaacttcctgaacctgtcaagtaagattttaattagtatcccttgtagtgatcttgctcagtctggagcacaacctattgaagtgtatgctcagaacgaaacctacctttgcaagatccacattctcagatgtcactgaaaaacgtccttttatctccaccacactacgcttagacttatctcccaaggagcccacatagcctgcaaataacaggcagataatcatatactttccttcagttcataaccacagtgaattcaaatgatctaatttatgttacaaaagtctgtaaaccttaaatgtggtcatttgctatgttaataatattaacacgtgactgctgtttatcatgtgcatccaaaaaagtactggctgcttcctacctccagaagaccgaataggagcagacagactatttgcagaagcacgagtagggagtgcaagaggaccactgagatttgtggttctttttgtacaactcttttgtttatcagatgccaacttaactgccgcttccctgcagcaaggaataacaataaccaaaagtgcttttaaaatgcaaatgcctttttgagcaatttgtttcagcaaaaaaattatgaaacctcctaacttcataacagtactcacaggaaactcaggtatgcaaatgcctttttgagcaatttgtttcagcaaaaaaattatgaaacctcctaacttcataacagtactcacaggaaactcaggtatacaaattcaagaagaataactactaatttgtttctataaaatcaattattgcatgacctaagtcaaacatttaagaactaacgacacttgaaagctcaaatattagccgattttaagggggaaaaaagcatcttaaactgtaccgtttcatttctgaggcatattcatatgtaatatttcaaacaggaaagtccaaaaaaaacatgcattaaattattggtatgcacaacattgtagcagccaagtaatattaaaattggaataggaaaaaaaaacagtgaaaggcttacctatcaaaaatgcgactgctttcagttattgatttattatgtacaccagaacacagaattgggccagagcaagtcctttctttttgtttaacttcactactactgttttgtccttcagaatcatgttttgatgtagagggtaacgattcgttttctgacccttgttttctatatccatcaactttcctttcactatcagcatcaccaggttcagaaaccaatcctctgcttgtctcatgcatattcccccctggacttactgcagtgacacaagtttgttcactgaaatgtaacaaaagagtggaacattatgaacacactaccagtaacacagaaaagcatgcatcaaggctcactgaatctttcgcttgttttaatttataagaccaaaatttcaccctacaccacataaaataaaacttgaatcctatatacttcgattggtgatgttgagaatcacaagctagggaacaatatagaacatctatatcttttaaagaaaacattgccacaaaaaaatattgcatactgattcaacctgaagtgctttccactcaaaatttttggttgtccaaaatgattgccagaaaacggctcctgcaaacagagcaatcataaatgacttgaaacagaatcatatttggtacataattttgtcttacttacaagaaatcaataagctatgacaacatggtgtgcaaatgtttctgcagcactcagaattagcgagaaacaataacaggatcagaacataagcatcttccagatttaaacagaagcatttgtggcattacaaatgaccctgacttttcaaatttgataaacggcaagctcttttctgtgctttgaagttaaacatgtgtgatacttcttctatttgacacactagataaagttttctcatgatcccatctagctacagttattaccctgtcttaccagaacgcaagcctacgtctgaaacaaaatcaagtcgagagcagctaaccttatcagcttcatttattctatcattgtcaacatcttcctttatttcaggtggatcatcatcatgaatctgcaaaaaggttggaaatctcacttataagactaaattacagtcattttacatcttagcaatgtaacagaatgaatcagagagcaatgtagcatttcgatatagaactaaagaaactggttgttttaccaatgatgcttgagcctttaaatcctcaatatcgaagttccatgcgcttacgcctctttggtactcactctattagataattcagatgataaggaaactatcatgtaagtgaaataaaagtgcaaacatatctataataaaccaaactatgtttatcatgaatattagtttgtatgtggaacagaagtgcaaaaatcattagggtattacgtccatggagctaacaagtgaaagaaaaatagaagttagctactgcctgtaaggtggactagctaaagtgatctctcgtacaaatcattgcgttggctgaaatgtgtcttagacatcatattcttagcataaatatagtgacaccatagcatacaagtgataaaaaaatttaacgtcattttaatttttaaattaaaaaagcatcaaacatagtctaatatgctgggatcttaaatcattctgtgctagtccttgttcaaccaataacatatccatgcatgaaagtaataccacagttctaacttcattttgcaagggctgggatttgtgttactgcaaattgaccctggccctctacaaatttgtttttaagctgcatctactgaccaaaatcattaagactggtatggtcagtgataataaattaaaaacaaagcagaagatttgcctgtaaaatgaatatatataataccaccataaagcctatttcagaagtttgtgggtaaaataaactagctagcatattttcatgaactcaaatgaaagaacagcacaaaacaaagtggaacttaaaagaaacatcaaaatcacaaaccatagaaagtgcctcctgttcagaagaaggcattttcttcaaagctaattgtgctgcatcttttagctgcaaatgcacaggataacaggaattaattaaggcataatgtttccatcattaagtaaaaacaaaaggaaagtaaactagcaaaacctggagcgcttttacacgatcccacagagggggcaaatcagttaaaatactcttaacagtcagctctggaggttttgcgttcttgaaaaatgagtgctttagtaacttttcagccgttggcctctttgtttgatctttgaccaggcacattgcaaccatttccttgaaagactgataacaactgaaaagccttcattaggaggtaaacattgaggctaaaacaagcagatactgccataaaacatagactcgctagccaagaattagctgaaaggactagtactacctttgagaatcttttatcacggtcatagtcaaggcctggtggtgcattttgaagggtcatgagaagaacctacagaccacataaacatcctcagattctggcaaaacataaacatcctcagttcagcagaaagtttgtatttgtaggatcctaaacccaagattgttttctatgaacaagaatgttctacaggcatattgctaactgcatggataacgctgttcatcggcagtaactttaaagtccaaacaagtaatttcacgagaagaatgtatgtgcatgtagtatatggaattgtatacaaatgacagaacatgtattgcaagtgcaaagtacatatgttttctagcccaacatgacatacaaaaatcacaaaaacatcatccctggcagcaaacactaaccatgtgaaaatttgaatataagacacatagatatttggctgaccatgcacttgttaattagactgtcactctttttcttttaataaaaaggtttcaatttgcaaaagataaaataattcattgccttcatgggaggatacttcgagaagggagcatggccatgtgctagctccagtgcagttattccaaaagaccatatgtcagctctgtacaaggacaaatagttgtgagcgcactgtgcacctcaacagtacaatagcaaccaagtaaaatataaagacatatatagtagaaaatacagaatgtttgaacacaagcagcactgcagttacatgttgagtgcaacgacagaagaaaaaaagaatgttttagttatctgccaatggttcactgaagcatttgataccaaaatataccttattcccagtatttttatggtagttagagttcttacccttaaggaaattttaaataaccaaattaagttggtaaacaaatggtttgaaacatatttcctggtaaaatattttaagaaacacaattttatctaaatattgaaattaatatctaaatattgaaattaactttttcaaaataaccaggatactggtagctaacggaacaaggttatgctattaccaacgtacttgaaattatatcctgctccaggctggagaacttctggagccatcctaaagaccaaatgacagcagaaaacacgtttaaaggtttgcagaacacttattgtacatacaacagagaaaacgtaagaaaactccagttaccagcatggtgttcccacgaatgtattcctggatctttgtctatcacctctatcaaacatacaagcagagacaccaaagtccccaagtttcactataccaggactgtccataaggatattacccgcctgtataatattacgctgagcaaagcaactgacaaagttagctaaaatgaatactactgtagaagctaaccttgacatccctatggatatgtccttgccgatggaggtactctagagccttaagtgtttcctttaggatagaggcgataacaggctcctcaaaaccatcaggatatgcaaccttcatcaggtgtaaacatgaaccctctgacatgaatggcattatcacccagaggttatgatccacaacaaatgagcagtaagccctgatgacattagggtgatctatcaagctcatcgtttgtgcctcttttcttatatcatcctgggtacaatatgtatatataccactatgagatgctaaatacattattgaacttggggagaggatcattaagagacctcaaacatcagcctataacagtaaatgtatataattaatttactgcaggtaatattcatgaatcctactacttagcattaagatagaaagaaaaatagacgcattcatgatccaatgcaacaaaggtgaaaagtactacaagcaaacaagctataccacaacgtcctatacatctaatttactggatcagtaacccaagacaactgcatgtcatcctataagccgcaaatgcactgcccggaagaattaaatgtaggcctttgtgaagttaaccatccactatctatgaagttaggccgaggatgaattaaagtgcccatggataaggaaccccacgttgtctcgatatagccacaaaacctaataaaaagtaaccgacaaaatgaacaatacgaacgatcgaactaaaaatttgctaaaatgaatagcataagtgagtggagctaaatcccgactccgcaaagcacagttaccacaacctaattcttaagttggtaccacgtcaatactgatcaatagaataaacaactttaattggatcaaattgtcccaacttgacacaacacacacagctcaactgcatcgaatcctcccctgcacgaccgcatatcccccgatcaaaacagcgatcaccaccggaatccctaggacacgaacgagtgagggagtttcgatcgagagagagagagggggagagaaagctcacgaggttactgttgacacgatcgagatccaggcacttgacggcgacggtccggttggatggcaggaacaccgcccggtacacgacggcgttcgcgccgtagccgacctcctccagaaggcggtagtcgccgggcgaggcggtgaaggccgtcggcaccgccgccgcggcgggcgacgacgacgcggccgtccgccgcacactcccgctcctcaccatggtggccccaccccccacgctgagcagagaccccccgccgtgccgccccccacctccggcgatcgccgtcggtcgttgactcgtgtcgcgcgtacgagaccgcgggtggactggtgactgaaacgaggaagagaagagagagagacgatggggagaaaagggtgggtggattttgggaaagggaggaagtaattattttggcgtgacgtggcgggcatggggcccgagaggcgggggccgtatgagtgggcgtgattggtggataggctatgacatgtggacccgaaggcgtgggtcccgtttggcagtgggagtgaagagatggtggctgtggggtagcggagtgacatggggcggcagatgccgccgactgtctgagagatctccgcctcccgatgttggtctgtgactaggatcgtctgcaggggcttccctgtggctgataacgtttgttgagacaaacatggcatatccggatgcacatcctctgcagtgggttcacacatcagtgtctgctactgtatcagcagtactgcaggcaatccccgctagacatatctatatcattgcgtcaattaggtttttaaggagtatacttattttgtaatagaggtagtagtacaagctacatccctatcaaaccagacttgctaactatgtggtgaaagtttctccttatgcattcgtagtaatatattttaaggatatctgtatcgtataatttatatcattacgttgtatcttagtatactattttatctctgtggtatgttgggaataaggttcaaataaaagtttatgtgtcttttcaagtgttaaccaccccgtagcatgtcttcgtcatttctttgtgtggttgtactgcatacatatgtatccccactgttcatgacaaaaggcatcttggttttttttcacaattttgcagcccaatgattgtcttagtacctgtgctaaggacgaattatcaagtaaatatagtagttatcatatgacattcaaataagaaagataatatatgcaattgataattgtattacatcttgactctgagactaagataaagaaaatccccttgtaacccatttgtaacccatttacttatgcctctctatatactcgtgttgcacaccatcttcacatgaaggtccttattggttggcaatatctcattaattattagctcctaacaaataatttgaaagtaaaacttttatctatatgtgagtatgtccttaacgaccttaaaactaatgttgaaaacgaactacgctgaaagtattctaaaaacaacctcaaaatcaagtactaaattttaaattttggcaatgctttattttttataagggaaacaataagatcatagaactattaaaaacacatacaactcgacggccacataaataacagacgcatcgtcttctccgaatgcaaatgttctgcattcaaggcattcaagccaaccagactttctctgcatgcaaccaaacttcctctgcatgcaatgttttgcactaattatttatgaaatttcttcaaatcaattatgcgcttatcaattataaattagaggaaatacatatttttaaaaaagtaattcgataggtggccaatattcttggatcaactagtaaattacttatacacagaaatatcctttttaaggtacacggaaaatatttgacactgaaaagagaaaaggggtagtaaggcaacgaacccacaaagccgatgggcacagaggatccgcggtcgtcgggagcagagcaggctagcgtgtgccgctgcggctaccaagccggtaccacggccgaggacggctcgtacaaaaacggacggactcgccgcttcgcgggcccaccttcagccaccgtacgatccaaaccagcctcatttactaccaccctcgctggggttggtttgctgccgacatacgtgggcctacgatcctagatgggccggccccactttgacagctactcctactctcatgggcctagtacccaaccaggccaccagcccaacttatatcagaagacaagtccaccccatagcatcatcgtctccgcggaaccacgcctcgtcgccgccgccgccgccgccgccgccgcgcgacgtcctagcttcccggaccgcctccgcgtggttggatccggcgagaggggagaactgttgtgttccttggaagcgggagctggatgaaagctgggaggaagaacctacggcgggcgtgcagcgagggcgccgtcacgctgggggagggcgagagcatcatgcaggtcctcgcgctgcgcggctccaacgtcatcgaggtaggacaagctctctctctctctctctctctctcccacctccaggtctcccctgatcgtgaattcccttgcactccattcgtatgtgttccttatcgccgtggcttgctgggtgttaggtgatggacgccaagggagtgaagtctctggccttgttcccggccaagttccagaagagcttttggatcaagaatggtgagtggtcgccggactttagcatagctggtcactgctcccgtagtgaaccgagctgtcttttgccgccggtttatgacggtttggttgtgggttatgtgaatttgcagggaattttgtggttgtggatgctagtggccgggatcaggcgctcgaatcagggagcaagatagcctgtgttgtgtcccaagtcctcttccatgaccaagtccgggctatggagaaatctgaggaatggtgagttgcttggttctttgatcgctgagagttccctagtagtactaacaatcagggttcagggcttccgagtgtatacaagttgtaggaaaggctggtactggatatcaatctgtgaccaggggtaacttttgaaattgtttgccagtagctgcagattctgcatttaatatgcaaaatggcaacaagaaattcttgtgcaactttggttgaggtattttgcctcatgagtcaagaaattgtcaccgatgtatttgttggtgtaaccagcatgaataacctcggttatggtattttgactcatgagtcaagaaatgtcaccaatgtatttgttgttaacggcatgaatagttttcttcaagctatgctctgtgttgtgaccttaggtcacgaacaagatcgggtataggccggaaagaagtgttttcccgcctatccttagaaatgagctcaaacagcaaacacaacctttgaggattacttttgtattaaaaatgtcttgttgtgctacagggatttgaccggcttttatagcctacggtcttacatgtgatgttacgtttctaccctcatgggctttagtgaacttcctataatgcccttgccatgtcagcaaccctaggggtactacagtacattctcggggtcattatagtcttttggctccagctggcaagggtggttgagaagtggcccccacagaatcttccattcgactggatcttaactcgaataggtttttccttcgagttctcttagccgaatgtcttctatgcttgagggttcgcacatccttcatcaacttcccgatcgccagattcacctgccatgtacttagaattcatccccaatcaagatgagttacatataagtgataagaagccactcgagggtgctttcccactcgagagtattttccaactcgaaagtgttttcccactcgagagtgttttcccactcgagagtgttttcctactcgagagcgttttcccactggagagtgttttccttgttttacacttaggaactttccataaaccatcttaggtgtttcgaccggataagagggagggcgttgtccccctgttacaacactctgatgctcatacaaaacaatcagatttaagtgcaatatttgctccttggtttcaaaagcatttgtgttgagctgcgaaatacaaagtaacgtatactgtttttatccctagtttcatctagggtccagtgttagtgacattggtttatagattgtcatggaactaaaatatccttgctgtagtaaatgcttgtgaagagttctgcagaccattgttttaaatatttgaattctctggcaactttggattaaagtcagttgcctgatgtcacctttgcatttcaacagcctgaatagtttgctcaggttttttcttgatcaaatatccatgaaaatgatgtgaggaatctataacaataccacagcaaaactaagacttcaacttattgaattcatcagtccccgtttatcatgtaaaccgtcaggttctctaagaactggaactataggtttaattatatgttagtcaaagggtggctttactgacatcttcaaactggctctctgatgaattcattattttcgtacatactaggccagctatcttcaagtcaacttctaaggaaggttcagaagctggaacacaagaaggaacaaggccacagattgaggaggaaccggattctgatgaagatgatgatctgccaccgcttgaggcgaacacgaatagacaaagaccatttgaactgtatgccgactcagagagtgattctgactcttagactagtttacatttgaacacgccattgatgatgttgtggtttgtgatggaaaaatacacccggtgtacttatggtcaagtcttacattctgccaaaaactgctgagtgtcaaaatattctgaagaagttcgatgtcattcagtagcaggcacaaggcctttcacttgaaactatgatcaactccatatgttgctttttattgttctcaatgatggtgcattaattgtctggacacagcctgatcaacatactgcattttctatcaccggttcggaattattcaagcttgttgtgtgtcagctgtttggctccaaagcttggcctgtttctcaattctgcagatactgctagctgtcggaactcctaagctagagctgactggccaaatcgaatgaggagttgaagtatcaaagtcattagtcataagcgtggaaaataatccttcttgtgacgaccttctggatgaagcgacggcgtggtaagatccagcttcgaattaaattgttgatttgcttatgctgcaatttatgttcacgatcatgtctgctactagcaggataaggccccaaagagaatttgattttattatgggtttatatattccatcaagtctaattattagtcagggagtgcgtctgtatcggatgagttgtgtcaatgttgagttcttaataaagaataaaggagttctttttattaataaagaacaattgacactggcaacttggcaagcacagatgagttctttttattaaaaaaaaaaattaggactggagcattattactggtaagcatgtactcctgggtggtaccgtggtagtagtcaattacgagaaagtttcaaagaagtgaaatttgcaaccagcagtgtggaccggctccttttctattacgcggatttggttgagatttcggggctttttggacttttgtattgcactgcagatttccctacttgcttcacagtggtttcccagattttgcaaccaaaccatcccgatatttttggatcacccgtataatattcagtcaatctttcggcgaaatttgctttggcaacttggtctctgctgttgttcacgattctattatctatgcaaagatcagtgtcacaaaattcgttggagaaggcaatttcgttgatcgatcatatgtacacactctttgagaagatgatgtgaaatcttgaactaaaaatctacaaaatttggacattttacacttgaaaggtgaaagaaaaaaaacgaaagggcgtcctcttggtggccgtcgcggcgagcgggtcaccagaacgcccgtttccgccggaatcgcctcgccgtggcgagaagtccgactccgacgcagacagcccatgctcccatctccagcgcccacgtcaacgtctccgcctccatctccggcgtgtcgagctcgccgtcgtctccgaccacctcccactcgtcatccccgcacgtcccgcactcgcagtcgcacccccacccttcctccggtatcccctccagcctcgtgccgccgcacccgagccccctcgccgacgccttcgccgtggccctcatcagcgcgccgccctcctcgagcaccacaacctcggccaccgccgccgccgcagccgcacggcggcactcgacgcgccaccctcctcccccgccgcggcggcgcgagaagacgccgtccgccaccagatccttcccggcggcgtacacctcgaagcgcgccccctcggcgacgcagacgcggtcggcgctcgcgtacgccgccgcgtcggtgccgccggcgcccaccctccggagcggcacctcggcgggcgcggccggcgggagcgcccgcccgccgagctccagcgcggcgccgccgatggccgggaggtagacgagcgtgagctcggccggcgccggggacgagaggcggaggtagaaggcgcggacaccgaggcgcgcgcgcgcgcggatggaggccgccatggcgtggcggccgtcgtccaccgtggctaagcacattgctgctgccgtgtgctggatgcgattgattcgcggaattccgtgggtgtgtctgtgtgttgtgtcgcgtgggcgcgaggtggagagataataaagcgaggcgggcgggaggaggaggcgggagatggagatggggatgcggcggatgcggagggtggatcggtgggcagagcggctcgcggttttgggcggtgcgcacggggttttgtgggggaatcagtggtgtgcgcgtgcaggagcacacgggtttgggacttggggtgctcaggtgggcgcgcgtggggagatgtccctgggttggcttggatttgtcattttccggttgctactagttgtgctagactacagtgtttaggaagcgacccgccgacttggctgtcaaccacgccgaagaattggtggctgttagctgacgcaaatggggggtcggaaacgtgtcgcgatctgcaatgggttcgtgcgtacatacgcgagggcgaggcaccacgcatcagtccatgggatcgcgctcctacgtgggttctacgtgtacccacgtccctctggctttacgttaagtcagaggagactcatctcagtacatgcgcatgacattttttcttgcagtaactcggtaactttctaccagtttcatgtgaaccgagttaaccgtggtagtaccatcttttttaactagtcgtgctgattgtaatacacccccttttgaaacgcactgtaggaaacagtaagaggagctctccaattactccatcacatcaaaaatctatttatattattaaaggaatagaaaaaaaagcctccacgttcgctctcatggtctagaaattctcacattaatcagagaaaaagaaaaagcagagttcatatagaaatacaatttagaaatagctgaaattcggaattaaaaaaaaggaatattagaagaggagactagagtacacatagaaataatttagaaatagttgaaattcggaattaaaaaataatgaatattagaagagtagactagagtccatatagaaatacaattaggaaataatagaaattcggaattaaaaataaagaatattagaagtagagtatagagtctatatagaaatacaattaagaaaaaaaaataaaaattcggaattaaaaaataaggaatattagaagtagagtatagagtccatatagaaatacaattaagaaaaaaaaatagaaattaggaattaaaagataaggaatattagaagtagagtatagagtccatgtaggaatttaaaattaactaaaattcgaaataaatataataaaattaaaagtatagtttagagtccgtataaaaatacaatttacaaataactaaaattcgagattaagaaaaatatgggaagaagagtttagagaatattgaaagatgagtttagaatcacatagaaatacaatttaaaataataaaaattcagaaataaaaataaatattattaaaagaagagcataaagtctatatagaaatacaagttacagaaaattcggaattaaaaatatatattaaaagtcgagtctagagtttatataggaatatatataatttacaaataattaaaatttgatattaaaaataattaataactaacacgtatataaaatacattatgaatattacccattagtagttcgtaaagttattgcaaaatttaaaattatgttgtcattttaatatatttgaataatatattgagaaaacatatatgctattatatgagagaaaatataatgattcgccaccatgctagttgaactaaagaaaagttctccaaaaggtctaacatcttaattaccttttgaattaatctagaaatgcaatactaggaaaattttcatatcctcttattactacgtatagaacggttctacaggtaagaagtccttagcaaatcgaatcctccatttgaatagtactcgtatcaataatttcgtggtcaagaacacgaaatgatactcctataaatcattttaggtcagaaaagagcctatgcagtcaacagtgcgattcctgttgaatctgcaagatagtatagtagtcaataatagattacacaggagcgcagcactccacgttacaatgcgtgctctactatccactgcgaaggacgcagcgcgactcagctaaaagtttgagcctctaccatactacaagccatattgggtgcaatggcaatgtcaggttcagaagcagctgcctacctgacccaacctctcgtcttgttcacggctggttgctgccttgtggctctggtaacaggacccgtcttgtgtgtggcagcggccgtctttgaagttgccgtcacccgtcctgggttcttcagcggctcggtcgattttctcttcagccttggctcaccttgcaggctcctcttccttgaagcattctggcttccaacaggctggttctccaattccccaccaatcgatgaattccttgcatctcctttcctcttcttctcattgacaacttctggagccccaacaatggaagaattgttggtgactttcttgttcatagaatctgagcttctcagaatgtgctgctccttctcgctcattgcttcctctcttgtcaagaggtgcgcctttgcctctccaggagtactagcaactctcatacagttggtcgagtcaagtatcatgtttgtgtcctgaagtgttgtcctttcttgcaagttattctcaagatctcttggctgaaatgtggagaggttaaagtccacattattttcacccctttactgtaagaatgggcacaatgtagcagttctgagaaaagagcttaccttgatctgaagcatagcctctgttctctgtgtttccaggagctcctgtcctatttccattgcctacaaaaaaaattcaggatgatacaagtgtcaggtaggttaggaaatatgtatattagggtcagagacactagccacatgttacaaatcaccttagattctgcaactgatcgatggtgttcttgttccttcaacttgagctccagctcctttatctgaaaataataatataacaataaagctatgtatattagggtcagagacactagccacatgttacaaatcaccttagattctgcaactgatcgatggtgttcttgttccttcaacttgagctccagctcctttatctgaaaataataatataacaataaagccaatccaaacctggaccttttcaattaatagccactaacagtttaatgttaaatttgaactgcaacctcagattctgattgctgctggagtctaagtttatgctctgattcctccgctatctggaaaataaaaaaagaatgggtatatgtctagagtttagtaccctgtgcactacagtagctacta

SEQ ID NO: 42835 - DNA, 1378 bp, Oryza sativa
agattttggcagttatcttccagctttctcaaggaatcatccttaagtctgatatcctgtttagccctttcaagctggcatacattcacagaaggaaaagtgtggaggagtttatgtcattggctcagtttcaaggaggttcagatagccagcttgaaaggaaaggcagtattattgacacttaccatctgtttgaccttttgaagttctgcagtgtcaacctgcttctttgctggacccaattctatacgacgaacacgacttgcaaagttcaatgagctcaaagtttctgacacatcgttgttggatgggctaatttgcacaaacattaaagcttttgagtcccctcctattatcagtatgaagaagcaccaaaagagcaaattaatgatgtagctaagtgaaagacacacacgataattgctcaaaaaatacatagaagattggaaatattgaagtgataaattatgaagatggttctcttccagaagaacaggtcaggttacctagagaatcttgcagcaagtgcgtcaactttgaattcctgcccagaaaaggaatataaacagtgagaaacataaactgatgggttaaacaatattcctttatgaagaccacaaacctgtagggaatgtgggaatttttcgttgcaagagctgaaatcacatcacccaaagcagaaagtgatctgttaatgttttgtgcttccttaagcctttcaccttgcacatcggtcttagctaatcgttcacttccagccaaatctacaagccaaagcttacttcttgtacattctccattcatcaggttctccgctctcaccatgatgcaaagcatactgaggtacagatataaaggtcaaaacattttgaccagaagcaagtactctagaaaagaaaagaataataataaaattttgaccaaccagtgggagcgactgctgtgctcattcacattgtttgatcctacagcccttgcattgcttccagcttgcaagacatcccaaacctccttgatgttctcaactttggcctccacaatgccagggacatgatgggacccttcacttgcctgtttgatttccaacctaaaataccaagattacaagttatcacaggatggcaatattatggaacccagcacagatcctaaaagaaacggtcatacttcttagacgaaggggatgatgcaagcaggtctctgatttgctcattgtagacctcaagcacgctgacagaaatgctgtatgtgacagtctcttttctctcttctgcgattttgaacaactcctccagagttctataatttactccctgttcctctcagttccttccatggtaaaagtcttccctgctcctgtttgtccgtacgcaaatat

SEQ ID NO: 42836 - DNA, 13372 bp, Oryza sativa
gtcttcttagctgctccaccgttcacaatagcaatgtctccatcttttgctccatcaaaatccactgcacatttgtaacctgatgatgtctcatctttacttaatgggcggcaacgacagaaaaccctgatatttcctggaatggcatgtacagccagtcagtagaaagaaaataattatatatggcagactagaaaaaaaatgtgaaagcaccataatacagaggagaagatcagaagaggcaggcacctttggtctcctcaacaatattatgaagtttctttctcttggccatctcttcatagtacttcagtttaagatcttcacactgtgcaactgcagcagaaaaaaaatgcttacaaactttttcattttaaatgctctgaaacctttacaacaatgcaactgatggatattacctaatgtttgaacagctcctatcatcttactcagatcaggaacagcgtttgcacagtcatgtgcttcaagagataacagtgtttgctcttgtttcatagcctgaaaattaataagtgatataatcagtaaaacttggcacgtattgtatttatcaattcttgttgtagcattgcagacagtaaatctgcttttaccttgattttattttccaagttagatatggcagctgcccataatttcttggcattttcatacttctgggaaacacttctcagttgatcagcttgtctatcaacgacttgttctgtcaggaatgtagaacagcggtgagcatatataaacatttaggaaacaaagttgattatcctgatagcttagttcataccaatattatcactttgcatgaccttctgatgaagctctatcttaagtctctcaagctcctgattggtagattccactgaagaccacgccatataacattcatcagacttcatgttgcactggttggttagctcctcaatctgtttctcatactttgagattaatttacttgtcctggtctgcattgtagattgatatgtatcagtattacaccaaatatgattctgtaactgtttgtgaaaatactgacctgtaaaggtgaattccctgtatgagctgaacatcttttgcataagacattcccttctgtaaccatgtctgtcactgcaagttcatgattaaggttatcatgctgaaaattagaccttgaaggagcaagttgcatctaatatcaatgtcttacctgccattgctaccctttttcgaatacagatgccacaaaccatgggacttccccttactcctttgaagtttatgacaatggcactgtcactctcaactgtcactctaatatcacgcacctgaaggggtctgttacctccaaccaccgcgtacacatcaagttcagacaaaatctgcacatcaatcaaaagtcaaattgtttagctagacatgaaaataaatcgtgatacaaaactaagagtcacatgagtcagtgtgtttgccttttcttcttggacaaggacatcaaatgctctaattccttttggcccataagtgttcactatctcagcaaaatgcagatctaagaaatagtctccaggagcaagaccatcgattttgtagctgaaatttccatatcgagctgagtggtaaagtgaaggatagtcaccaccttcaactatatcctcagatgtctctattgcatcccctccttcaaagaaagaatcctcagaaagctttgaagagggttcacaaccttcagttgcactgccaccggcattaatgaacagaacagagtcatctgtttcatcacaggcacaagaaggataataagaagcactgtggaactacgatgacatgaccaattaacatttcgacaaggtacttccaattttcaatttagaattcaagattatgaaatatccattttgaaagcacatgactgatgatggctatcgaagccccttctacttgatattactacagcaccacagtcgatgcaaccttgtactctgacatagaaacaatcttattttcttcaaccaatccaatgcccatgactttagtactacatgatgtattattcattcactctgagagtatcaaatgtggccagcacactgatccacttgaaaataggctaacatggcagagaatcaagtcaatgaagaacccacaattttaagcagagaaacagtactctatcaaatattcaaatatactccaaagagcctaaatcgacgcacaaaaactagagcattatgtgaatgattccacacatagctgattcctgttacatggagaaccttattaagctcctagcacagcacaacacctgaaggcctcaaaattgggattgcaactttgataccaacacaggtaacacaccagaaaatcccaaatctgggcacatccagcctcctaaatttcctcctccacacgcacacgtgcacacacacaagaaaaaataagagcaaatttggaagcatactttctagggttttctgcccgagccaaatcgagtactctaattcgaccatcctatacgctcatatcccaagaacccccacgcggagttgagagaaacctaagcacaagatctgcaccctggaaatctaatcacaaaccaaagggggaaaaaaccacctgcacggcagtcgccccgcatcagcccggacagaaccacgcgtggcccgggcaccaggatcatggactccgccgcctcctgcggcgaaggggccggcggtgcgggcgcgggcgccgactccgcctcatcgtcgtcggcggccgccttctcccagcccgtggtccacgagaagtccatgggggtgggctcccccgggcaccgctcctcctcgccttccatcggatccgcgagttgctgctgctgctgcttcggctgcggcggcggcggcgagcgagcgagctaggctagggtggcgatttggttgggggagagatggatggaaatggggatcgatttggtgtgcttcttcttcttgttgcctctttgtgccccgcggtccgaattcgaactgcggatagcaacggcgaccgttgtgtgcttttgtttgtgtgtgggcatcctaccgttgcatacggtgcgctgcgcgggccggcctacccgcacatatgaggcccaattaatctgcttttcaccggatgtaataagtctattttgtgctcctcgttttcttgctcgtgattgaatcgtttccctcacaaccgcaataccaggtataacatcttcattttcgaaaactggtgtaaatcgcctcctttgatgatttgagaagtggttttttttctgatgtagcaagttgactacacttgactcgtttagatgtgaggagaaagatgagatgaggtgaaggtcactaacatgtgggtcccacccaacttgtcacgtcaacataaaccatttcctaatccattgaaggaggtgatttatgccggtttatgaagatggaggagggtgttataccgcgtttggttgaggaagatgaatcagtcaggagcaaggcatgacggactcgaatagacttatacctcgccatattggatggcccaagaggccaagattgcccacggggctcatctttttggcccaacaaaatgtgcacatttgctcatctctccttaataaggccacgttcttcggcttggtttggaagaaaatttttcataattaaatattaacaaatataaacttgaaaaagggttaagttgctttttaaaacaacttatatataaatttttttttgcaaaaaacatcatttaacaatttaaaaaaacgtgctaacaggaccttagtagctgcatgtctttttctacttgtaacatacaaattgatgaataaccactctacctaaaattccaaaaggtacatttttaaataaaattttctatatacgtttttttattaaaaactattttaaatatatttttcttaattaattcatttgtaccaaaggttgtgggtcttatatatagacaaggccaggatgtaaaatattttcattatttaaaaaaacaatttttattattcaatgattcattcagctatttaatcatttatttacatacgtagacatggatttctgcacacgacgcacgaacggaaccacacctctgttgccatgttgattgctcacggctattgcagtgtgtgttctcacgctgcctacttttatattggcagatgagtttagagtttactccagactttagagtgatgctgtacagccagtactttatgcagaatccaatcatcagagaatggaccaaatttgatcagaggcagctatccttcgaaagcataaagggaaggctagctacaaatcacacttgtcatttgccaagttggtagctgtcacatacttataatgtaggagtacgtactcctaggcctaggtaagtgatcgatgccggcagatggagtgaatgtgattttttttttctctgaaagaataattagggattcttttgaaacgtagcattgaaaaaacgaagaaataaaacatacgagatatcaattaaaatgcaagtgcaaattacagaattgcataacgcacgaaaaaaatatacaggagcaatagtttgagtagaccgcagaaaaaatacaagaatcacttgaaagagatagactcaatggatttttcccaagagtttggaactttgactaacttccttcaaaatatgcattattccatgaatttttggaggaaatgataggatttactcctttgttttaaattccttcctagatttttttgctataggattagaattcaccaaaattcctatgattttcatacaaatcaaaagaggtccttaatctgcaaaccattatactaccttttatgtgaaaattatctacctttctgtgaacaattccaatgatttttggattgtgtgcctcaccacataggagtagaaagtagctgacgatgacatcatgttatctatcaggaaatgcaagttccgtaaagaaagctaagcacatcgtttttgttttgttctcgtatgtggaggtgacctcttctctccttcgacgtaattaccattgtctatgcgagtgacgaacaattactttgtaatgtcctagataagtagagtcactgtcatggcgcatgcagttgcagtgtagattgccattgacgccgtataaaaatacaatcaaccacgcttccatcactcgtggcatcgactcatcagcccccagaatcaaacccagtaaaaaaaaactggattaagctcgatggattagatgattaacatggccatcagtaaaaaagttaaaaaaaataaagatgaacacgaccgataggataggcattaggcagaatgtatccatctatccatcgtccactcgtgacaatgacagcccaaactaaaaaaaggcacaaaactgaagaagaagaagaagaagaagaagaagaggaggaggaggaggagatcagagacatgaggcatcatcttttcgcttatgtttatacttattagcaaaatttgaattttttaactttaagtttgaagttaattttaaattttttttcatcataatttattttttgggttttgcttttagaacgttaaacatgtatataaaagtttttttttcagcaaatacgccgtcgatgggctgcagagttgcaaaaaaggactagacacggaagcacacagaaaaatacactgcaaacttgagaggaggctgaaatcgagatgcagacaagcacagcattgggatctgaatttctgaacttctgacgagagcacacgagccgtcaattgacacgcaacttgtcgacaaaaaaaaatactcctcctccctccactgatgcaatacgtacgtgcaccaccaacccaccaatgcgtttgcaacggagaggaaaagaaagctagtagaactagtagaatgattggaatatactcctacctgagctgagctgagctgaatggcctattgggttccatgttactgccatgtttaattaagatttaagagtagagaaatggagagagatcagggaactgaatcctgattgaatgaataagtacaaaagttagctgcatcatgcatgcaatggcaaatgcaatgctggtgctaaacaaccacctagctacagatgctgccagattatagctaaacaaccacctagccccatgtcaagatcatagcttgtttagtggcaatgaaccaagttttatcatagagtatgaacacactatgttagtatatttatgacgtaacgactttacactaaactagtagagaatatacggcgcattttattttattttattttatcggtattgttcgtgcggttgctcttgatcccaatcattcggttgtcgataaagaattcggagatgtttgatctctaattcccagagaccaatcaaattgaatgaactaatgaattcaattcaggtgttgagacattcataaatgaaatgacaaagtttttttttttagtcacaccggaaaactgatgatgagaaatggctaatcaagatatgatgatggcgatgggatgctttggattcttcagaggtcgaggaatccggtctgccggagcacggcgttgcggacgcggcggaggtcgcgccccttgagcgtcctcccggcgccctccagcaccgacgacgaccgcgcgtgccgccgcgccgccaccacgtgcggcggcaccatctcgtcgtcctcgttgtcgtcggactcctcgccgccgacgacgttgttggcggcggcgcccttgcccggccacatcgggaccctcaccggtgccgaccgcctcggtgccgcggcgcctccacccggcgccgccgcggccctcacgggcacggccactccatcctgacgcccgtcgtcgctgccgccgccgcgccccccgttggcgagcagcgacgacagcccgaagctctgcggcaccgtgtgggcgcggcggggcgcgcgcggtgggccctccgggtgtggcggcgccgggcagcagtaaccgtcgtccccgacaccgccggccggccacaccacgtcgctctcgtcgagctcgaacggcggcgccgcgccgtcgggccccgactccggctgcttcaggaggccaagaaaccggagcgagcccgcgcccggcgaccgcggcatcgccatcgccccccacggagcagccacggatcaatcctttggctctgatctccccttcgccgtcgacggctgcggcggcggcggcgaccagcgattgcaacgaggtgtttgtgttggtttcggatgccgcgaggtgcgcgttatatacaggggagagaggaaggggaggaggagggggcgatgatgagtcactggaggtggggcccacactgtgggggaatctccagatagatgcagtgggattcctgtgtggttttggaatgctacagcaaacacaagaactgatccttcccgtggttaattcgggggcgctttgcgctttgctttactgtactattcctagttcatacgccctccgtttcattaaaaaaatactctaattctagacaatataatacaatgaatctagacaacacaatctaacgcaatgaatctggacaatctatctaattttgttgtagattatgtcaaatccaattgtagattgtttttattttttaaaacgaagagagttgggagtagtgtgacgagctagctgtttcccatgacgaaatggcgtaaaatgctttataggataggtgttcgtttgcggattgatgtatctgattccgcatcaccgtgatcccgtgatactattcttttcaatcaggatcactcataatggttactaagtactacctttgcgagtttggatctgttttaaggcatttgttggggagtgtcttataaagcgaaaatagttttagaacaaaacttgtttgtccagttttattatactaaaatgtgccacatccactcattatctcttgtattatgggacagagagagtatataacaagtaaagatgaagaattaaggagtctatctagaccatccaattaccaaccaatgtctaggattcattgaaccttccctgctagcctcatcaagaaccaaactcgatcagctgcgagctgttagtatatatgaacaattgagaggacctgcgagactgtgaggtcgccgtcgatggcggtcactgggagtgactcaggtggtgctctaagagattgtcatttaattgatctcttttggatgatttagatgggtctactgttaaaattgttgagctatagcgactacaccatttattgtatcgtcctctctacatttttctctagtaacgaagatatttactagccagtggaagtttcagtgtgaatagctaggcgaattgtttaaaatgaaatccacatgatgtttactttaagactgtgattaatgctcaaagagccaacgtacagtgaagtatactgttttactgagaaaaaaaaatattgggtgcaacgtactagcagtagcttgacgatgatggatgcatggtgacaccggccgggtcaattcagaggttttcttgcctgcggttaagacgagagtaattgggggagtagaagacaagatgtggtggctaacaagtaaccaggggctactgtttcagttcgatggtgatagtggcctatatggaacgttccaaaccatctttcgaccgtgcagtgtacctggcatatatgtttattctttgtaatcaagagatagtcatatagcgcgtatcttgtacaattgcgagccggaaattaattacttatttggtcgaagagataaatacgagcttacgaggtgacactcaaacgtactacaccttttatgcgtggttgatgtgcagcacacgagaaaactgcgttctcgtggtgaattagacgcggaaagctagctagggcagttaattggttgtatacaccatccgtttcaaaaaaaaattaatataatactctctccgtgataaaatataaaatatagtactccctccgtttctaaatatttggtaacgttgactttttaagtacatgtttaaccgtttgtcttattcaaaaatttttgtgaaatatgtaaaactatatgtatacatatatatttaacaataaatcaaatgataggaaaagaattaataattacttaattttttttaataagagaaatgatcaaacatattttaaaaaaattaacggcgttaaatatttagaaacggagggagtaagagattttagggaaatgtaacttatcatagtctatccagattcatatatcatatccatctaaaatcccttatattaaacatgacacgttctaatcgtggttattatgctaaatattgctttatgttacccgcgcgtgtgtgcgcgaggcgtgaatgaatgattggtggcgcgcgggtggtggccggcgccgatcattgggcgctgggcgacacgtacgacagattgatgattttacaacgtgaccccggccgcctgcctgcgggatgtgcggcccacccccgcacgtacgtacggttaatttgcgcgatcgagcggcgggggcacacacgaccagacacgcacgccgtgtgctcggcgatcccaagcgcgcaccgatcgatccgcgcacgtcgcgcggccgcggagattcactgtgccgatcgatccaccgcgggtggcggggtccggggccatggccagcgcctcacacgaacccagcacagtaccaatccttgcatgattgcgcgtgcatgaacgccacagttgtaacagatgaaaggacagcagatgagagaaccttttttttcctgggaactaatacattcgttccaaaatatagcaacgtataatataataagactcatcataatattatgatattacgaatctagatatatatccatctatcgattctagaactataaatttaaatataagacatgtttctatgagtaaattgttacattttgagaggggagttagcatacggtcctcgctcactctcctctccgccgtgtttgtagcagtagcactacactgcggccactccgtgcaaagcttgtccgacgtgaaaagatgggagaaactaccctacaaaggctgacgcgagagggcctttcgggcggcagctagcattgccggttttgtgcacgcacggccacggtcatacacattgctgccaacctggatggattttctctcactgtgcacagcacagcaaacaccacactggctctcagtctcagcagccttgtagtactactgtcacagatctcacaagcacagcttctttgtcgttgtcgaccagaagcatccacacgaagaaattttcaaattagtagtaactgagccatgtccggcggcattttacgttatagtaagacctagtattactaccggtgataggactaattaaagattgttcttagattaccctgagaatgagagaggcttggagatggaacctgcctagccaatggcccatgctagtgctacctacaccaagtcaccaacaaagatggaagagatccgtgactagaaacgaccccacgttaacctacgcatcactgtgccatcccctgaatcgggaaagatgcactgcactgccactaactacggcaccactatacgcgagtcatcagcgagtgagagtgacagtgtactactggtagggcagggacctcctccaattaggcgactaatagaaacaaaagtgctaatgctactactagtacgagttttgttgtgtgatgagtagtactgatgtggccaacacgtcggtcccgcctccccctgcactgcatgggaacatatactatcgtgtggtgtggtgtggctggagatggaggtgtcgcgtcatgtcagcttcgccttcacacacgcgccgcaagacgccagtcgggcgcgttgcatcacttgtcatcgccggctcacaggctttcctgcctggatgcagctttggctcggctgtgtatgcaaaggcgattttacatcgatcgatcttcacgggaaaagccatgttagtagcagtacagtacgtcacggcgtcagatgcatcaccgggggattgagatcttgagatcgatgtaaaactgcccagttgcggaggtcagatatcaggaatgaaactactcctattttgattcggcggctatctggaaaaaacatactccaacatcgcaggtgtcgttaggaaccattattcagcaccagtcctccgaaacgatgtaaataatgagtttatggaagaagggacaactgttttacttgggcttacgacctcgatgcccgcatggttcactcgataaacttgagatacagtgcaaggaattcaatcatttgaactagatgacaatcgatactcatctcatctagtataatgtagtcgtacttcaatgacattgacatgttttacacatacaaagatacaaaaaatgtgtcggacgtagcctatgattggtactttggtagggacctacagatcaacttgtactctacagatgcgagataaggaagaaaacactcggagcaatcaagctgattaaaagaatatgggtggttaaaatggacatatctgttgctcgacgcactcgtacatacaacaatagatcaaccagtaatgatacctgccaatacatcactttttcctcgtgcaaatatggtgtacactaagcgtatagcatctaaccaaccatcaagagactcccaggtatcagcaacctgaaaaacgagttaaaaatcacaggctgagaattgaggtgataatgacagagggagggcctagggaggagcaacaagaataaacagtgccctgaaatgtcaagaaggcggtacagtacatgtaaacttaactcctgaacaacaagcatcaaatgagtatgtacttaccaagaacaaaggcccgtgaattgtttctatacaaaggccagcaccaggtggcagtgttagatcggagcatgcagacactgaaacgatatcttcaacagctactttaatatattttttgcttctccccatatgtccaaggggtttgctagaagggctttcagaggcatcgacctaacatttgcaacaaaaataatgagactcaaatcctggtgaaatgcacatgggtagaaacatctccggctaaaagaaaccgtctgaaaactccaggtactctagaagtatgctcatgttaaagtagaagaacttacctgctggagtccctcatggtttaagacaaattctgacctttcccaatgtttatgtggtgcaatggtgttgtctgctggaggagcagttagatacccagcttttagatatggtaaaggtagctgcaaagcatagcataacaataagtatgccaaccacagaataatttaagacatgcagattacctggtgtatgaataattgaatagttgctgaaaattcaaaacgagataaaataaaaatgataaaaaaccaagctagtgataaaactaggacatatatacatatcacttaaacactgaggacacacaagttcacaatctttaccctaattttctcgatcatattaattgttccggtgcatttcaatatacgattttgtttccttgtgaatcatcatttgtactcaataaaaaaaccaattacatttaaaaaacgaagtccaatacaggagatgaattgcttaaagacaaacttcaaacaaagaaatactgaaagcatagagcatgctaacataccattgatcgaaccagacgtagagcactgcgataaacctgcattatccacaacaacatttcagtacatctacataacgcctaaagattcatgaaatgtcctatggaatttcaagcttataaccacatcatgatgcgaggcataaaatgctaactctgccaaaatagtcagttcactcatccaagtaacatggaaatgctactataagataatatcaaaacccacaaactgctgaaagctagcagaatatacatacaggaaagagaaaaatattgctgaattaacaaacgtttctacaatactgaatcgtatttgttgaattaaaatatcacttcagtgacttcagttaagcaggaagaatacaatgactgactgactatgaaactcttcttgctttgttttcacatctctaccttccagggcatcccaataaggaaatttaaaggcagagtagtcaaagagaggaaaaacacatactgaataatttggcttcaatgcatgagcagctgcgacataaatggcggactgactgtacaagtcatttggagagacatctggacctgcagacctcattgtatcctctgctaacccatactgtgacatcaaatatatgaaagttggtgaattgttgttagcaaaaaatgcagtcagctagcatgtacgaatattgacaaagtgctgtaaaaaaacataccaggacagttccaagattgtaaatagcccgg

SEQ ID NO: 42837 - DNA, 993 bp, Oryza sativa
  unsure (1)..(993): unsure at all n locations
tgtttatctcgggctggaacaattgcgctcagctcctacattataagataataatattgacaatgaatgaaaatcagtgtgattacgaagatatgttaagtcagacataagtaacaaagtcacaaagtcgtgtacctgtagtcccaaaccccagttgttgagggcctgcagtagaatagtgacaaatgaaatcaatcaaaatgatgattgatgaaaaataaaaggcaagcacacaagataatgggatttggatgcaaaggtctaacaaacgttcaattgagtattagttatattgcccattaaatcagccaattgagaccatcctaacctgggggctgttccaatttaactggactgccttgtcataattcattatagcctgtagaagaaatagacagaaacgatcaattagtaagacatgatctccaacaagttgaaaacaatataataaaagtattatccataaaattcaagtaaataacttcaaggcattttttccaaagtaaatgtaagtcaggctaaccaaattataataaatccttactctcaataaaatatactatctaaccaaaaggaacaatgatagaaaaagaaatcagatattatgtttggttcagtgctgctagagtgctaagaattgcacgcccactatttaccgtggacagtattactagtttacatgtcaatgacagcaaaagaagacaaccattttacaaaccgtacttgaaccaaaacacttcaacaaatgcaggcatattcctatttcatcagctcacatttgggtttgcaattcaaattgttcaattttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42838 - DNA, 848 bp, Oryza sativa
ggactaacacatgccggccagctagagtgggccctcatttgttacaagagtgggccttcatttgttacactctagatctgtcccagattatatatgactctgctgggacctgcgtaagtttatcgattaagacagtgcgctctggggcacaatgcacatgtgatcagaggtgatattttttttgattcacggtatcatgcaatttctgatttttattcaacgcaagttgatatgaatagggaggacacgagctatagtacaagtatacaaacagtactaaagaacaatggaaaaaaaaccaatccaagcttgagagtaaacaaacacgcaatcatatccgacattaataatgtatatccgacattaataatgcgcggcattccacactagctagattaatcaaattaagaacaatcatgtatcgatgaactcagaggctatctggtcgatgtcacgctcggcgtaccactacggactaacacatgtcggctagctagtcgtgcccggctatctgtcttgctcgccgccggcgccggcgagcatcccatggtgcaccctgtcgatgaacttggaggccctccgatcgatgtcacgctcagcgtaccattaccgcccgtagtagttgttgtcgtcgtagtgcgccggcgagcatccttcggtgtacctgttgatgaactcggaggccttccggtcgatgtcacgctcggcgtaccactacggactaacacatgccggccagctagagtgggccctcatttgttacaagagtgggccttcatttgttacactctagatctgtcccagattatatatgactctgctgggacctgcgtaagtttatcgattaa

SEQ ID NO: 42839 - DNA, 29416 bp, Oryza sativa
  unsure (1)..(29416): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccattttgctgctgttctgccaaggcttatgcttaattatatttacctgtatgaatcgttgtcaaaccttatgctggttaacatcgaaggagcacaagggagcaattacagaaccaagttggacaacatcggtgtcaaaattgcaggatcctaaatggaatttcccttttcacgtactggactaatttaaattttttgaagaaaaacattaatccgtttgaatttgtttctcatatataaattccagtatgaccacatcttgtcgacggcaagcactcttacatcgaaacaaatgaatcattcaaacaaccaacaaaaaaaaattacagatcgaacagttccaatccgactcgcacaacaatcgcattcgaatcatcatcgattcaaggtgagaaggccagatcagatcgccgggcgaaggcgccaccaacttctacgcggtgggcttgtagagcttctcgaccatcttcctgaactcgtcctggttaggccagagggcggcggcctgggtgttgaggggggagtcgttgttgggctcgccgaggaggctctggatggagaggaggatggtgcggacgtcgtaggcggaggaccacttgtcctggaggatgtcgaggcagatgttgccgtgggcgtccacgtttgggtggaagcagggggtttcgaacctcaccttgggcggcttgtacgggtactcgccggggaaggcgagagaggcggtaggaggtgccctcgtacgccgtcgcggcggacccggcgatggtgcccacccagctgaagatgttgtccccctccgggaacgcggacacgcccgggtcgccgcccatatcagcgccatcagctccgactgcagccgccgcaccaccgactgcccctccgcccccgccccccgcgcctgctgcttcccggacgcggcgccgtccccgccgccgtggacgcggcggtggcgggaggaggcacgttgccgctgccgtgcgcgccggtgttgttctcgcccctcgccatcctcctccctccttgcctggatcgagagaattcgagatcggtggaggcgcttcgagaagagagagagagagagagagggaggaggaggaggaggcggcgcggtggggagtatataagggattggtttagtgaccgttgctgcagggttgcgtggatggggcagctttccggcgcggcgcggcggcggccccccaacggctagtttccggagaagcggggcgcgttcacacttgggggtggggaggcggaggtgtggggcccacgtgacaggttgcgtacggtgggccgcggcggggggcggcctggtccgcgcattggcccgctcgccagtgagtccgtgataggctgatgggttgatgaaattcatgcggattttacgctctatgtcatttttggtctaaaattattttaaaaattatgaaattcgatattattaggattaattttaggggtttctttattgttttcattgttagagcatcaccttacatagtctcaaaatagatcctaaacccaaaattgagggtttttcttttaaagaaaagatcaaatcgaatagtcgacctggttagatgtccaatgtttggaattcccaactttggttttttttttccgttctccacatatagatttgatagacctccagatactctacctatctttctctattttttatttttttagcgaaacacaatacaaatgaacttgtgtttcgctaaaaaaaataaaaaaaatacaaaaagataggtagagtatagatagatactaccagggtttccaaactgtttttttgggtggttaccgccaccctacggtttggcggttgccgcgagatataccatagttttaaaaactgaaaagataaccgtacacgataacagtggtaaccatacggttaccgcatgtttttttaaaccatgaatactgttgaatggttatcctacttctataaatttcacacaatcgctagaatacgaggtaacagttctataacaaaacttagggttcatctattataaaagaattaaagtcttacatattttttcaacatcaattttttttaccttcgagcaaatttatccatatcagattatttgtgaacgaaagaaaataacatgtagaagaccctattcgaacgaacctgatgaagaagaatattacttcctccttttcacaatgtaagtcattctagcattttccatattcatatctagattcattaacatcgatatgaatgtgagaaatgctagaatggtttacattgtgaaacagagggagtaagtaagaacacgtacacaagaaagtcattatcatatgcttatttgagttttaatctttacaaatttgatgaaaggaagatttatttgatattttaaagtaactttcatttagaaattttttatacaaaacatattagcagtttgaaaaataacaacagagggcgaaagaaatttgaaatcctgaacgactcctactcggctactccgacctcgcggaagtcggtttgacgccaccgtttctactcacccaagccgccaccgcacttcgcacccgaagaagaacaaaccgcctccaaaaatctagggtttccacccgcgcgcgacgcgattcaggtgggcgccgctccctctcccgctcgatccctcctattcctcttcctcctcctcctcccgcgcgcacgattgcacgaatcgctcacgatttccgatccgttcggccgcgtccttgcaggtgtagcagcagcggcagagggtgatggcggcggcggcgccggcggacgcgaaggcggaggcggccaagatggacctcctcgaggacgacgacgagttcgaggagtttgagatcgaccaaggtatgcgcggcccgcggctccctcctatgacctatccctcccccaacctatcgtcgagtcgaatcgccgtggtactgtttgcgttctctagggtgggggaagcgacgccgattcgccgcaggttgcgttcgtggccgagaccttcggtttgggcgagttggtttggttggtcaggagaccgtgcggcctgctatctcgtgcgatctggtggattctattactttttttggggaaaatctgtgctcttttagtttcgcataatgcaatgtatgttctaagttggtttgcttttggtattgttgttttccttatcgagttaattcatgctcgcttgcttgcgacaattgtgacctgtgccttgtgtgctttcgtatctgtaccggtttcttcctctcactggcatatagtgtaaagattcacatattagaatgtagaaatttagaatgataaacccctaagatttttaagtgtaggggcatatgaccgaaaatgtttccattggtgctgcctgttgaggtgaatcataacaattgtgagcagttgatgaaattttgtgttcttttgcaagtccattgaacaataatttgtagtttagtttttagaccaaaattttgtctttaaaccttttcatgataggcatcccaatttatttttgtaattatcctagtccatacctgctcccttcctcctctaggaacacatgatatcttctctctctcttcgaggcaactagtccatgaattgtgatggaggccattacattaccaaggttggttccagtcctgttgccacctgcaaatgggggtggcagtgttggagccagctattgcacccctaccactaccagtacgcttgggcactagcctgcaaagaagctgttctgaaagcacgctctatgttgtcctagcctcttagggtctatagtgatttaacggatagaagattttatcgctttttgtccatggtttatcgagtagagaaaaggagatatgtactcaacatatgaatgagataaggacttctagcttgtgctactattaatggttttatttttaagcgaaatggaaatgtacagactaccttccccttactgggaactgctcttcttgttaccttattatcatggcttttcttccattaaaacccttcttgtgatttgtgcttatgggcctgtttagatccatttggaatggcaaatggcaaaagatttggcatggagttggtgtttagatgcatcctagagttttgccattttagcactagagagagagagcgtggtcccggagcacttcttggcaaaatttgctaccttgggctagcaaatgacaaatgccaaattgccaacttttgctactagtgtttggatccaaaatggcaaaactaaacaggccctatgtatgatttagtggctaccaaacaacgtagaggtttccacttcttttgtcatttatgtgttggattttttatgcacattgtactatatgtggtgtgttttcttctatttaaaatgagcagataacctaatattttgtgacatcacggggttatatgatttggcacaaacttattgtttggtgcttcttccatgtattgagctataacatctcatattgggcaactgtctgtatggttcacagggaaaaaaaaacttctatagttttaggatgtttctattggcttcctctctatatggtggtaatagctactttcttgaagttgagtttagcattttgatttattctttacagtgccttatggtcagcaagttgtgcttcacactttgatttttggcatgcggctgtcacttctgtgttgcaatctgtttcccccattttgtacattcttctgcaagcaatatgcgatcctagggtgaagttgtggatctggtgctacaatgttattatgtaaggcttgcacttacccattcttcctgctttcttatattttgtagaatgggatgacaaggaggatggtgatgaggccatccagcaatgggaggatgattgggatgatgacgacgtcaatgacgacttctcgcttcagctgaggaaggagctggaggaatgcaacacccagaagatctgaactacttttttttcccagttatgtttagctgtagcacctatgctgggtcaggcacttttgtaccctttgtgccccattgctttctcaacctgcaatgttcctactatactcctacttgtgtgctgaaacctgcgatcaaatttaatttgtgaaagggttaaaaccaagttggtggaaaaaatatggttctctattgttggtaacttcgagttcgaaaatcggggctaataagcgttgtccctgttggtcaaatccaggtcgtctgatgcaagatgggattttttttttttggcctgttgtgttgagactgtttgagtcgagaagatgtttcttggtgcaacagttattaccggcaactctaagagctcgtctacctggcatatgtttggttttggtttagggatgaagagctcgtttacctggcatatgttttggttttggtttagggatgaagagctcgtttacctggcatatgtttggtttagggatgaagttatattttttgggatgatcccatatagatgtttgctgctggcatatgtttggttttggtttagggatgaagagcacgtttacctggcatatgtttggtttagggatgaagttatattttttgggatgatcccatataggtatttgctgggcgatgtctaagggggtatttgtccacattcgctgatgtctaagggggtatttgtccacattcgctgcaaaattgagtgggcccttatttgttacaagagtgggccttcaaaattgagtgggccctcatttgttacaagagtgggccttcatttgttacactctagatctgtaccagattatatatgaccctgctgggacctgcgtaagtttatcgattaagacagtgcgctctggggcacaatgcacatgtgatcagaggtgatattttttttgattcacggtatcatgcaatttctgatttttattccacgcaagttgatatgaatagggaggacacgagctatactacaagtatacaaacagtactaaagaacaatggaaaaaaaaaccaatccaagcttgagagtaaacaaacacgcaatcatatccgacattaataatgtatatccgacattaataatgcgcggcattccacactagctagattaatcaaattaagaacaatcatgtatcgatgaactcagaggctatctggtcgatgtcacgctcggcgtaccactacggactaacacatgtcggctagctagtcgtgcccggctatctgtcttgctcgccgccggcgccggcgagcatcccatggtgcaccctgtcgatgaacttggaggccctccgatcgatgtcacgctcagcgtaccattaccgcccgtagtagttgttgtcgtcgtagtgcgccggcgagcatccttcggtgtacctgttgatgaactcgaaggcctttcggtcgatgtcacgctcggcgtaccactacggactaacacatgccggccagctagccgcggccggctatccgtcttgctcaccgccggtgtcggcgagcatcccgcggtgcaccctgtcgatgaactcagaggccctccggttgatgtcacgctcggcgtaccactaccgtccgtagtagttgtcgtcatcgtagtcgctcggccgcactttcgtcgtcgtcctcccccgttcctgctgctggtggccgtagtacctctgctgctccctctccgccaccgccgccagctagccgtggccggctatccgtcttgctcaccgctggcgtcggtgagcatcccgcggtgcaccctgtcgatgaactcggaggcccggtcgatgtcacgcttggcgtaccactacagccccgtagtagttggcgtcatcgtagtcgcttgaccgtaccttcgtcgtcgttctccctcttcctgctgctggtggtcgtagtacttcctgttgttggtggccgtagtacctctactgctacctctccgctgtcgttgcttctgaacaaaggtattttgaaagcaaacactgacttctctctccccatcacaggcacaactagctcacaaacaagatttgtttggttggttgtgaggggacatggcctatagcctagccaaccacatgcacgcgcgggcatttgtccacattcgttgccattgctcttaaacccaaaggtctttggaagcaaacaccgaacttccctctcccccatcacctctgctgctccctcttcgccgccgccgcctcatccttccttacaccattgctgctaccgttgctcttgaaccaaaggtttttggaagcaaacaccgacttccctctccccatcacaggtatagctagctcaatcttgatcagaaaccagatttgtttggttggttgcgaggcgacacagcgaggccatacgtatttatagcctagctgaccacacgcacgcacgggcatttgtccacattcgctgccattgctcttgaacccaaagtaagcaaacaccgacttccctctctattataggcacattccataagcacattcgctgccgttgctcttgaacccaaaggaagcactccatcataggcacattccataagcacattcgctgccgttgctcttttaacccaaaggaagcaaaactgacttccctctccctatcacaggcgctcatcacaggcacattcgctgccattgctcttaaacccaaaggaagcaaatgctgactttcctctccccatcataggcctcttaaacccaaaggaagcaaaactgatttccctctccctatcacaggcgctcatcacaggcacattcgactcttgaacccaaaggaagcaaacactaacttccctctccccatcgcagacacagttgtttggtgggttgcgaggactcaatcttggttgcgagggaactcaatctttgatgtttggttggttgcgagggaacatggtgagcatcacagacacagttagctcaatcttgataaaaaacaagatttgtttggttggttgcgagggaacacggtgaggccatggcgtatttatagcctagctgaccacatgcacgcgcgggcatttgtccacattcgctgcaaaattaaatagggcccaggcccctactggtgatctctataatcactactacccttttacgaactagagcgtagtgattcgtataatcactactatgcgaagaagtgccaaaaacatcccttcaaaaaaaaaaagaaaaaaaaagacacattcgctgcaaagttaagtgggggctaggccccctactggttatctctatatagttttctaaggtgcttgggaggcatggcggccgttaagtgggggcctaggcccccctactggttatgtctagagatttctaaggtgcttgggaggcatgacagccgttgattactttcaatatgacgatagataagagaatctatcgtcaaaaccaacatggaggtatttaaaaatgtgggccaggtattaacttgaacataaaaatgaaaggttagatagtaatttgtagtagtaccacaatcaatggcgcatgctaataataaaaatctatgtttctcctaattgaatctgctccataatctcatcaagcagtagactaagcaatgctgccatcacagccatggtccgcgcaaatcaactgtcgatgctctagtacgtagttacttatagatgacaaagcacgcaggtgaagaaatacgacatgagaaagacgatgcgaggaagctaacctggcaacgtttgatgggcagaagtaacttgctatcacgatggttgatcatgagttataatgttcagtaaagatatcaataaaatttggttgtgcaccggtggctccacgtacctaagccatggttgatcatgagttataacgttcagtaaaaatataaataaaatgatatcaataaaatttggttgtacaccggtggctccacgtacctaagccatgattatggaggagaataatgtggtcctctcagttagtaattcaattttagatgagaatcagttgtggaggagaataatgtggtccgattagatgagaatcagttggggaacctaagccatgattatggaggagaataatgtggtcctctcagttagtaatataattttagatgagaatcagttggggaagaagatattagtttgatgagaatcagttgatattagtttgctaagtgatgagaatcagttgatattagatagtaatttatatatatatatatatatatatatatatatatatatatatatatatatatatatgtcgcagaattcacaaagttagcgacaaccatagttattaggaccgccggtcctaccggaaaaaatcggaaccaggggctcagccggtccggtccagtttaaaggtccgaccggaaaaaaaccggaactaggggctcagccggtctggtccagtttaaagatcggccatgcaatcaacctgggaaaaaccgattgaaccgctagtccggtctagtttaaagatcagccatgcaatcaacccgggaaaaaccgattgaaccgccggtttttagccagaaccggtgaaaaaccgagcagataaaccgctaaagaccggccacacgtgggtgagaaagtgccagtgcaggctgaaaccatgggggagcgtggggggatggaagaaaataggagaaaaatatgggcagaggggttcgaaacctcccctttagactcaagaaaccccaccactgagctatgcatgcttgtgtgattggactatatatctcagtttatttaaaccgtcttgggccggcggttgaaccaatcaaaccgtgaaccgaggtttcgaccggttcgatgtccggtccggtcctaataactacggcgacaactagcgacagatggctatgtaaagattatgtggagagaaaaaaaacagttaggagagaagtttctccagttgataattgataaaaaaatttaacaattactaaactaccatgtaatgttaatttctatctctataaactaccctttaacagatcaatggtggatgtttaatagcaggggaggtacttaggatacctccaagcactgtaaaagctctcatctctataatcactaagagttacgaaaaaaaatccctttcagaaaaagaaaaaaaaaagagaagaagaagagatacgaaaaagaaaataaaaatcttgtgcagttcgagatattagcgtcgtgtcgccgtctcaccgcgcctcgtaactcgccgccgccctcaccgcgcggctgctctccgaccgatccaccggagccatgagctgcgcggcggtctgggtcccttccccctgctcgccctcccccgtgccgccgcggcaccggcgggggcgatggcggcgggggagcgcctcctcctcgtcgtcctccgccttccgggcctgcgcgggcggggacgcgtccggcgaccgcggccgccgagggcggccggcgcggatggtgctgcacgactcgctcgagggggcgggggtgtcgaccgagcacgcgagggcggcgagggaggggttcgcgaagcaggtcgggaggctgacgcggctggacgccgagaccagcatcgccatcagccgcggcgcggacctcgcccgcgccgcgctctgcgtcgccgccgaggacgactcgctcgtctcccactcctccgtgccgctccccgtcgaggccttcgtctcccgcctcgacgacctctccaccggcttcctcgccgacggctacctcccgcccgccggcgcgccgccccaggtcttcctcgaccacctcgaccgctacctctacgtccacaaggtacaaatcatttcgcacaagcacatattcttcttgaggtcttttagtgtgcttgagaggtaccatgggtacctccctttctagtaaatacgcaccgttgattcaatgataatattttgtaaataaaattataaaaacatgggtagtttagtaatagctcttagccataactgccatctacttttcaggcatccgttgctcacctaaattaaattaacctgcatctccggctcatggatgaaattgatcgttaatttgttcccatttcgagtgagcataaggcatgacaaattgatatgagaatattttctttatctgggaacaatactagaatctgatcgtatagattgaagggaaatacacaattattgattaattacttagtttatcattaattatgcatgatcagtgtattaaatacgttgttcttttctttacaataataaaatacgcatcaaccaacttgtgtttcctataaaacaacaatttagtattgtttgactatactagataatcaactggtatttatcgcccgttacacaatctacatgtgttcaccttttttttttttcttgtgaaagttttaagcattcacacgtttaagtgcacttttcccccacaatcaacggacgtgaaattttggaatgtagtggcacaacatagtatagcatactatcaaaagaaaaaaatacatacaccgtgatttgccttctctcagttatctaatttaatttgataagaggcacacaattacctatttaaccttccacctaatctacaaattaagtacctgtcccacttttttgctacctttcctaacgtacctttgtttgtataccgttagattttaattgatcaatggactagataacttccaagcaccggagaatctctcattcttctttcaatcgtttgacttcaggctcactctgttagttcgattccttgatataaaatcctgaagaatttcttgctgtaccctctaatcgtacagtgaattgatgtgctaaatacgttattatgtgactttcgattcaggggtttcggagaaaaaatggatcgtcagatgggcgggcaatatatcttcactcggtaaagccttactgtaccttgtccgtgttgtatgtgtattctcttctgacttacttgtatgtgattcatctaaatttgtgttgatttgtacggtggccaggttctgacgtgccggttgggatcagctctaatgctctcgttgatatactccgagatactgaagatgctacgattgtatggcttactggaattcaatgtggagattttctttccacatgatctcaacagtctgcctaggggttatgacaaacacaaaagcaagttgggcgatgaaccgcatattatgacatcaaagtcacttttggttgaggtgtgtattttttctatcctcagtacccatgttccatttttaactgtaaatatgttttttgtctgctacatgctatttgtatatctggtagcatttaccaccaattaccaattcataggagcacgccagccatagtggcaatctcaacaactttcctacagcagggaattttcatgttgttctagcttgcttcaggggaaccatttcctcaagtacctttaccagcaaaaagattgtttgcatttatgcatcagattactgaacaagacttgaattggattcctgcttgaaaatttccatatgcaatttcctgtcaattatttttgaacgaatttcctactaatttccataagtacagacatgaatttatggtcatttgtttatacatacaagtacaacacttatgaacaggcctaaaaccttttataattgttctttggttgtctgtataagtcctttcagaaataaagaagggagttttgtagtttatagcttttcaggtggttgccataagtacttccatgggtttgtgcatgctttgtacacggtacacttgtcaattacttcttgtcctccgggaatttgtttctccctgccatgcttgagaccttacagttcagtgtacaccttcttggtcatcaagtagtcctaagtaccggagcataacgattttggaagtgccacctgatccaagcataattcaacatctctgcaagtcaacttgtaattttatctggaactaaaccaaaatatcttggatttggagttgtataggtagatatatactgttgaaggtttcatctgcactttagaatgtagcattaatagtttccttctttttgtcagacatgtcgctcctgctctttatattagttaatgtttttggtctgtgttctgttgaaggtggtgctatgagacttcgaccgttaattttttctgatgagaaaacatttttcgcttactttgacttatccttttcagattttgaaaactctgaagaatacattttggcctttccagtccaaccagtctggtagcttatttttaaatgctgtttctgcaaaccaacatggccctggtaatgtaggtgataatcaaacaacgccacatggcaatataaggtttgttctaaacatgacttgcatagcaaagtattttttgttgttgtcatatattatctggagtgcatgataacagtgacatgcaaccattgacagtaccatagagatggctgctgcaaaagctgctcaacataggttgatgcgtggagtatggactaatgtccggtttggtgatatgcggcgtgctttagcaggtagaacaccttttttctgttttaatagtgaacagttggttattttacatatgatgcactaccatagcatctcctaaatgagaagtttaatgtttcaaccataatctgggagttgtatataacacactgcaagtcattcgcgattttggttacaagtcacctatctattttttggcacctcatccacttcctaaatgtgtgatccttctcctttaaggccgtaataatttgggtaccatataattggtcattgttttgcctaacgttgttttgcactaactctgtgttcctgcaattcctgcaaaatacttgcttggcatttcagcagttcctaaccagagattcgtacctttcatcttcatggcagcatgtgaacgacttatcctactgaaccacgatccccgtgaactgagggattatgccgcccttctctaccactgtgggtactatgaagactgcctgcaatacttggcatcataccaaaccgcagtggtataatacatcttcaaatgcggtacgttcgatcgatcattgttgaaatcacagcacctctaaatgtcgctctatttgtttcactccaaggctgggcagcattggaacaatccgctggagatcatggaggacgaagcggtgaacaccctgagagcgcgggtaagcttgattttagcagaggatggctggagcagccgcagatcacctgccacgagttactggacgaagaactccgagccgtggtagaattagataggacgatgcgttacatgtgtatacggttttactgaaacaacacgagcttgtacatataatttcgatggcattttcgcaatcatttgtactggatgaagtgagctcatgaatcatgatgatgctaccatctcttccctctaatggttataatgctttctaaattcgctccgcaattgtaaatgaattacagaaggtggtaataatcaaactggagtaccaactatgatcaacagatgcaaactggctgccgcatttcgtgcaccaggcccaccgacgtgtttccacgagcccgtacctggttgcaatccatgaaaatttatgcaaacaggaggatttaggttgaatcacacgaatggaaaaacatggacgaaaaaaatagagaaatagaaaaaagatatgattctaatagaaatgtaaatgtaaaatagatgattgcaaaatacaaatgttattttatagaaataaccgtttaattgaataacaggaaaaacacagaaatcgaataaaagagatggactcaaaagaaatttttcaagagattgaagctctagctaagtttcctctaaaatatacagataacgagccattcgatatgaatttatatgatttgaaaaacttcaatctttatatcaaatgaccaaaaaagaaaatttcttataggatttaaatcctacgaaactcagggccctagcatggattgcagcattcagattttgcctgaaaactgtaaaagttcctgagtactttttttttacgcgtgtccgcgtgtgtgcctggagatgaaccgctcctagtattacgggcttgcatttcatgggccatccaacgtaacggcagtcaaagtgtcaaaaccacgtcgtcaccccacttcctccaatcaaactccgccacgtggccacgtctccccgactttccccaccctcccccaacccccgaagcgcgcccccgcggtcaaacaaatttaattaaccgcggcaaacaaattattactactactaattaccccacgacccgcatcttatatatataaaccccaccccctcacccgcacacacacacacacatcgctctgcagtttcaacctcacctcaccacccaagcgtcgctcgatcgatcgtgccatccatggcgccgccgatgatggcgacggcagcaaggcctcgcgacgaccagccgcggcggcggcaggctctgctcctcgccgcctccgccctcctcttcctcctctgcggcggcggcgctcctggcgctggcggcgtcgtcgtggcggtcgcggcgacggcgtcggcgacggcgacgccggggctggtgttccacgtcggcgggccgcgcgggtggcgcgtcccggacgccaacaccagctacacgtggtgggcgatgaacaaccgcttccacgtcggcgactcgctctgtgagtagctttgcttccactcgtctcgccattgccgccgcctgcggacctcgccgctgtctgttgcaggatgtggatgatggattcacggcgagttcttggatccgtgtgcttgcagacttcaggtacggcggcggcgactcggtgctcgtcgtcgaccgggaggcgttcgacggctgcaacgcgacggagccggtggccaggttcgccggcggcgccaccaccgtgccgctcggccgcccgggcttcttctgcttcatcagcggcgcgccggggcactgcgacggcggccagaggctcatcgtgcgcgtcatggtgcacccggcgcctggagccccggcccccgcgccgtcggccgcggcggcggcgacctcgcatcctggcgcctctgcctccggccccggcgcgtcgtccggagccgccgcggttgccgccggcggcgccggcgccgccgtcgccgcggcggcgatgggtgttctcgccggcctcgtcctgctgcttcagtgatcagttcgcttgcaagtagttcattggctaatcttcatttaggctgcttggtttgatgtttatctgtcgttagtaacaacttgattaattagattgtgtccagcatttaagtaggtattattactgcttaatcatgccgtgtaagacaaatataattgtttgcattgtgtattcctttcgctggttgcctctttgatcctctccaagggaagggatacagaggatgcgtgttttagcagtatctaattctaatgttatttgttcaagttggtttgatacattcgtcataaatggatcaatctacgtgatttgaactcacccggagcatgatttgaattttgcaaaaagtttagccaatatgcatggattgttctaaagtaactgtgttggatctaatccactggacggttcagatccacataaaggcagttcatcttctgacctcttcagtcccgatggacttcgttgtcgccctagccaactaaacttctttttgtgtgtgtgaaatagagattttcgatttaacctaaatccaataaaaatctttcaaaaaatagagatcaggccattcgaatgtccaatgtaaacgcgaccaacgtatgaacgtatgatctacgaaggaatgctcctatcagtccagatgcacacaagcatgtgtcttggagtcatcgagttaaaatagaattcggacacaagtcacaagcggcaaccaaaaacaataagcaatatgtgtggctcattcaggcaatttgcaaagttattttgcaaaacgaacgactaaaccattgtattttattgacattatataggcgatatttaactttggcattcgcaaacattgtttgcatgccaataagctacagttcactatttacacagcggtatagttcgaacaaacaattggacaacagatcaacatatgctcagtaactctatagagatgtcagaggtgcaatcaccattttactggcataactatactttaggtgtttatactagtagcatttcgatataatttcatcaaaaaaacttttgggctgctatcttgttttctttctgtaagtatactgggaaaactatcgatttctatcatttatggtgtattgcccctgaatagagaggaatggggcagctatcagaatgagtaatcactaatcagcaacatttgtcgtcatagtctatcttccatcatcccaccctggaaggtttgcggtagcctcgtttaccatctttacaagtgtaacctgcattaagaaaatatataggttatggctaaaaataaaagcatgaaacctgaattctcagagacttttcgcaaacaggataatggtacaatttcacaagcatgatattaacccttgttagtgcaacaccattttagctattcttttttataggaacaacgccagctactgggagtagcatttgtaaattcaagaatatcaactaaaaaatctgagccagaaacccaacttgaccatggaataaatcaaacaaatgtcagcagacaacttagaaaaattaaaaaaatgcatgaagcatctattttctggatattttctatcagaatccgcagaacatcttaaacaactaaaagatatgtacattttgcagttttgctgcggaacatatattgcattcctttggaacacttctcatcttcgcccagtttaataaaggtgaatttcggaagctgcaccagtagcacattttctgtagaccctgggacacattcatttggcatacacagtttttgcagggccttgtatttaattgtcagtgccagacaggatctggtacgaatggggtaaactggggttttgagggtgctgctgagaagttttcttagtatattggatactcatctttgcagtgtttgaattgtatcatgaatttatgtaggagtactaaagttagacatcgattgactctaatgcatagataacttccctaccatattttcctacatcctagattatgtataacattattcaggtaagccatatggccagtccaatagttatcattatgcacttctcctattgttctgttcacacaattattcaggattggcataaataaagtaatgctaacaacaatttgttaggtaaaaggacaattccaagccacatgaacccaccgtacatgaaaaaaacacatggttcatatgtgatatactaatactccttatgtaacaatttactagctgggtactgttgtgctttaaaatttgtgcagtactcagatgtaagcatataagctaagaaatctagctaacaagtagttaatgatcatgttggaaaggaagagagaaaattgggtgatgaacttgacacgggaatcacatagtttagtatttgctgatgatggcaatgtgccagcattgtgtaagcaacttaattatgtattcaaacttccagagtggatgccaccatcaatggactcaaagtggcacttgaaaggaaaaagatggcaaaccactctgacttctaagcccaagcaaaaggacaatttatgccaagaccatcatgcaatcaatcatataaatcaaaattatgccaattacaatatcttacaaataattgggttaaggaggaaattatacagataacaattgagttatataataaaacagtgccagtgaagcattgctctagtgtattaacatggcatctgaattaatttaaatgagaaaaaatatttttctgtctagcaaaaataaaacgttgtgttttgtactagcaagactatattatactaaaaaatacaagacactaataacaccttaacatcttaaaggttacaatatttcttttacgacataatgaaaattttgtattttacaaattaatttgctagtaaacataccacactttctggtactcctggagggggcaatgtaagatttcgtggcggtggcctgtcttggtatgctctcttgtcaaatctccattcaccaatttttccataggttagtacaccctgaaatcatttgccagtgtaatgtcaattacattatgttagcaaaacaaaaacaatagtgacttctttactttatcgcctcagaaattttagcttccgatgaatatttatatctgtagaaaaacatcacagatctgggatttcaataccttgagtgtatagtcacatccgtaagtgaagtggataataaatgtatcccaagtttggtatcaaaaggtggctgcaaatttttactggaccatcaatagcactctcatcatgaaactcaacacaactactctgagtcgggcaagtctgttgtcaagcattgacaaaaaaacataaacaagtagagcacctgaatcatgaaatcttttcgaaggatatgttgaaccccatggagtgcactagcaacagcatatgcatacctagaagtcaagtaaaaacaagaacctggaatcataacaatgtaacaagcaagtaaatgcattatgaaaatatacacaagcgtaattctcacatttccaagacccatccaaaagctttatctgtctcctgatcttctttcatttgaatcgatacattcatccatgtaggggcaatcttctcaagttgtatctaaaagtttcctcagatgataagggatagagttaaaaattgaagctcatcaattcaaaacattaataactagcaactggcatgtaagtaatgtaaaaataaaatccaaggaaatactcctcatgcatgagacttcaaggtataccacgtcaattctgcaatatgtgttaccttcttaatgattacaggggaattcccaatagggtcgatatttgtgacagggcctctttctttaggataatatttcctgagaacactttcatgttctgatggtgtaatgtaaaagaaagggaatgctgctggatcatcgcgggctaaatttggtaaaggtctcacaaatatatgatctggttctgccatcaatatgtatctgccatgtttcaacaaaacagaaaattgaaaacacatcagaacatccacattattttagcacaaataaattaccaacgccaacaatgttcttcatctcaaaacccaacaccaagaaaataattaagctattcacatgttgttaaatcatgcatgttgggattctagatatgcgtccaagtgtccatcagagtaaggttaaatgtcaaaaccacaaataaagtaactcaacgaaatggcagataaattttaactcactcttcttcaatctttgctttctccagccactgtacaaatgcccagggcctatttagtacgacatagccctgcaaacaattcaaaacaaaaaaaaaagtttggtcagttaccaaattgactgatcatgtatgtatactctgcaaagtgatttcggcgcaaatagttgcgtacaaaagtaaaacacgccacaaatcctcataaaacacacacacacaaacacaacaagcaaattcaatgtacaaccgaacagagaatagtacccacatgggaaggcaagaaaaggaggcataagttcagacaagtgggtcagaaaactgaagaaaaccttcagttatgatattattgttctgtgaagtaccattgaaaagtaagccatgactgttcacttctcacgcaatcttcttgccgaaattcacagacactatctatccggaagctgttctcaaatcataatgttgtaaaaaagaacattcggtttgtcattaagagttgcatagaagcggtcattttcatccaaaaaatgaaggggaaaaaaaaacttagtcccgtctaaaattcacaagcacatgtgttcttctgaacacctgctggaccacaatgccactgcccccacattgcgcaacagacaaaactgatgaaacgagagagagagagagaatttggtttgatcgcttgcgtacatggtccttgccggcggggagggggtcgacgacgaaggtggggatctcgcccatgagggcgtcgggcttcccggagtggagcacgcgggtgaagcctcccatgtcggcgccctccggccgcgcctgcatccgcttgtaccagtagtacatcacccggcactgccaccggctgtacgcggcgtcggtcgccgtgagcgccacgtggaacggccgccgccgccccccgcccgccgacccagccgcccgcatccaccccggcatcgccaccaccgggtccctctccctccccgccccggtggccgcgccgccgccaccccggagcacgatggccaggaggttgtaggagatcaggaacgcccccaccgctaccaccaccagcaccgccgccggcagccgcgccgcggcggcggccttccgcgccgccgcgttcatctctctgggaattttgggggtttggattcgaggggcggcgcgtctcctcctccctaacgagggaagcgaataattaacaggagaagaaaaatgggtattacgtgtaataatacattaatactcctcctaattagtaattaatacgcgtggattttaacgagtgagacacgatgcacacacttacaggttacagcgcgggcctaccatgtgtggggccgagttgtcagtgggatttagaagcggggtcgtgagggggtcgccggtgagaatgttggggggatgggagtcaacgggattttgtttgtacctaaccagtggcgtgtggtagcgtttgacgcagctgcgtgctgccaccgtgcaccagttgacttggcccactgagcaatgtcgagtttattattattattttttttttggaggggggagggttggtggtgggggcttcgatttttttagctgccggatgtgttttaagattattttttcaacaaccggatgtgttttaagattagtggtagggagggacaaaatttgttagatgcgtgaaactcataacaagggaacacaagcgcttaacgctaatccgtgcgctagtacgtgtttttaaggtattcatataagttactatatagaagttacattatacgacaagcaagatggataaaggagccaacgagcttctcgatccaatcatatttcctgctacgccacctagcctacatcgacatgccacctctctcctaccttctttttcttcctcctccctccctttgctctcttgccacaaacgaggggaagacaggatcaatgacgagcttgactaggggcccatccgtttgactgagctcgagagaagtggggcaacaacaagcttgattggagcctgacctcttggctaaggtcggataggatttttgagtggccgcaagcagatgaggaactggacatggatcagagctttgtggacatggacatggtgcggatcagccctccatgccatctagatttgtcgatggctgcttgtgatctaggagtctttccttccaaatgccacaagccaagttgcaatgcttcaatgctctcctccacgaggcctttgtcatcgtctcctacccaagctttgctaccacagcgagccggccccgagcttcgctatgacactcctatccaatattcgtcggtgccgctctccacatcaagctcgaggaggtcagctttcattggtaagctcaatcaatggtgaattgtgaagtgacattgattgattctaaatatcggcatgtgtgatagcattccattatgggcaggactttgtaatgggccatggcccccctctagttttctcaaatggataaaaaaaggtccatttggcctccatcaactatatgctgagtttaatttgtgttctttaaccgcaaatctggctatagaagaacctcaactatttaaaccaggttcttcactttaataggatctactagtttctacatgcaaagccttagagcaagtacaatagcaggctacaagttagctataagcataaatggaataaataagagatgagagagaaaaaaacgggctatagttttatagccagctgcaatatggattccaaaatatatgagaggtgggaccatatattaatggtgtattatatatttataactaattattatatcaataagctatttgattgactatagacgatttgaatctattagttggctgtttaataaacttgctcttacgcgtttgggttttggtttaacagcatgcatgtcaacacgtgtagcagttcttctcacaaattgcctttggtttagctttctccaacaaaaaaaaatttgggccgtattgccttcacgtacgtgcgtactcgtgcccgaccggagctagacctacagtggttagcttgtgtgtcgtggttgagtccgactcctgttgctgcgtgcactaaaagccacgacggtaacaaactagaatcgagcgctgggtgctcctggaataaaaacgaagttggcgatcccgtctacaccgaatcgaattgctcggggagtcgtacgtcctcgtgccacagcttgagctcgccgcctaaagcctaccggtgagttgaattgctcgatcgttccggtgcagagggtgatgaatcatcagtcacgccgcggagatacatcgtacgtgttgccctctagcaacgcgcccaggcggctcgagttccgcatccttaagcgcggcctccgcaactagtggcggacgcaggatttcgagaatggagtagaagttaagaaaataaatatcactcaaaaataataataaagtcctatgtaaatatagtgtacattaaattattaaaattacaaaatacttaataaaattaaaattatactcgatcggaacttttttttttgaaaaatgggacattatgtttttacaatgaatatgtagaaaaaaaagttgttttcaaagaatttaactaactaattattcaagtttttttatgtaagttatatttcttatttattttatatagaattagttgcaatattctgggtacaaaatataaaagcccatggacaaatcatcacaataacatttagatggttcaacatattaaactttttcagaaaatttaattctttgaaggctccatagataaaatattcagcaattttaaaggttctataacctaaagtcacatttagcctataaatttcttgttgccttgtagttgtcatggccattggttcgtgccagtgattaagtgcaggatggactatggagggtgaggtattaattggactgaagtactaatttaggtgcagatatattcattttaacccacttttggtatatgtatgaaatataccatatgtatattgttctttttgcaaaaaaaatttgggggtacagctgtaccccatgtccctatacagtgtccgcccctgtccgcaaccacaccggcagggtgagccgccacctgacatgtaggggcggagctagaacaaaataaaagagaatgtcaatggcttaatttactctattttagatcaagtttaagctgatgtgggtgtctcagtttgtattgagagggtgcacaaatgatgaaaatcggtaaggtataactaaaaatttttcttgactgggttcctgggcaccccctccaatactctacctccgcccctgctaacacgtagctgcttcggcgtgcggtcagtcgtccacaaccgctacgtccagaagacgcgctactaccactactgcgagctagtcatgtcaattaggctgtgttcggcagccctttttctcaacccctcttccttgttttccacatgcacacattttgaattgctaaacgatgtattttttgcaaaaagtttctatacgaaagttgcttaaaaaatcaaattaatccatttttttaaaaaaattagctaatacttaattaatcacacgctaatggaccactccgttttccgtgcggagggaatgagttcccatccggtagatgctaacacagcctcacagctggttgaggcagacatgatggggatagaacggtggccggggaaactgttttaaacactcgagtggacgttcacccatcttttgcatgtcaattaaatgattatgtaaaaatttcaaaaaaattgacaagatgtattaatatgtaatatatcacttcacaaatatacaattccaaattcaacttctataagttgtaacaaaaataataaatttaatcgtgaatatttttttagataatggtttttcattaatccagcctctatatccacgagggatatacacagccaaaaggatagaagagtacttagactcacacctcaataaagaggagaaaacacaaccaaaaaaatgaaaaacctacaacctcgacacatccctacatcctgacatcgtcctctcctgaaacggccacaaccgacaagagggagtcgtctagtgccactgcccctagtgtgttatcgttgcgaatctccactaagtgccatcttcatcagcttcaagtgaagtaatgccactcgctgccgggtagcccaccttcatccatcatcatctggtcagaactagatgaccagacactagctgaaagcatttgcttatgcttcgccagattcctaagccccgccgcccatagggccgccgtcgacgtcggaatcctcctccgctcttggactaccagcccaccgccatctctgctggagttagaggactagcctccgtctctgcccaactccgttgtcgcccaccaagtccgtcggtgacaaaggaggggatagaggactcgctccatctccacccagcaacgctgaccaccaagtccgcagcaccgtcgtgataaaggaagggatagggggctagcccccatcatcgcagcccatcgagtcatccagtgatggaggaagggacggaggactagcccctgtcttcacccaacgccgccgctgctaaccacgtccggcattcgctgatcggagcgcccggctgatcggcaacctcctccgctatcacggtgtcaccaccctcggccaaccggcaccataaccaccgttgcaccatcctgccttgccgccgctaccaccttcaacatcaccaccgctatgctgcttaccggagccaggcgagacccaccatgccgcccatctctaggaaggggactgaggaggaagcctcgtcgccaacccagcggacctgcaccctccggtgacctactccggcggtggcaaggttgaaaagcggtgacgatggtgaggatttaccagattggcaacaagccaactgcttgggactggatctgagaagaaaaggtggaaaagggagaagagagaaagggaaaaggtgaaagggggaggaggaaacagggaggaggtgggtggggacagcgccagcaccaccgccgatggtgccgatggtggcgaggggagaagcgccggggtcaggtcatcctcctcccgggtggccccagagagtgacacgggagtcaaggaggcgtgtcaatttttagagtttaatttatcttgtcattttttttgaaatttttgcataatcatttagttgacatgcaaaaatgggtggaggtccacccaagaaattagaatccatcttctggtggccggggtacgtggaggcgaggccattgtgccagagggtcagcgacatctacttggcgctcaatccggcggcacacaaggcgtgcatgctactagagcgctaccggaggatacaagcgcggcgcagggcggcaatggaacgctatcggaggatgcgagtgcaacgcagagttgatgttgtgcagtggcggcgaaaaaagaggttggtgaagcgcgcactcatcttcgtcttgccggccttggagacggccatgcttgggctcaccctcctcaggaacacgctcgtgttggattcgtacaccacatgatggaacttgtgcgcgtgcctctcgtatgttgcatgggtctattgctttcgcttatttgtgtgcatgacaagtaaactttttgtattattgattgttgattgattctagatacagcatcatgcagtaagcatggtcttcttcagagaaatatggaattactacatttcttcggtttgaattcaagctgagattatcagttctcttctcccaaatggaatcgaccaattggctgcacattaaatatcagaatattgacatctatcctcataattattttttaggaaagggcaggagctctgccaatttcaattaagtagggggagaaaacacaatttttacaacatatagcctcaaggctttggggggtcccctggagagaccaattgaggagggagaggggaggaggcacataagttaagaaaatgcaaagcaactaataacaagatgcgctggaaactcatccaagttacttggctgcattgaactccttgcacatgtctatgatggaatcaacaacctaaggcacaatattgtatttcccattaaagattataccattcctttgcatccagatgccccaagccgtgtagatgaaaacgccatcgaagttacgcctttggtcttttatcatttctcttctgcatgtttcccaccaacctagcatatttcctgagaaaaggaaaggggaagggcggaaggcatgtggaggccaagtttgctctatatgctgctccagacttgtcttgcaagggaacaatccatgaggagtggtgggcagtctcaggttctataccacagagggggcaaatctcactcttatcccatccccgaatctggagtttgtctgcagtaaggattttcctgtgtatcaatgtatcatgagctagccgaagaatttgcaaaatcctgttatcctcatattttctaaaatgtaaaaagataatgatactgtacactacacaattatgtcagctatggttcgatctgctatggttctcttattagtagggttgaaagtgattcggaccttttttcggattcggatagtttcggttggacatatatgaaaattttcgaattcagaaatgaattcggatatttttttcagaaataaaaacgaatatgatataggtgatatccgtcgaaaatcggataacgatcggatactatccggtatttttccatcggatatccggaattcttatgcaaaaacatgttttacttttctctacttaggtggaacaaaacaaaccatatgaataagatacaaggaatagcaattaacatacaaacaaatggaaaaattcaattctgaaaaataaccactcaaattttcaaaaactttcaattcaattatgaaaattttaaaaacttttaattcaaaaattgaaaagtttcagttcgaattcaaaactctcaactcagatttaaaaaattcaactcaaattctagaacgtttaattcaattttgaaattctcaactccaattgaaatgttcaacccaaaatttaaaatattcaaccaattttcaaaaatttcaatgtgcctgtgaaaatttcagtggtacacactaatttatttgtttcatggtaacataaatttgtatggaaaataaacacaacattttctatctcccccttgcccttacaaatagagataaaatttgaaaatattaatgtgttgtttttgaaaactaatggctacatctcttcctcgatttaagaagcttactttgaggggtcttgatatttcgataattattcgttaccgtatttgtttcgattcgtatttgctccgtaactatattcaataatattcgattccgttttcatatccgggtttccgattccgatttcgattccaagaaaaaaaatatgaaaatgaatatgatagagctagtttccgaccgtattcgatccgttttcatccctacttattagtggtgtgcatagattctccccatgcattgccaaaaaggcaagaacacacagggttaaagctggaactttgacatggctgtatttggtcaagatacaagacaaaattccataaatattgctgcagtgctatgctgcatcttcatatttcaggaacaagaaaaagagcacacattgatagatagcgcttttgacacattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42840 - DNA, 9505 bp, Oryza sativa
tgaatatgatagagctagtttccgaccgtattcgatccgttttcatccctacttattagtggtgtgcatagattctccccatgcattgccaaaaaggcaagaacacacagggttaaagctggaactttgacatggctgtatttggtcaagatacaagacaaaattccataaatattgctgcagttgctatgctgcatcttcatatttcaggaacaagaaaaagagcacacattgatagatagcgcttttgacacattgcgctttacacatgctttggtaatggctacaaaaagaatcttacagagcgctttcaaaagaccggcagcctaatccacttaaaaggtgaatggtaaaaactaatggagatcacaagttaaatagattattctattcagcaaaaaatgtcctaataggtggaaccttgagcctactgtcttttataactttacagtattttgaatctgataatcaaaataattccatatattaacacaaactgggttgtagttggtcaagtattatactagcatctgatcaattaacagaattccatgtgatcaatggggaaaatacaacacaggtggaaactattagaattcacgttgtcaacaatcgaacaagcacacacgaacacacggacacgaaagtggagggcaatcaactttattgatgtttctctctctgttacaagtattactttgccctcaacctcactattgtatttatacccacaataggatgtcctatatggatacatacatatatatttgatataagcctacttcattaataaggaaacagaagaatagaaggaggaggtaccgtgatcctcacgatcatagtcctacaaatccgactccttcgggagatcggtttcataacactcccccttgggcgaataccgcgctatacatatgcctcatcgaaactccttccaaaaacccaatgggagaaaaatgaataggagaaagagtacatagtacacgctacttatattgcactgttgcctcattaaaaacctaaatgtgagaaacttcaaagaaaactcactaaagggaaaaagagtacaaccataagctaatctactggataactctatcattcttcaagaatgatgtactaatctgcatgatcaatatcaacggaacacagtcagggaagtgctccccctgatttgttcatatctctcatcctactcataccgatgccatgcacaagcttctcaaaaacactagttggcaaagacttagtaaataaatctgcgagattttcactagtcttggtgagagtcaccttgatttcttctttcttttacaattcatgcatatagaagaatttaggtgatatatgttttgtgagactcgtcttcacataacccgtttgtatttgtgcaacacaagctgaattatcttcataaataatggttggagttggtgtgatattcagcccacatgtattctgtacatgttgtatcaccctcctcaaccacatgcattccttgctcgcttcaaataattctataatctccgagtgatttgttgatgtcgcgaccatcgtctgcttcgttgacttccatgagatggctgtaccaccacagagaaacacatacccaatctgtgacaatgctttatgagggtctgacaaatatccagcatcagcatatcccgtcatggtcaaatcttgataattttctaaagaataaaccgagatcttgtgtgccacgtaaataacggaagattttcttaacgccattccaatgccgtttggtaggagccgaactgaaccttgcaagtaggttaacagcaaatgcaatatcgggcctggtaccattcgcgagatacattaaagctccaatagcgcttaaatatggacattcagggcccaataattcctggttattttcctgtggtctaaatgggtcactctctactgctagagatcttactaccatgggggttctcgttggatatgaatcctttatattaaatttctccaatatcttctggatatatgcagactggtgtaacaataccccttcatgagtgtgctcaagctgcagacctaagcaatatttagtcttacctaattctttcatctcgaactccgtctttaggtaagaactagcttccttaatcacctgtgtggtcccgatgatattcagatcatccacatatacagaaataatacaaaatccatgttctgatttttttgataaacacacaggaatcatcattcttgatgaatccttttccttctaggaattcactgagccggttgtaccacatcctactggattgttttaacccatacaatgatctttgcaatttaacactgtatatgttgcgttttgtttcttcaggaacttgaatcccatcgggaactttcatatagatttcagaatccaatgacccatataaatatgcggtcactacatccatcaattgcatttctaagttcaaattgactgccatagatattaagaaccggaatgtaattccatccattacaggtgaataggtttcatcgaaatcgatgccaggtctctgcttaaacccttgtgctactaatctcgctttataccgaaccacctggttgttctcgtcccgttttcggacgaacacccatttatatcctacaggggatatccctacgggggtacgatcaacaggaccgaatacttttcttttattgagcgagattaactctgcctttattgcttctttccatttgacccagtctgaacgctttttgcattctgccatggactttggttctggatccagatcaatgatcttagcgatcttttcggcaaagtatatgtcgacaatagtagtctctctattgtatgtttcacctgtatccacataactggtggatatttcctctattctttcacattcctgatcttcattgtttcccgcaatgtttaagtcaggaatttccggtctcccagtgctagtagtaattgcgcgcgcattctcactgggttcattgccatccgggcatatcactgcaggtggctcatctacctggtgagctccttcactattctctggtgctgtggtattctgtccaatctgttgtttcgtaggacgtctcctagaaactttagtttggttgtgtgcaaccggtggtctccccctcttcctagaagttggggtagatgtagaaattaatttgaaaaccggttcctttgcgtcatgaggtatttctactctttccggtgcattcacagcaggtatatgagatttcatgatcccctttgggttagtgaaggcttctggcagattatttgcaattctttgcaaatcaattatggtctgaacttcctggtcagattccttagtacgtggatctaaatgtaggagatttttagtttcccactcaatttcgcggcattcgaccttctgtaggtactttcctccccctaatgccgggaaatgatcttcattaaatatacaatcagcgtattgacccgtatgtaggtctcctatcaatggttctaaaaatttaacgatagacggagattcaaatcctacatagattcccaattttctatgaggacccattgacgtacacttaggtggcggtatagggacgtatacagcacatccaaatttgtgcagatgggaaatatttggtgcatatccacgtgtaagctgcataggggatacaacattgtatgcagtaggtctgatttgaagtaacgccgctgcatgccaaacagcgtgtccccaacatgtagttggtaggttgctatgcagtagcaatggcctagcgataagcttaatcctcttaattaatgattcggcgagaccattctgagtgtggacgtgtggtacagaatgttccactttaattcccaaagccatgcaatattcattaaataccttagaggtaaactccccggcattgtccattgtaatggattgtatccggttatccgggaaactggctctcaaccggattatttgggaaataccggaatgatccagacatgggattaattggtccacatatgtttccctgtattcgttgcaagaatactggtgattctgcgttcacctttagattagagggtctaacgattaatttcgctgttgcacaatcagtgcaaacaaaatcttcttggtttgggaaatcgttagttcgtaaattatggccatttgaagttgagatgattcttgtcatcatccctagacctggatgtcctaacctatcatgccatattctgtatgactcaggatttttaaatattgttttcagtgcaacattttcgggttttatatgagtgtagtacaggccagatttcaaggaagggagtttttcaacaacagtcttacgatttccgtttaatttcgttatgagaagaaatttgagtttattctcatctttggtttctacatgataaccattagcacggatatctttaaagcttagtagagtacgactggactctggatataatagagcatcatttataatgatcttggtaccatgtgggagaactactgttgctcgtcccactccgacgatgtgtgcattgcttccggcaatagtagcaatttgaccagtctttttctttaaagtctggaaatacgtggtatctcaaaagatagtattggtggtacaacagtctaccagacacatctcctcttccattgccatagtacgtaacactattcttatcataaagcatttaaatataatcaattcatgaccatatagcaaaaattaacactttaagatagaaaaataaaaatctgggaaatatattaaactaaaagagttcactcaattattaagataaccattgctctgaaggagcttacagaaactatagttctgctaggaacacaaactaaatgcacacttgaaaaatcacctaactttagtctattacatagtctaaaatttaaagtaacttataatgtaggaagctaagatacaaattggaagacttaaatgtccccatataactgatcagagtccatgagatcatctgagagctttagctctgcgtctgctgcattctgttccatcttatcatcgatgtgcattgcaaccactgccttctcgtcgacctgcttgtcgatattcatggcagccatcttctcctctgagtgctggatctcaacagtgaagtgtgactcatgctccgacttcttcttcccatgcttctcttgataaagctcaatgagatgcttaggggtgcggcaaatgcgagaccagtgtcccctagtgccacacttgaagcatacctgatcttgttttccatattcaccactagtagagcccttcttagacttactgttctgatttcctttcttcttgaaagacatcttgttaactttgccaccatttttccagaaattcttccctttgttctggttattctggttattctggtttttccccttcttaaaggagctagcatttgcttcgggtgctgctgaacttccagtggggcgagacgtatgattttcagcaagtgtctcatcttctccttgcgcttccatgagcacggagactagtttagaatacttctcgtatttatcctggcggtattgcctctgaatattcacatgattggcatggaaggtggacaaagttttgtctatcatgtcagcatcagtgattttctctccacatagcttaagacaagtgacaatgcggtgaagaactgagttatattgctccacatatttgtaatcctggaaacgtaagtgaagccactcacgttttgcttttgggagcaaagcctttacttgatggccatagcgatccttcaatgagtcccaaaggacattcggatcttcctcagtcatatactcattcttgagagtagtattcaaatggtgcctcaggaaatgcagtgcctgatttttctcggctgaagttggtaaattattaactcctccagctgatgttgcaatagttgggtcctgaatgcagttcaggagtttcttagcaccaagcatgattttggcatctagtgcccatatcaggtaattctagctgctgactgctagttcagcaaaatctctcttagcaatatcagtcattttcctacactagtcatgcaaaattcaataagtactgcaagtaagagcatgacaagtgtgcaaatagtaaattgtctggttatccaaatttagtactgtgtcaatatattcccataattctcccaacatttctcagaattgttgtactatttatttaggtaccaaagtaattactgaattactaacccattaaatagtatcctgaaaaaaaaataaaacagctaggaaaataaaccataaatatgatgctctctcgtgtgtactaaatttcaaattatgagagctcatttcctaaaaaccatgtctctaggattctatggttgattcaaaaattaactaataaacagttaatatacagaaaattgaaagtacggaataacaaaaaaaaaagtgatattctctgtaatttctatgatcccgagggactattccgctaaaattccaaatccgcgtgtatcctgaaaattcaaggacatattcagaagtttgcctttttcgggccaaatttcgattcgagcccgactccttttataggcctaatttatactcggcccacctctatgtaccggctattcaaaggttaaccggcccgtcgggaccgtcgtcctgctaatggccttggcccatatgcggcccaacaagggcgccgcaccttatccaatcgggtggctagggttgaaaccctagcccctaattccaccgattcgatggcggcggcgggtatcccggtggctcatgcgggcgaggcggcgaggttgacggggctcgtcatcacggcggggtcgacggagctcgtcggcgcggcggggtcgatgatagaggcggagcggcggtgaggctacaagcagcaccgacgccggcgtggttggctacgggccgtatccggcgtccggcaaacgcagctccttgctgtgcgccggtggaatttggctcggcatgcgggtcggcgaggcggacggctatcggcggcgggaggccgcggcggcttcgacccccatcccagttgcgtgcggtagcgcgggaggcgtgccgtgcgtgccggcgggggggggggggatgcgggcgcggtctcctcagcgtctctgcgggcggcggccgttgacggcgagtgcgggcggtcgattgaagacccgtcgactggcttttcaagggcgaaccgacgacggaaagccgatggcacgattctgcggccatcggtgaagcgggtggccggcgacgcgtgctggcggcggcgagggcacgacggcgcatgctggcgtcatcgactcggtttcgtcgtcgtcaacttcaggaggacggcggcgctggcatgaggatttgggccgattcgttcggaatcggcaatcacgttagccaggtacgcgattcttcttatgtgcatcgcgattacaccctgaacatagcgtcgcccttcgaggcatcactagttctaaaccgtcgttcttgcagcggcttgtctgatccgttcgtgcgtctagggcatacggtatccgtgtatttgtttgcaagaaaagaaacccagcgcaaaggctgggaacagatctaatcggactatagcgataaccgcttctcgttcgatagatcggttgtacaagggataaccccatacgcctgtcgcgcatggggtggagagccgcaaactctcctgctacgtgcgccataagggacaaatccacatagtacaacccatcgatcaaacgattagcggagaaataaaaataacagaaaacgatctagcaagtttatcgttatccctatagaacgagattaggacagatcgatgttgacaatataccttggctgaagagcacctcgtgctgataacgtattaggattcacgttgtcaacaatcgaacaagcacacacgaacacacggacacgaaagtggagggcaatcaactttattgatgtttctctctctgttacaagtattactttgccctcaacctcactattgtatttatacccacaataggatgtcctatatggatacatacatatatatttggtataagcccactttattaataagaaaacagaagaatagaaggaggaggtaccgtgatcctcacgatcacagtcctacaaatccgactccttcgggagatcggtttcataacagaaaccatgtgatcaatggggaaaatacaacacaggtggaaacaacctcttgcacagtgcacacttttacaataatatcccaccctgatctatcttttttaaagctagctcatctcgagtaattttattgggccacatggcagtgttaaattttgagataaatctaagaaaattaagcataagaagaaatagccaaaagaaaaagaaaatacacaaatccaatttctagaggcttcccagtgatccatccttttgagataaatctagagaatatccataagaaaagaaataccgagaagcaaacaaaaggcacaacatctagattctagaggcttcccaaaatatatttcccctttgtaatctatctcgtgctggttggtttcgtgccagttgattggctgccctcaccaagagcgacacgtggcgagatacaagcggtggaaagagtgtcgggtaagaaacgctctctataaaactggcaagcgctcaagttatgacgttgaattgaaaaaaagagagaagaagagccactccatacgcgtagcttaggccacacagcaccacaacccaatagtatgtgattggaccagtgcaaacacgtaaaagagagggaaaaagaaaaaggaaaaaaaggaaaaaaatactttgtaaaattctttgcacattattcggggcatgtatcgtgatcatatatactatgtttcgagaaactaaaaacaataaatagaaaaactaaatgacataaacaatttgctcttttctaggattgaatcaaactttgtaatcctgataaccattttctaaatatatgtataatctgcttatactacaaaagaaataatatgtaaatctttcaatttttaaaaacactataattcggataaaacaaacacttatgtcggtgttgtagtcttatttcatatctaaacatcatgatgctcaaaatcgtacaagaaaaattaaatattttgtatgttaataatgtggtttttaaagaccaaatacataggctaatcagctggcgcgctaaccaacgcgttgatttttctacttaaaaacaaaacatggaccactagaatttttataaagatatggaggagaaataaaaaaacagggacattgagtatatggaggagaaccatagagaattttatgtgggtatggaggagaactaaaaacaaagggcaactgaattttaggatgatataaaagacaatcatgtagaaaacacaagtaatgaacattaaagaatgagtacaaacagtacatttaagtcttggggtagatatgtacaagttatcaatcttacaaatatatca

SEQ ID NO: 42841 - DNA, 2246 bp, Oryza sativa
gattgaaacatatacaattcacagtctacattttgcaacgcaaaattaaattaagacatacatgcaaattcatgatgcctcctagacctacgataattacttgtgaactcatgacgaagaactccttcatggccttttgccaggagcattcgttagcatgatcattttagaagccatggctggaagaaatacctctcgtaatgtctcacgttggatctatccaataacatgttctctaacatatgcacattatcgatttggtatcttcataccatgatccataatacatgatcatctatcaatatatgtgctgatcatctaatcacatttgtttcatatgtgatatttgattagggaatctttgaataaatagtaacatacaacataaagagtttcatgaatgaatcacatatttattaatcaataataataaaaaatacctgcagtctgagctgacattgatgcggctagcatgcctatggctaccaccacgccgaagaccacaacggcaacggcgatgagcacaagaaaaggatgcttcgcttctggcgtgcagagcgtgcacaacagcagggcgacatgtctatctcatgttttgcaaaacgtaaaaaccagtggtattgtacactttatagtcatttgtatccacaaacgaagtatacgcaagtgcactacaatgtaactagagatgaaaacggagcggatacggacggataatgcatataccatattcattttcatatttttttccaaatacgaaaacgaatacgtatagctcgaatacgaaaacaaatacggattatctcgaatataaataagaatcgaattgatcggactcgaatacgaaaacatttttttctcggaacacgaaaaccaaactcaacttctaatataaacaaatatcaacatatataattagatccttttatataaaatgtagtatactttataattttttaaaaaaacttaaataatattaatagtgtagactagtgttaagaaataaactactattaaaatctaaaaaggtatattgaaggtcatagagttataaagaaatggagtatgtctcatggctctgcagatatcctaatagcactgttcaccggatatccgaattgttatccgtattcgacggaaaccccgataccatattgtcagggttacgaataacgcctaccctccatccttggatatacgatgtatactgatatggtatacccgcgcatatacgggtgtttcctgtatacgttaaggaaatctatcacgtaacataaacaaagtccacaattggaaggagtcctactcggacggaactgggtcgttaccatatcgtgtggggtccgatatctccgagttctacttggagatcgactaacccgcgatataaaaggaaccccccgggaggacctaaggcatcgaatcttaccgccaacacatccaccacagcctacgaagccagagcctacatgagccaagtcgctgggtgatctagtcgagccaactcgactacgatctcgttggttcgccgaatttcattattccctttgtaatatgtggtttccactatataatcccatatcaactggactagggctattacctaccaaggagcctgaaccagtataatcctcgccttctgtttgctcgatggtgtattacgtaatcctggtaccagcgcaccccaataccctctatatccggtctgcgggtatcccccgtcgacacatatttgtattcgtatctgggaaaaaatatccgtattcgtatccgtatctgaactatccaatccgaaaggtatccgttttttgtttttctccggagcggacggaaactatccgctccgttttcatccctaaatgtaactgcaactgaatgtataacacattcgatttgctatagtagtgcagcagtgggagagtagattattttaaacactctcgagagaattcttctcattatttgcatgtcgcttaaatagttaaaatattaaaaaaattgagaaaatatattagtatgtgatatatatatatatatatatatatatatatatatatatatatatatatatatatatatatatatatatatatatatatatatatatatatatatatatatatatatatatatatatatatatatatatatatatatacacatacatatatatatatatatatatatttttttatatatatatatatatatatattttttatttatttatttatatatatatcaaa

SEQ ID NO: 42842 - DNA, 1773 bp, Oryza sativa
tgtgtgtgtgtgtgtgtgtgtgagttttttatatatataaagaaaaaaaaagagtgtgtgtgtgagagagatatatatatatatatatatatatatatatatatatatatatatatatatatatatatatatatatatatatcattctataaacattaagttaaaattcaaattttacaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaagattgtccacgatagaaattgcactgtagtttatattaactgaatgaaaataaattttctgctttgtcattatcatcaacgatggaagtgcatgcacggttacctttagcattagcggcccataataatgcaacttctctcttttaagtttttatttttcaagaggacatcctcttatttattgcacgcaacctaaatagtatagttattaaaaatttagaaaaaaaaagttttgatgaagcaaattagtatgaaacatatcactccacaaatataaaagtccaaattcaactttcacaagttgtaataaaaacaacaaatataattgtgaattcacgttaactaatttcaacttaatttgtacttttttcttataacttataaaagtcgaattgatcttgcatgtttgtgtcgtgatatattttatattaatatatcttaattatcattttttttattttttaataattatttacgtgatatgtaagaaaggcaagaatgttccatcaaagatgaaaatccatctccctagctttgacatacctatatatggtcatgatacaaagacacaagctgcaccttcatatttcagggggaaaaaaaagcgcaaatcgcatttttgtacgagaaacaagagcatatgaattggtataacaactcgtgtcaatgttcaaaaaaaaaaaactcgtgtcgacgtgtcgtgtggttgggcccgactacgactcaaaagacccatgcctgagccatggcggccgtgtaacagattataatagcaaatagctcgagttattttcgtggttttctcctgccgagcggtactgctcccggtaaaacgaaacgaagatgcatggcgatcccgtctacaccgaattgaagtctccaagccagtaggaagagagaagatgaatcaacagtcacagcagatgccggggagatgcatcatatcgccctctagcgagtagcgagacgcccaggcggctcgagttccgcaagcatccgcaaacgcggcctccgcaacaacactggcggggtgagccgcctcatgatacgcagctgcttcggcgtgtggtcggtcgtccacggccgctacatccggcggacacactatctccgctacatctggagttgaggacggcttgagcatggagtgcattgtgggcgtcgacatccacagcagggagtggcggcgcgggtagttggagaagaagccgggacgaggccgacagatagtcgggagagaagcgcccgcattctccgggagcattggcggtgaagtcggggccgcacccaaagtggtttctgcgccgcgggagtgtcaaacgcagccgtcgctggcagatgtttggagagagcatcacgcacg

SEQ ID NO: 42843 - DNA, 25365 bp, Oryza sativa
cgtggtgggcggagcaaaggctatctgcttaggaagaaggaggagaagaaggagcttgatcagatatgaagatactttggatagtacaacaactgtcgatgccgctgtagttgcactccatctatatttgaatttagttagtagaagtactgttcgctctagtgttctatgtggtctaagagttttaaactcgtttatgctatgatttgtttttccatggaagcagcatcttgaaattttagaaattatgttggacgaacacatctgacagacgagttgagggggtggtttaacagctttgttgatcgcctgcgcttgagctactactgctgcacaatgcacatgtggcaatggagaaggtggagttgcacgtgagaggaggcggacggcgcgggtggagcggtacggcgatgctgctgcgcgcgccatctagctacaagctaggcggtctcgccggcggcgcggaagacaaacaggtgcaagcgcggcgcgcatgcagggcggacggatgaagcgtgcgctcatcttcgcattgccggccatggtgacggccgtacgtacgtgcttggccttacccttctcaagaacatgttcgtctcagctcggagtcgtatagcgcgcgtatggcgaaacctgtgcatgtgtgccttttgtacgtacgttgcatgggtctaagtgcctccgtttcatttgtatgtaggagaaacgaactttatactagtattaaccgttcatttttatgtatgagaaatgaactttatactagtattaaccgttcattgattccaaatatagcagcatatagagcatcaccaatacattagcaataatctatctctaaaatttgatttttgggttttctaaactaaaagtaattagcaataatctatctctaaaatttgatttttgggttttctaaactaaaagtaggaagtattccttaaaaactaaaagtgggccctttcactttttccttccgctcacgcacaaaaaatcacggtcacttgctcccaaaaataagttttgatcacccgcttccaaaataagttttcgcgcgggaaggagaggacaagcgcgggcaaggagtgagaaacggcgaacgaggagacactctctctcccttaaatccacatagcaaaatactccctccatcccaaaatgtttgacgcagttgatttttttaaacatgtttgaccattcgtcttattcaaaaaatttaagtaattattaattattttcctatcatttgattcattgttaaatatattttaatgtatatatatagttttacatattttacaaaagttttagaatgagacgaacagtcaaacatgttttaaaaagacaacggcatcaaacatttagggaaggagggagtacatagggatgggaactccaaaactatctcaaatacacgtagccaaatatatggaaatgggaactccaaaactagtgtagagcttttgggatttgttggatccgatttttttcgctaaaaaacctcaaaatcaattttggaaatgaaataggatgactgccggtgatgctcacatccttatcttttatctttacctattataaaagtttaagatgtttttgccaagtattttcgtacgtcgtcctagtataatgggcgcgtagtccgattccctccccgtacgcgaaacggacaacttgtttaccgtatagcttgattccgaggttgatacgatgtgattttgctctaattcttagaaagaacgaagatagaagaagataaggatcaaaactcttcaattaattttggattatctctgtggatgcggactgatttcacagaggtggcggtgttgggaaggtgcagagtcggacggaggtaggggacgacactgtagcactgggacccacgcgatagtgagaggaggacaagggatgctaattagactttgtggttgcttgatgggtcggatgcacgcttgcaggctgaggtggaagggaggagaagtgaggttaacgggctgagccggctacgggctaatgaaagaatgggctgaaaatggccctgggagaaaggagggttttcatttagattttcatttaaataaatgctaaaatgatttttgtattattaaaattagtaatggagctttgaaaataccgaaaaaatttcacatagtataattaatcatggaaaattgaataaaaattaaatctagccatagtttatttgggaaattttattttccacatttaccttgatttttacgagcctttcttttctttaacatcgtatacatgcatagttgcgattttataatttaattaattacataatgtaagggcctattcactttgatgccaaaaaaaaccttaccaaattttggcattaccaaaattttggcatagttgccaaaattttagcaacttgccaacattttggcatgattttttatatagttaccaaaatttagcatcaaactaaatgtagccacttttttggcaactttaccaaaatttggtaaggttgaaaatggcatcaaagtgaacatgccctaaatctttcccaacctttccttaaagttctcatgttttttccgttgcaatgcacgagcatttttttctagttcagagaaaaatacggaattactatacttcggtttgaattcaaactgagcttcgattgcagactagaggtcagaagaataacatcatctatctcatgttttctaaaacgtaaaaactagtggtacctatacatatgtatccataaaaaaagtatgtgcaagcgcacctacaatgtaaggagaaaccatctttgatcggtcgaccaaatttcacaatagtcctggttacaataaaaaccgaaactaaaaattatctttagtcctggttcaaaaggttagagctattttttttatctttagtcctggttgggaacaccaaccgggactaaagatcatttctagtcccggttcaaagaacaacagactatgtcacaccttctctattatctttagtcccggttagtctatttcttgtcctggttggtaacatcaaccgggaaaaaagatcggcatacgcggcggagaggacgagacatgtgcaagatcgaggaggaggaggcgggatcagttaataagttctatctcctccctcaccttatctcttcctcctcttcaccccatctcttcctcttcctcctcgtctcctcattctcttcctcccctctcctcccattcacaggcggcggtggctgcgccctcgcgcggcggcggccgcgcggaggcggaggcggcctcgtgcagcggcgaccgggcggcggcaagcagtggaggccggtgctactgcgtggattttttttcttttttccttaatgtgtgattcgatctgtattgaatgtgtgattcgatctgtgttgttattgtgaatgatttggggatgactattgagtgaatgatttggagatgaactattgtgtgaatgatttgggatgaaactattgcttgtgaatgatttgggatgaactattgctgtgaatgatttgggatgaactatattgctgtgaatgtttgatctaaaatgatttccgcaaataacaaaaaaacaatgaaaaagaaagagagaaaaaaaacctccagccgagaccacattgggactaaagatcgatctttagtccccgagtatttgaaccgggactaaaaatagcgatatttagtctcgaattcttactcccggttggaaaaccaggactataaaggggttaccaaccgggagtaaaaaagatttctccaccagtggtatatatataacacatttgatctactatggtagtggcgtgcaaaagattgtccaagatagaaattgcactgtagtatggtctatattaactgaaggaaaagaaatttcctgctttgtcaattgtcattgtcatcgatgatggaagtgcagcacggttaaagcatagcagcaaatagtaaagcagcttctctcttttgacatgggaaagtgttattatttctggtggcgatatcctcttatagtcttatttattgcatgtcatctaaatttatatatctatatacctaacaaaaaaaatacataaggtttccggttatttgttttcgttagtcatcccacttgcgtgcactaaaatctgttttaatccgcttagccacgtcaggcctttttcaatctactccaaaaccagagtttagatagtattttccatgtctgcctacttggctaaggaaggatgttttcacgttgcccaccacccgtattattacttggaataaatctactttgtcctcatctcttgctgctaattgtatcgcaccctcaaccgtaaaacgggtataacacctccctcatcttcaaaaaccggtacaaatcaagttttttcatggtttggagaatggtttttactgacgtggcaggtgggatccatatgtagggactcctcttccccctctctctttcttcctctctcttctcgttttaatctctctcaatgacgttatgtctgagcacgaagactcaccaccatgagtcggcgtccgtggctcggcggtggtggcaatagcctaccgtagcgtcgaccacgcgtcgtcgtagcaggcggggacgaggtgctccggcacgaggcggttgtcgacagccgcaactcgctcatcatggaaaaccgctcgatcgagcgccgcgccattgcctcagcgtctttgtctccactgtcaagacgacggccaccgtgaaggaagcctcgtgcccaccgctagctgccgcacaagtggagaaggcgtgaccatgaaggagctggtgaggagatctacggtgggcggtatagatggccaaatgggccgcccagtccggcatgacccaggcatggtcgggcctaggccgagttcagttggaccggcacgactcgacctacacggcctggccatgccattccagcccacgggctacatacacggcccaggcacgacccaataagactcaggccatgccagcccgtcccgaagacacgatagcccatcgtgcttctccatacaataagtctatttgtcctccctcaactcttatggcgatctatagtggacggtgaccacgacggcactaacgatgggaggacacttgggccagaatggctgtacgttgcgcgaacattcctgcaacgaccattctgcaggatgcatgccatgacgtacggtaactgatccgttgctccaattaggtacgatgagccccctacctgacatccctgcaactaactggacggtgccacgacaacgtcgtggtcgctagccagctcgaagcacgtcgacttcgccttctgcgacataataattccgtggagcttcgtcaaccgctaccgccgccgcctgctctatgttcgacgtggtctccgccgcgatatggcagtgttgcacccgagctagccatccacggccacggcggaggtgtcaccgccgctcccgcgcccccgttcgtgttcacggccaacgtgcggaaccatgtcggagctaaggacgggtactatggcaaccgcatcacgcggcaggtggtggcctccacggccggcacgcggtggcgagcggcgacatcgtcgacgacctggctaggctcatcaacgacgatgccaaggagcggatgccggggctcctcccgaacaagcagcagcatctgatgttgctggcgcgcgctgtacgtgtcgagctagggaggcatcgtgctgtgtgccgtgcctgccatgctcgagaatggacagtgtgaacgcggtcgcgtggtgcgtcacggatgaacaccacgatggtgttccgctccgaactggacatactccagtgatatggagtactccctccgtccaaaaaaatgttcaacgtttcaccgtctgtcttatttaaaaaaattataaaaaaattaaaaaaataagtcacgcataaagtattaatcatattttatcatctaataacaatgaaaatattaattataaaaaaatttcatataagacggacactcaaacgtttgttttttttaggacgaagggagtactcttgaagatgtactcaataataaatacgggccgaattgtttccggaccaatactaggtcccccatctagccctaacatgtagggcccacgtagatcccacttgtcacatcagttaaaactggactcgagacatcgataatcaccgcttttacaagttgaacataagggacctaaagtgaacttgcatatttctcgggccgaaattatacagcccgattagggcccattaatacagccccaattcagtctctgggaaggccatcccaattcccaaaccctagccgccggcggccgcaccacacatccccgacccaccgccgttgccgcagccgcagctcgatcgcgagcgagaggggctagcggaaaccccagcagcgtgagggctaagcttcgcggcggattggagatgacgcagaagcagagccagttcaaggggcaggggaagaagaagaccatccctcccaaccgccatggcaaggcgccccacgtccgcaaaggtacccccgccgcaaagatctaccggcgcctccgtccgtccttccgtgccgttctctggtgctcttcgatgcttccctgtcgccctgcgtgttttgattggtcgctcgattcttgcagggaagagggccgtgaagccgaccaagttcaccaaggacatggacgccgataaggtagactcggtttactgaatgcttgctctattcatcaatcagcacctgctttctccctttcggacataagatgttatttggggcagcatttggagattgggggtctagccttctctgagctctgaagtaggcaagaaacaaacatgaattaaactagtgatacatgcaaaccaaatatgttctgtttttgagtgatataagatggaaagttgtgtgttcgttaatgtgctccaaaataacatagcaatattcttttactactccaaaagagagttacatgcctattgattacggattctctactagtaccaataagatcaaagttaatgattttgtcggaactaatatccagtgatagttcttttcaacataggttacatatgtagtaatatgtttcttcataagttgaggagccatggaaataataattgagaggtgtatggacatatggttagtatggttagaggggtaaaggtaaaggctaaattgctttgattagcagctgggatttgtcttttagcgcctgatttgtgttgcatttcaatatgggtgcccatattaggctaatacatgtaaatctcatgtggttgacttcaacattgttctggtgaggcccttttagggtaactgggtgctgaggtcatgctccatgattcatggcctatggctgggaactgtacaaaatgcaaaaactgatgttaatattaccgtataaatatatgaatttatgataagtttgactccagaggcaattgcagagagagtccgacagcattgctgattttttggctggctgttgctgaatatgtccgctaatgccattactgtcgttccatttacagtggttgatctgtttgtattggttgtttgggtgcttgccaatcatctaccgtatgttaaacctagggatggatttaaaatctatttttactggttgacagacacagcatcagtattcagtagtcctatagatatgccaagctgtagtttaatccatggtttttctgccagtacttgcaatgataggtctgtttagtatgatattaacagttttctatggctcggtaatatggtaactaaactggcatagctgtagcctgtagtcaacatgttatggccattgataagttacatcatacttgggactacgatacattctttgtagactatagttttctagctcggtatgtttttgtaatattccgaattgtgaggaatgctgcctcagttttctattccactttcttgttataacaagattggtaactcaattgcatgaccgtgtagttgttgttgatgttctacggtttgatctgaaaaaccagttttacattgcttcttgttgtattttgatttacaggataagttgtgtttgtgaactatgtagatgtttgggaaatatttggcaatgttttaccttgacttgcggtgtggtttttgcacgggcaatcgtgtccgaagttatcgaggatcaaattttattagactattttggtgttgcagatttcagtaggtttggcattctctatgatactaataaacgaccacttttggcgccatgtctgtttgtcaaatggtgacattagagtttggaataattgaaagcagactagaccttctgatcttattgttattaactttgtgattacgtttttttcttatttgagatatttaagatatttagtaaccagtgaactcatttgatgttctcttcttcccaggaactcacaaaattcatcaaccagtgcaacgagaagaaggctgcaagtcttgccagcaaagaaggcggcgacctcagtatactcaaggcggacgttgatccctccaattcaaactaggaatctgtggctacctctgcctacggctatgtgctatagaagatgagtgtgtggaatggatattatgttacattgcatacttgcattctagtatttccctgcagaaatgtagtaattctgtatttctctgaagaaggttatgcttactgctaaatgtttacaatcaatcaacggttaatactgtaaagttctcttctcatacatacaaataattaaggcgaaagcaatagacccatgcgacgtacgcgaggcacacgcacgggtttcgccacgcgccgtacaactccgaagatgcaagtagtgaagatgcatcctgtgagcaatggtcaggcttgtagagttgcatatccatttggggcttttgggatgcgtgtgtgcgagagagataatagcatatgtttattgagaagtaagagatggtcgaacatgtgaatggacgtgctccagacccacgatttaagtcaaagggcttaaattctttctgttgtgtgctacagtaagattatgtaatcatatggttagcaaaaaaatgtcaaccatcaccgtaggatcaaacatgcagtataaggatcgtacgggtcattttgctagtacgtactccctccgtttcaaattgtaagactttctagtattgctcatatatttagaagttaatgaatctagatacatatatatgcctagattcattaatatctatataaatatgggcaatgctagaaagtcttacattgtaaaacagagaaagtacgtacaaatgaaatggagaagcggaagcaacaaaccctcgaagtatgcgagccacacgcacaggttccgccacgcgttgtacacttgtacgaatccgacacgagcatgtccctgaggagggtgagcccaagcacaaccgtctccttggacgagcgcgtgcctcaccaacctcttcctccgcaggcgctgatccgtcgttgatgtaccgccgggagcttccagccctagcccggaccgttgcccctcgaacattgcctgcaaagagagccgaaagaaagaattgacacaatccgattttagaaacatgcaaaacgagagattttgcaatgcaaagtgaataaaacaggcaaaataaagaggcaataccagtagcaggcgctgatgaagctggagggagcaatggtgttggtgcacggggcaatagagccataggtggcaccgggagccacacgctggtggaagtgccaccacgaggtcctggagggggaggagatcaccgccagggaggaagaaatcagcggaagggtgtaggatgttggtgaataatgtcacgagaacggctgcggtgaaagccacgccgctagccacaccaaggaactagcatgctggcggaggcgcttcatagttggggtcgagggggagggcgaggtcatcgtcgtcgtcctcctccttgtcctgctcgtggtcatcgtcagcgacggccgggatatgctctgcgccggcgacctcgagttgctcctccgagggatcctctgacgacatagagctatagtaaagtgcattgggacctactgtgctccttgttgacgacggttaaataccaaatttaagccttcgatacctgcataaatttaaaaatataaaacatccaacatagtggtagggtttatttctaacaattttcataagtgttggtgtatatttgaatgaaggtgataaactaccaaagtgaaaagaaatatacataaggaagagagaattacgttcatatccaagactatggagtctcgggcccacaaactcatcgaaataccagaaaataggcccaaccatcataccaatgggctaaggactcctttgccaaggcccaggagaaaggcctaggccagggaggccaaccagggttcggccgaaccccaacccagctagcccagaaacttcacaagctagtagttatcacccaaggcagttgtgactgtttctacctgaagaaaccatcaaatgacacttggcacaaggaggtgaagcaagaaggaatatgctcattggatgcttgagcatctccacatttccaaggcacttcttggcctataaatacctctctcctccttcattcacaacacaccaagcataagctgaattataagaggctctattgtatcttttactccctccatcccaaaatataaggctcaaccactcataacacaaagaccaagaaaatatttaatcatattcttggtttggatcacctcgatgcatgaaagcaaggtgattgagaggtttgatggtataggatttaaaacaaatcaattctattgaaccaagaggtgctagttaatctatgcatgcatgcacatcttatattatgagacatggaagaaaagtggttgtgtcttatattttgggatggagggcgtatgtacattagaatatggagagggtaagggagaaagagttggaggaattagaatagggagagagtaagagataaagagtcggatgaattttggagttttctatattttccttttatcttttgtatcttgtcaactaatctgctttaatagataatatctttatcgagtaattgagatttactttgtaaggattatcttttagttcagctgcgcaggaatatgttccttttacctttttttatcttgtcaattaatctgctttaatagataatatctttatcgagtaattgagatttactttgtaaggattatcttttagttccactgcgcaggaagatgtgccccagcccgaaccgctgcccctcaaattcttcctgccccagcccaaaccgctgcccctaaaattcgagatttattaaggctaatctatttgttccactgcggaggaagacgtaccgccaccgccaccgcgaggaagtccggttgatgtgccgcgcgagcctccagccccagcccgaaccgctgtccctcagatagcttggttactgctgtaatgtgaattgctttctccaggatgtgagattgtcaattgctttgtgtgtgtgtgtatatatatatatatatatatatatatatataatgtcatttttctcttttttttagctaatttcatttaaacaaacagtcagttttgaatgtgtgtattttatctctaagcacttcttggttatccctgaatgtgaattgctttcttcagaatgtgagcgaaaattcttaggatcggtcaatcgggggagggggaaaatcggtcgctccccctccccacgcgcgcacccccgctgggcccaccaatctgtccctccccttattccataaaaaatgtttcacctagtgtatctacaatgtttcactatatatagagatctaatgttacagtggattaaaatattcttttgcaacaaatcaccaacatattttgtaaaccctctatgtcaccaacatattttggaaaccctctatgaaaggaatttatttcattttttgttccaccaaaaatgtttcacctagtgtacttataatgtttcactatgtatggattaaatgttgcagtgaattgaaacattctctcgctatttgctgaaacattgtttttatataaggtgaaacatcgtccgatttaaacgattgaaatattgttgatttacttagtaaaacaatttcgatatacttggtagaatatcgtgcaacatttaaaaataattcaataataagctaaaaaaattcgtcggaatatatccatatgtgtcttgttttaaagatttaattgcaacgaatttaatggtgcaatcgaatcatgatttggataagtaatttaagagaaaaaaaatagtttaaagtggttttacacatatgcgtgacgctgacatcatgctgacgtcagcaccgatttgaccccctcccgggcacccaactgggagtcgcgtccggacttgtgaattgcttgtgagaatgtatacatgtcattttctctttttttagccaatttcatttaaacaaataaacagttttgaatgtggtgtgcattttatctctaagcacttcggtccccccggtacaattggttaattctcagttcttgaaagccatagctataaactagtatcaagaactctcatccattttcgaagattcctcgacgcccttgaaagtaacacgcagcttcctcagagaggatactttcttcccgttgttttctgccattccagttacatgcacagtcgtgcgtgcagctcctttgagtagctcaaacattgggacacccaggtttggtcgcgtcatctgctctaggacttcaggtgcctgcatgtagaggttatcgccttcgtgtgttacgctagccctcgacattagcagcttggggtgctcttcaagcatcttgatgaactgtttatcaggggaagtgttagaaatctacaagatacttaggattatacacgaaatgtaacaggtatgcagaatatgggcaaaaaaaaatgtttgtctttgcttgtccaaaacaggaaaaggaattcaacagtttagaaaagcacgatgtgaatgcaagcatagcatgctgtttaaactttgtaaacaacaactttagatgacaatggtttggagtctccatataagtgattgccatatgatggctgtattaatgcatatgtagacaggtcacaggtgagctagataatgattactataacagctctacctcagaggttcagactgccattaacagctgaagtacgtcacatactagtgtgattatgtggctaagctagcaaagtgagtctagcaaggaaacgtgttcatgacatcagaaattctcaacatagttacaaggtattgagtgtattactgacctctgagagggtagtcgatgtcccaagttcaataagggtaccaggtccacatacaaggcagtctttctctcttgcaaattcgcttacattaatgtgtgttccatcaaggccgttatacctgcagatagtcaaagaaaaataatgcacttcaaacagaaccatgttaagtgtttctaacctggtcaagaaatcaatcgcttcagatgtgcttgttaattatagttaaacaatcttggggataaataaatattccaagtcgaaaccaaaatttaaaataagactcagaaaagtagtgaactcacgtgagataattcgacacagttttgctgcacccagagataagcttaagagcttccaacgcacatgcagcagaaacaattgcatttgttgaagcaatggctgggatgatattcttgacaacaccctgtaattcatgaaaatacacagtggtacatatgtcacatcccatcaaattaacaaccatgactttccaataattacacggcatatcaactaatggtaagatgatcttagtcatccactcaaatcaagaagcagaaatggctggcataaatttcgatgaaaactgacaaaatggaccacaaccaaaattaataccccatttagcacaaggaccaaatattgaacatgcttttatttatttgtagtaagatcgaatcaccatgagagtcaacttgttgtgcagagagaatgctattcacatactgttgagtctaacattttctttaaccaatgttggatcgtttatcatctcagtcaatcttaaagaatttcccaaaaaaaaggttgaagttggtgtgattataggactcatgcattattaccagagtacaagattcgcattaaatcactagcagagaaggcacaagattagagagacacctgggtaaacgaatatgtaactccagaaataccaaaaagttctgctctctttaaagcctgtattacaatgaggaaaaagattagagagaaaccagagataaaataaattccatgtcatgaagtaaagcaaacctctgagtaaatccactgcatatgttctgcatcatcagcatcaaaaggtttcccaggatgaacctacaagagtgactttaattattgggggggggggggggggggggaggagttcaaagagcaattatacagaaactagaacagtacctcattccatttgatcaaatgagcatattcaatgcaatgagctgcagttctcggagtctcagcaagtgtacataagggaaatttgacctggggagggaaaagccatatgttgcattcaaaacaaggtgttgtcccaggtatgatgactctagcatgacctttgaaaccttcagtcccaccatcgaccataggtttaagcgtctcagggattggcttgtcatctgagtcatactctgcaattgcaattacatattagcactatagcactgcactgaatatactgagtttggtacagtacatagtgaataacaatatacctctgtttgggcatcaccattgtctcctagatgcaattcagatcactaatttattttggaaaacccattaatctcttaaagtatactattgtgaaaatattttttgatacaaatctacatgtatgattttcatatgttcaatctaaatacttgagacaatattgatacccaaagttctaaaaactttactacatgcatgtccaaaacgaaatgtatttgagaccgaagggagtagtaagctatggacaattgagaatcagaaatataagcaaacttcatagacaatgatgagtaaaaattatctgcgcactaatttggatttatataaccatgacttttgtctgcacagtatcatatttacaaggttactccaattcgtcacgaatggtttttcatcggttttaatcctgaagctatctgtggcatgtgtgtaggttatcacatcactttataatttaatgtcaaaagttttatactgaaagaggagagatgaagatgttgtagaactcaagacgtatgctagattaaatgtctgtttccaattcccatgcaggagaaaagataaagaaagaacggctaaggaaatatgtacctaagaaaccacacgccacggaattgatatagcttcgagcttcaattgaatctagaccaagaacaattatcgagaattgactgtagaactctatctctttatcttcaatcctacagaaatgtggaacaatgttcactccactaactcgctccataaccctctttgcagcaacttcagccttggacttcccaacatcttgaaccctgtaagagagtacatgtagcacttatcgagatgaataagataataataaaaaacacaaatacaaacatgaaacgtcaaaacagacaaacaaacgtgaatgctgcaccacactgaaacttgaacttggctatgagagaagccaaaacatgggactttttttttttgctttccattcaggtattggctttgaaaactcgaaataggctttctgtagttatctaccattaccgtcccttttattaggaaatatgcgtgcgggttgtcaccatcgcttaacttaactttatctaaggcttattctactccgtgaactcagagctggtaagcaactgaattaacaaagggaaaaccacctcaattgcattcaactgaacaaataggcataacactcttaatcctattcgcccattctccgtggatattatgcactcccagtgaatgtaaatgaatcttttcagtcgacgctcataggtgcccggctcttggcatttgaacacggcatcgaaacctgacaatctatccctatgttttccctcacggcgcaacaatctgatggcatcgcacacagtgggggggagggggggcacaattaggtgggcgtgtggaaggaaggagagtaaaaaaaacctgaagaggaactggcggttgaggttggagacgtcgatggtgtccatgtcgatgacgtggatgttcttgaatccggagagcgccaggtccttgaggagctcgcaccccagcccgcccgcgcccaccaccagcacctccacgaggctccccagcgagtcccgcagctgcgacgcacagggcacaacgatcttcatctcaggacaaacgcaagaaacacacacagacaaagagagagaggtggctgaccccggggctggggttgaagtcggcgtggacgaggttgccggggcgggagaggagcatgtccagatccctccaccgctcgggctccgtcggcgggtcctcgtcgggggaggacatctcgccggccctgcttggacggtgggaggggaagaatcgctggtagaagagaccctagtagaaagagagattgctgatgcggcggaggagaagaggagggggaggagaggaagggagaaaagaaaacccaggggctttggcgtggacggctaggatgcgtggtgcgtccgatcggacggcagcaaccgaggtttccactttccaggctgatcgagttggcatcttatcacgcgtacaagggactcagttgcgcctttggggcaatagagcgcatttttagatttttaacacggagtctgagatactattttgatcaacgatatttataaaagtaaaatgttttaaataaaaaaaattatatattatgatagtttgtttaataataaatctagtaacatcaattttacattattaatcttttttttattttttttacaattaatagtcaaagtatagcatatgatagagttaatttaactttttaaaatttgctattataatttgtttatttggatcaacactattataattcgcgtatgatttgaaacatatcataaacctatgtatttttacttgtattggatataaatatccacatcttccttcaacatcctccttgtatcctttttaagttggagaccaggcaacgccacggcgtctagcggcacgacttgcttgacgcacaccaacctgagaaggattgcacgtcacattgacttagagaccatcctctggtgatagatgaagaagaaagaaaagactcaatctaacaaaatgtgtccggtagggatgaacatgatgatagcttatttgatttcagagccggctctgggctccggcaagaagtgcgatggcctagggcccaggaaaagtagaggcccagaccttggtatgtattagttataccatatggacgtatacaagtttctgattgaatcgctgcccgcataagcgccacttatacgcgaccgtccgagttccaaacttctgttttctcgtctcctctcctctaccggtggcagtctccgccaatccgcctccagcgccctctacggcgcctccgcaagtccgccgcacgccgggccgccgccgatccctgcagcattcagcccttcacagctttgtctgttcgccatcgaccggccgacacaacatgaatatctgcctcaacttccagagtgtctgcgggtttcaatttatatgtactatcgtgctgccgtgctgcaaccatattgtccattgaattgaactactgaagtaactaattagtcattagtaaatactaaagatcagtttcctctgtacgtttaggtttgcaatgttacaagaaagattaaatggcttggctatgtgcatgcattgagaagaatgtcttggacaatattgatatcgataccgtattaatgattttgcatcaagaaatacccgaacgagtattttttttaagagatgcaaatggatgtatgtcatcttttcttttgtcaagtattattaatgaagtccctggagcttgatccttagtcaagaatccttagtcaataatttaaggtaaccatagtaattctattttactgctctttttgtatttttagcaacatatatagaggatattatcaatatttattttcagcatgattagcggatgaatgctttaaaagtatactttaaaaatccaaagtgcatatgtgtatatatagagagagcgtatgcctaagggcccatgtcatggagttgatctagggccctaaaaaatgtagagccggccctgtttgatttatgcaagcttcgaatgggggggagacgccacgcgtatgctcagcgattctgacttaggaccatctaggcattaaaataactccataacaatgtcaaaagacgccatcattgttattgccatcggctgctatggtggttgttgcatgatgttgagttgttcgcggatgggaatctatccttgctctgaccccatccgatggtgatggaaacggagtagaaagaaagcaggttgccttcatcacttccttccctctaggatcgattagatgtagcaaagcatgtacgatggacaactaatgaaaaatattcattttcactccgtcttgcatgtcttggtcttgtggcgtttattgttgccgtctgagcgaacatatcatttctctcaacgatgtgttcttctcccgtttctgactgcttatccttaatattacattgtgtacaaagcaaaaaaaatataataagaaaatagatcatgcgtagagcaaaaggagttgatcaaatacaataaccagagtatacatcacctttcgtgtggattaactcccaattaagatggtttgtctattgtattcttccatggaagaatgcagtatcagtagtaggtctgaaagcttattgggataaattagctaaagagagggtgtagtgtgtatggcgacgtccttttatagaaaatgagggtgcacacaacatagcattaggtgacaagtgccccaatagagctcatcaacggaattgctgctacgcctcaccgaggcaatgctcggtaagtcccaagctccctagagcccatccatttcgtcgtgctaaagtcaacctaaatagagccccacctctaccggtgctccacctcgctagcccccaacctccattggcacttcccttagctgcgccgctccaaagtgttagcccatcgtgccgagctatccttccacatacagtgctggagaatatgaacaggaaaaatcgagaaatagaagggaaagaagaaagaaaataaatgcaattatatataaaaaaagcaaacaaaatggctaagcaataacatatatctcataaccgtgaaattataacggatgtgttcaaatttattttaagatcggaaaaaaattagtggcatatggatcggattatttttttttcttacagaactgacatgtgacgattgaccaacactggcacagggacggtccagatgaacccacgtcctagccgtcaacggcgtaggcctcttcgttccgcctccgcttatccgctctcggaggccgcatccactcacccagcttcgctcgctcgctcgctctgccccccggactgcctcagccatggaggcggccgccgccttctcccctccccgcgtctcccccgacgcccgcgccatgttggctaccttcacagcgtggccctccccccacttccgcctgaccgcccgcccccgcgctctttcagcttcggcccccaccacggcggcggtggcggccaccaagcagcggttcttggcgccgccccgcccggaccccgcggcgccaggaggctgcggcggcggcggcgccagggacgtcgtcgcgatggtacgggctttgcctttcacctgctacacactacctggctgcgtggactgaaatggcgtctcatttggttgggatgcttgtgcgttgcaggtggtgccgttcctgagggggaccgcgtggcagcagccgccgccggacctggcctcgttcctgtacaagaacaggatcgtctacctcgggatgtgcctcgtgccgtcggtgacggagctcatgctcgccgagttcctctacctccagtacgacgacgccgagaagcccatctacctctacatcaactccaccggcacaaccaaggtttgctgcatttgattcaattttggttatacgatttccactaggcttggttgattagtgaacgggcacgcgcgtctcaatctagggtagcttgtggatcatgaaggtctctgccccccacaattttcaatgatctgttcagattcttttactttgccaaatgattcagataatgtgcagtttatacatctttgaagtgattagcaagtgaggcaggaactcaaaagtttttattgggctagaaaatgcaattccggtttatgcctatcaccttttccagtagcacatcatcttaacagtctacaatgttttcttcaatcagaattattgttgttctgttttcagcataaaattttctgatatatttctctcccttcttacttagaatggcgagaaattgggctatgagacagaagcttttgcaatatatgatgctatgaggtgatttcctacacatgcaccactttctctcaaagctattgatcttcctgcttcctctccaaatgattttcctcttgtttcttgatgctgttctctaatgtcaactttcatactagtagttccttatgagcagctcttttactgtataggaagttcgaatcaaattggtctataaccttagccagatggagaaattcagtggactgcactatatggtggaaagcacgatccaagatataaagacacacaggatatacctcacatggaactcaaagacacataaatatgtctcatatgattctccctcataaaattctagttctatccgtgttatcagaagggtggatctatgtctagtgtaacagtgtgcactgtaccagaggctatatttttggtggcctgagtcagacaactctttagggaaacaaccaaatacagctgtgtattgctcaggctcactgcaggccaggccaatctccaccagtgtagcaaccaaacacaccctatgtgacccagaatagaggaatcagctccctgctgctcagcgcaagaccgcagtaatctctccccaacatgagccacagccaccagcccaccagttagctatttccatctgaccgccatcttttgtatttaccatttgaaatactggtgatcaaatactacaatacttgaccaactactataataccttattcccaatttgtgttgacatatagtgattatatcctactaccagcttcaaatactgtaaatttatacaagcagtagactcaaggtttcatttaccaggaattttttttcgtgctacacataatttagttgcagaatagaataaaatctgtttagcttatggtctccaactctccattagttctttccattcaccttttaacttctactagttgtacttgggttactagtctttggaagattgtagtggttatagccgttgccaatacatgctgttattgtcatccaaaaattcattcttcaatgtctgtacttgttgttttacgaaatatgctcatgcaacctagcgattgtagtaaaatttctggaattctgtctcatgttttcactaaatacaggtatgtcaaagttccaattttcaccttgtgtgttggcaatgcatggggagaagctgctttactcttggctgctggtgctaaaggtaaccgtgctgcgcttccatcgtcgacgataatgataaagcaggtcattttcttttccatcaattaatagagagcagtttagtttctaccttggacaagtctatgtctatcacacaccactaataagacactgtagcagaatgtgtcacattcttgctcttcgattgtggtgcacacttggatatacttattttgtgaacatgcaattctgtacagtatcagtagtctttgcttccaagaaatacgaggataatgatcttattcttctgacctttaatgtgcagccaattggtcgctttcaaggacaggcgacagatgttgacatagcaagaaaagaaatccgaaatgtgaaaatagaaatggtattttttccaaggatagcctatcctattttttcctatccattctggaagaaagaactgataatttcagcttaatttcaaactaaatcaatatttaacatgttcatgtcttatcagtcataacaatttcgctagttcataactggtgcttttcaatcgaacattgccgcaagacaagaacgttagagttcttaacttacctgaattatcaggtaaacaaaattatacattgaatagctaaatgcatgtgctgtgctacacctaggcataaaagaaaatatgtcataataattcctaaaataaataaaatatgtttttgcatgaaatatgttatccgcttgtttgttactacctctgtcccaaaaatataagggattttgctcatgtaactcacgggccaaatcccttatattttggtaggataagggaatgctgaccttgatcatatatatgccaagtacttgcaacctatttattttggttctgtaattctaaaaaagtatcaggacggtaatttatgagaactgcagcgggaagaagtgaggtggcagtttcgctgtcaccaccaccaatgcagtcttttaagaggaagtatagattatctgttatccatattaacaatactacctaggcacatttataatcttaccagaagtgagcaatagaaaatttggcctcctgtcttagggagtgaatggcaactgaacaatagtttctgtcttcatataatcactgccaggatcccgatgtcctgaaaattaggtggatacagtgatttgaaagtgaagctctttgttatattttggggcagcatttgcgtgccttggaaatgataaaagacaatatacttattttagttatttgcagcaacccaccttaagaatggctacacacaatttatctgaagccagatcttatagggatacaaacttcttgttggaacttggaactgatgttggtgaaaatttagttgcattgcattagatttgatacgaactaggtttcccttgcgttattttcagccatgctacattcatattttgcactagctacccatgaactgaaggggcaggcagtctatttcagtaggctgtttacaattcaacctataatgtactgtatgaattcacttttatgtcagattaagctgctgtcaaggcatatcggtaaatcagtagaagagattgctcaggacatcaaacggcccaaatatttcagtccaagtgaagctgtggattatgggatcattgacaaggtaaaatttctagaatgatcgcaaaaaaaaaaaaaaaaacctgaaatgccgagcctaatttgacggtgttcttccacacacaggtgctgtacaatgagaaaagccaagaagacggtggtgtcgtatcggagctcaaaagatcaaatttgatatagtattacgctagatacaatctccctgtaagttggtaataggtcagacacacgacatgctttgtagtgccatggagtagctgccattcattagctggcctggttgtagaacatcgagctggattggcaatgcaaatatgcagtacacgctgatacttttttttttttttgatatgggctttttccaatctggtgcctgataacttgtacggtggcttggtgcgaaacttctattttttgtttagttttctgaatggcgattcaaatggttgctctggttgtttgcaatggtattgcttgaattgtgagcgccagtgactgtaagagctgattttggcctgttgagtgccaatattttgtatctggtctaaaaaatcgcgcaacactgacttcatctatcagggtttagaaattttgtgccgcactagtggatatgttttcggtaggaattttactagattcatgaatttaattctatttcagttgtgtttgtgcgtgtctgtactttatgtttattttcttttgagaaagtgcgtgtctttacgtaattagggaaatgttgtgctcgtctgaaataggtgtgagtgtatgttggtgtacgcgcatctgctttactaatgtttttttttaaaaaaaatgcaaatatgcagtgtaaatcataaatatagtgaaaacctgaaaaactaacatttgataaaaaaaaaggacatctaatatttgttcatttcactgagagaaacttttactaagtaataaaattttgctcaggataagttcatttttttaatctaatagtagtttttatagtatttttaggttttcagtatacatatatggttcggaaagaatataatcggagaaaaaggaaattgatgacggaaaaaaagcggggaaaacaggagatgccaggttcccttggaacggaaaatgttggaaaccatttgatctaccactggctcgcagaattagaccatcttttgcgattcgcacggcagcggccaagtttatattaacccctcccttggttgggccttcccttctcttccttcgctagaagccgcgctctgctcttccctccccctcccccgagaggccgagagacccgcctgcctgcctccccctcgccggcggcgcgcccgccccgtcgccctcgcccgccgcgccggcatccactgtgagtcgctttgttgatctcagccttgagcccttgacccttctttaccgtgggaacaaccgacttacaagctgcggggcgccccccctagttaagcgaggtttcggccttcgcgcgattttggccggcggcgcggggtataggggacccggacccgatgcgatgcgatgaggtgctgcggccctcggggattacgtgctgctagttagtagtagcttccttccaattccatcgaggcttttgggggcagtgagcattctgttggccagttcgttttgctcaccgtctgatgcttcaaatcaagttttgagtaatcgacttgtttgggtagtatcctggaattttatttttggttttagggaacatgtaaattctactgctcatgtggtactcttttgaggttgctatcataaccccaatctttagaggttgctgtcataacccccagctgactgcattcttatcagatgttcagtttgttgaaaatgacgtaattttgaaaggatgtttatttattttgatttttgagttagaaggctggaattttatatctt

SEQ ID NO: 42844 - DNA, 21666 bp, Oryza sativa
  unsure (1)..(21666): unsure at all n locations
accagtttctatggtcaggatgctattcaggcagcatatgtatgttctggttgactatttgctatcgctggtgctactcagtgaatttattgattgtctgagtattcatagttcctgttattatgcatgtttaggttgatcaatggctcgactacgccccagtcattctttcaggatctgaatttgaagctgcttgctcatttctagatggatacctagcatcacgaacctttttggttagttatggcttgtcaattgctgacattgtagtatggtcaaatcttgcaggtaattgtctggtttcttttataatctatattttatcattctatatgtttatattacttactttggagtggcacccctttatttagggacaggccaacgatgggaaagtctaaggaggtccaagaaatatcaaaaccttgttcgctggttcaacagcatagcagactattcagacacactagatgaagttgtctctgcttatgttggaaaaagggggataggaaagtctcctgcaccaagcctgaaagagaaattacctgattcaaagcagaatatctcaatccctgaagtagatctcccaggtgcaaaagttggggaggtctgcgttcgctttgcccccgagcctagtgggtatcttcacattggtcatgcaaaggctggacttttgaacaagtactttgctgagagatataaagggcgcctgatagttcgatttgatgacacaaacccttcgaaagaaagcaatgaatttgttgagaacgtcctgaaggatgtagaaacactgggaataaaatatgatatagttacttacacatcagattattttccgcagttaatggaaatggctgaaaatttgattaagcaagggaaggcttatgttgatgatacaccaaaggagcaaatgaggagtgagagaatggatggtgtggaatctaaatgtagaaataatactgttcaggataatttgtcattgtggaaagagatgatcaatggaactgaaaggggtatgcagtgttgtgtacggggtaaacttgacatgcaggaccctaacaaatcacttcgagatcctgtatactaccgttgcaacactgatccccatcatcgtattggctcaaaatacaaggtctatccaacttatgactttgcttgtccatttgtcgacgcattggaaggagtgactcatgctctccgctcaagtgaataccatgatcggaatgcacagtactatcgtatccttcaagaaatggggttaaggagggtagaaatctatgagttcagcaggttgaatatggtttacacggttcttagcaaacgcaagcttctctggtttgtacaaaacaaaaaggtggaggactggactgatccacgcttccccactgtacaaggcatagtacgtcgtggcttgaaggttgaagctttggtacaatttatacttgagcaggtaatgttctaatgagttaccgtttgtgatttcatagctatatttaatggtgtcttcgtaattcatttgttctttgaccttttatttctcaagggtgcctctaaaaatctaaatcttatggagtgggataaactctggacaatcaacaagaagataattgatccagtgtgtggaaggcatactgccgttctgaaagaccagcgtgtgcttttcactcttactaatggtccagaggaaccattcatccgagtcttacccaggcacaagaaatacgaaggtgctggaaagaaggctacaaccttcacaaacaaaatttggttggagagtgctgatgcatcagttattagcatcggtgagaaagttactctgatggactgggnaaatgctatcatcaaagaaatcaagacacagaatggatttatanctganctgcttggggaactccatcttgaggggtcagttaagatgacaaagttaaagctaacgtggctgccagatattgaagatcttgtatctctctcgttggtagagtttgactacctaatcaaaaagaaaaaggtaacacgttaaattgaagttcctttattaagtagtaggctagtatcgtacagatgcaataccacatgagaaacagagttcttatagtactgaacaattggtactctactgcttttgctataattttgtagtattaatacctaattaggccctctttgaatcaaaggaaaaaccataggaattttagaggattttatcatatggaaaataatcctatctagtccttttgaaacaaaggattgtttcctatcaattcctttgaaattcctatgaaatggaccttcctagagtaattttgaaggaaaataagcatgaggtttcacctcatgtttttctcttcatgtgtctaagtttcttgcgtttttcctgtatgctaatcaaacgatagttttgagactttcctatgtttcaaaatcccagaggaggcccttagtctgttaagtttgactatgttcaccttagacttcttcaatagatagtgtatgaaacccaatactagtgtatcacagtatcagaaaagctaggcttgtgaaggaatggtcaatatacttgttcttggagcacgatctagaagagatttagtttctttattaatttctttacatattggatgatgtctctgagttttcgcttccatgaatccatcgatgttttccttccatgattgagtagcatcatctgctagtattttaaatattgctgtggcatttttgcagctggaagaagatgataatttccttgacaatcttaatccatgcacttgccaagagtttccggctcttggagacgcaaacatgcggaatctcaaacaaggagaaatcatacagcttgaaaggaaagggtattacaggtgtgatgctccatttatccggtcttccaaaccaattgtccttttcgctattccagatggacgacaaaagtccgcaacgaagtaggaacctataagatggtttctggaacagcaaatacaagaatcatgttcctgataaaactggtgttgtaaacttgttgattggaattttaaacttaaataattttgttgctccttttattctgactatatgaaaattagctgatcgatcatatttctgtggttaaattatgctctatcatatttctatcatgagaattggctgatctatcatatgagaaggaatacatcgtacaaaatagtattcgtgaactgaagaattaccgagggtaaattcagcacaaactgtaatggcacaagcatcatcacatccaacgaatacgatatttttatcaaaaatgctcttttttcccccacaacggaggctccgtgtggcccttgctgttactgcttcaaagtttgacagcactacagcgtgaggcacatgaaagaagaaaaaattgaagtagtgcagcccatgaaacaggttcctcctgcggtcttcaggaacgcacacagattatgagaaaaaaaaaaggtccttcgatggtccaaatttttacttctttaggctgcgcccaagtcgttctatagcggcaccaacgccgctttgattaccttgttcctccaccaaatctgttggtttcgaacttgccatctcaagattggctttctctgccagcttcaactgtatccaacctgtaaaagaattccttaaggctgacttattgaacaaaaaatcaagctaccagcatcctagaatgtgtcagcacagcacggtcatcgtgtaagcataaagttgttggcttggcaattgatgacagtgtgctagtagtagctcttatatgcaaatgctaaatgcacttcttatatgcaaatggcttggcaaatgattcccaagtcccaaatcccaatcaaacctcattgagactgttcataagtttatagaaagatcgagcacccttgcgctgaagatgaacagggctaagcgatggtaatccatcagtaggcaatataagctgaagaactaccaatttggaaatgcatcctgcccaacatgaaatgcaactatgtccaagagtcctgcaattaaatgtactctcaaagttgttaaagcatagattgagttcacatgattcaatctagtactaccagggaacacactaaatatcagttattcagcttatcaggaccatattcaatcaagtgatgtgcatgttcgagtgaactaaaatgaccatttttcattggtgaatagaaagtagagtaataccaaggggaaagcagactccagcaccaagagctgatccaaccaatacattccttgcacgccacattggtgaacctggcactgaagatgaacgatcatcagttaagataaactaaggatgctgagggctaccttagttaatgaagttaaccaactatttgcacagcagaatcagaactaaaatacaaacaatatcataaaacaatgatttatctcatcatatcatgtggcaatgagatcacaattaaccctgacaggtagtaataatttctgagcacacagattgaaaaccaaagtcaaagataacaggatttattagatattcaaggaacctattttaagagcttcttacattaatctacatccttcaaggtacaggggaaaaaatcgagcacatcatggtgacagaaaaatccaagtagggctatatatcttagcaagtctattccaccaatcagattttcaggtatcatatggctaggacctagaagctcacagcggtagaaggcctataaaggaagcaaaccttatagaggaagacaagtaatataacctactaaccttcagaacctctggtagatgactacaacagacgactttccccaaaataatagtacttacgacacaagattgtctatactgaattacatacatattacgggtacatgataacctcgttttcttcaaaaatatgtcatttttctttcaaaacatgactggggctattcttattctattacaatcagtaattgaatatttgaatgcaattcaggcttcacagtatcacaaacatatttcataagctcacttcaaattatttgaggtgaccaaaatttccaccatctaaacaaaagtataaactggacatgaagagatacatacatataagtccaaatgcagctgcagtagccgagccagctccagctatattaaatacatcatgcaccccacgtttctcaataagaaggttctgtatgccaaagaaagttgcagtaaacatcccaaggcgaacaccaccaactagcgatcctttggcaacccggatgaatcttttctccattgcatctctcatcaatctatactgctcacgcttgtctgtggtgctccccatcttcaacatcacttcagcgtctttgctctgtaaaatacagcacaataatgttgtaactgaagacatttcattttatttggtgtaaggagttcaggaaaaaaggatataaatgttcacctcaaaatagggacatggttaattatcttaatcaaaattctagaatcccagttctaaaggagaccttaatggttagtacccacttggttatatagattggtagcttgtttcgataaaaaggaaatttctcaattctgctctagctctacaatttcaggtctaaatgatctgtgagctgtgatcaaaagaccaataaaatagttatcagtcgatgcaaccacatatcttccatctggtggccattcatttgttcaaattgtttttaatttcacgcaatttatcatacagagccaatgatagaaagcaggaggcggatagagtagagtagcaacttacgacagaggcgctggcctccttgctcccgccgtagagcagcccggcgaagacgccgacgagggtggcggtaccccagttcgccgtccccaacgcagaagttctcggtggcgtggcaccctcctccacctccccgtcctcctgcatcatcgcccacacccaaccacgtcagaactcgggcgccagacgaatacgcacgagggatcgatacagaccgtgggcgcggtcgaagccggtggattcgtcgccgccgccgccgccgccgccggcggcggcggcggctcggccggaggaggcgccgaggcggccatcgcgatctgctaccgctgccgcagggggaggattcgctcctaggatggtacaaaacagggtacttgtaggtcgctactagtaggcctcaggggcggcggggcggcgccggcggcgagatcacggccggtggaggcgaggcggagatgaggaaggggaatgggggagaaggaagcgaagtgtgcgtgttggggtttagccgagtgggctgggctttcgccattggtgatgggccctgatggtagagcccacggcccacatgttcgctcgatcgttccaccacccaaattcaaacgcgatgatttccccgaaattctaaatatgtttgaatttgaaggaaaatggtactacttcagatttcctgtgttgtgccattgttcttctccatgttgatttaagttttttaaagggtgaatagctaaagtgatcctccaagtttcacctaaggctcagtttagtccttgatgtttcaatctatccatattagtccttcaagtttttattttatttcaaacttatccttgaaccaacaactctcttcataaatgacacttataccccttatcattcacatatataagagaaaaattgcatgcttgaattttttatagataatacatagtatattatgtaaaaccaaaataaattatgtaccagcaagtgtatacgatagcaattgcttaagtttcatgtgcacatgttgaaacaatgggaagtacatatgtaatgttgtaatgttgtttattcatgttgactttctcttttctagtatatagttgtatacaaattaagggcaaaaaagatatttttttaatagaaatattgactagaaatagccatatggcatattaagagggtccaaggataatttcaagacaaaacaaatactccctccatcccaaaatatttgacgccgttgattttttaaaaaatatttgaccgttcatcttattcaaaaaattgaagtaattattaattcttttcctatcatttgatttattattaagtatacttttacgtctacatatagttttacacatttcacaaaagtttttgaataagacgaacggtcaaacatgtttaaaaaagtcaacggcgtcaaacatttagggaaggagggagtatttagaggagctatgtggacaaaattgttagggttacggataaggtataccctctaccctttgatgtatgctatatggaaatacggtatagcggtgcatatacggacgttctctgaacacgctaaggaaatccatcacgaagtccgccaatggaaagattcctacccgtataagactgtgtcgttattatatcgtgtagggtccgatgtctccaagtcctacttggagaccgcctgacctgcgatataaaagggacacccgagggacctaagggatcgaatctcataacctacacaacgaccacagcctacgaagctgaagactacaggagccaagtcgccgggtgatctagtcgaatcaactcgactacgatatcgtcggtaccaccgagttctattattccctttgtaatatgtggttatttccatataatcccatatcaacttgattagggctattacctgttaaggggcctgaaccagtataatctttgtctcttatttccttgatgtcatactacgtagatcctcgtaccagcgtacccaataccctctatatccggtctacgggtacccaccgtcgacagtggcacgccaggtaggagcacttggtgctcaaggttctactactatgacatcgagcttcgtcgacaacagagtcgacaccggccccatccaaggaatccctgcttcaacaatgctggtgtggactcaagtcggcgaaatcgtcttcctggtttacaccacggtgccaatctcggctagtccatcaataaccggaaacgagaacgccgtggttataaacccggacggtcccatgtcgaaggatcctcccaccgtggcggagaacggaacatcgacgtcatacgagctcgagaagattcctagtgcggccgagccttgtccttttgacaaggactgcgagccgaggaggacaacttccgaggtcaccaagtcctggtgtcatatccacaagtccaggaagcacaacttgcaagcttgctgggtttttctcaatgtacaagctgaaatccgtgcttgcaaagagcgtggaatccagcgtacttctccaactcgtgatgtctattgtcctattcacaagacgaagaatcacgacttctcaagctgcaaggtctttttccgcgccatgaagacgacacctcctaaggtccagcagtcaggaacctctctcgaggatacaaacaaggaacaaggagcgacgataacctcagatcgattcattggagtaatcgacatcaatccccgtgaaccatcagtcctacacttgctcgaagactatggctcgtcatcttccagtacaccacgtgacatgtttgccattggtgggactagcacgtctgcacaggctaacgcagaggcggagaatcagacggccacgccagcccaacatctcggcaccgtcaacgcaatactgagagaagctccctatgacctgtgcttaatgatgatctcgcacgatggacggaacgactatgggaatctgtagccaatctcagtaacgcgttcgagaaagctgctaccagagcacaaccggaacgaccgacagctggcggtgccgacagtgaaccaccggagcagcggacgtcgcccgcacgagctacccctccacctcgcggcaccggcgatctccgcgaccatctgaatggccgccgagaagcacgacgcgcgcgagacaacgagaatcgttcccgacatcgtgtttcttcacgacgtcacgagaacgaggagcgaggaggccgctcgaacgaggaccaacatcaccgtgatcgtcacaaccgccgcgatcgcgataaccgcaagcagcggacaccagacgatgacggtcgggggcgtcagcattaaggtgatgataatggtgaccggcgccaggacaacaatggtggacggcgacagaattcttgagaacctgaacgtcgccctcggaatcgcacgccagagccgagtgagccatcgtcatcatcatcatcatcataatctttgtcttcgtcatccgatagacgtccatggaggacacatgatcgccgacaacccactgcccccagcgctgggtgtagagctttcaaccgttctctacgtgatgtccgatggcccgagagattccgacccgaagcaatagagaagtacgatggaagtactgaccctgaaaaattcctccaggtctactccacggtactatacgctgctggggcagacgacaacgcattagcgcactatttgccaacaacgttgaaaggttctgcgcgttcatggctgatgcacctcccaccttactcgatctcttcatgggcagatttatggcaacaattcatcgcgaacttccagggaacttacaagcgccacgcgatcgaaaacgatttacacgcgttaacacagaatcagggtgaatctttgagggactatgtccggcgctttaatgagtgcagaaatacgatccccaatatcactgatgcctctgtgatccgcgctttcaaaaccggtgtcagagattgctatactacccaggatttggcaacaaggcgaatcactactactcgaaggttgttcgaggttgtcgatcgatgtgcccatgcagacgacgcgctgagacgcaaaaacgacaaaccaaaggtgggaggagagaagaagccagccaaggacgcacccgaatcaagcaagaagaaaagcgacaagagtgggaataggaaagctcaagcagaagtccttgcatctgaatacgagcgcccgcccaaacacccagacccacaaggcagtgatacaaagagaatatggtgccccatacacaagtcggacagacattctctggaggagtgcctcatcttcaaaaaatcgttggaaaggcagctggcattggagaaaggcaagcgagtacgtgtagtcgagaaggcaactgaggcaaccactcaggactcagactccgcgtacccagattccgatcttcatgtctcgcacatcttcggaggtcccacagcgtactcttcaaagcgagaatacaaaaaagtggagcgtgaggtttgttcgacatggcagggggctgcacccaaaatgaagtggtctgaacagaagatcgagttcttagatgaagactaccccaaggctgctgttataccaggacgatatccgatcgtggtcgaacccactattcggaatatcaaggtagcgcgagtcctcgtcgatggcggcagctccatcaatcttctcttcgctagcactttggacgcaatgggaatcccacgaagcgagttgacacctaccgatcaacacttccatggaatcacccctcaatcttcgtccaagccattgggcaagatcacacttccggtgactttcggccaagcgagcaacttccgaacggagcagataatatttgatgttgctgagatcgacacagcatacaacaccatcatcggaagaacggcactcgcgaagttcatggccgcatctcactacgcgtatcaggtgctcaagatgcccggcccgaagggaacaatcactatccaagggaacgcaaagctggcggtccaatgcaacaagcggagccttgacatggtcgagcacactcccagcccacccgccacagccgagccacccaagaaagtgatcaaaacgactaagacgccgaaaccagacggcgcaatcaaaatcgtcccactctgcagtgccaaccccgacaagacggtcaagattggggcatcactgaatgagaaataggaactcgcgctcatcaccttcctccgcgacaatgcggacgtattcgcttggtatccgtccgacatgccgggggtccccagggaggtgattgagcacaaactcatggtgcgacccgatgccaagccagtaaagcaaaaactgcggagatttgcaccagatcggaaacaggccatacgagaagagctcgatagacttcttaaggctggtttcatcagagaggtactccatccagagtggctagccaacccaatcatggtgcggaagtctaacgggaagtgaggaatgtgcgtcgacttcaccgacctaaacaagtagtgccccaaggatcacttctctctccctcgaatagaccaactagtggactcaacagctggttgcgagctgttaagcttccttgatgcttactccggctaccaccaaatcagcatggcaaaagaggacgaggagaagacatcattcatcacaccattcggtgtattctgttacgttaaaatgccgtttggactcataaccgcagggaacactttccagcatacggtccaaggggcacttagcgatcagctgggtaacaatgttgaggcctacgtcgacgacatcgttgtcaaaaccaagacaggcgacttgttgattgacgatctacgggaaactttcgacaacctcagacgatatcgcctcatgctcaaccctgagaagtgcacgttcggggtaccgtcgggcaaactgctcggattcctcgtttctggcagaggaatagaagcaaatcccgagaagatcaaggcaatcgagaacatgaagtcgcccacaagactcaaggaagtacagaagctaaccggatgcatggcggcgctaagtaggttcgtcgctaggatgggagaacgaggacaacccttcttcgcactgctaaaaaagcaagacaaatttgtatggacacaggaagccgaagaggcgttcatcgcactcaaacgctacttgtcaaatccccctgtacttgttgctccccaacctaatgaagagttgttcctctatattgccgccacgccctactctgtgagtactgtcattgttgtcgaaagggaaaaggtgcagagaccagtctattatgtcagtgaggccctacacgacgcaaagacaaggtacccacagatccaaaaactgctctacgcagtaatcatgatgtcaagaaagctacgccactacttacaagcccacagggtcacagttgtctccgccttcccccttggtgaagtcgtgagaaacaaagacgttgtcggccgcattgcgaaatgggtagtcgagctaagccagtttgacgtccactttgtaccacgaacaaccatcaagtcccaggttctcgccgatttcgtagccgattggactatgcctgaaaacaggttagacagccagaccgacaacgaaacatggacaatggcgttcgatggcgcgctcaacagccaaggagcaggtgcagggttcatcttgacatcaccttcgggagatcatttcaagcatgcaattcaccttaacttcagggtgaccaacaacacagccaagtacgaaggactactcgctgggatgagagctgcagctgcacttggagtcaagcgactgatcgtgaaaggggattccgaactagtcgcaaaccaggtgcacaaagattacaaatgctctagccctgagctgtccaagtatctcgcagaagtcaggaagctggaaaaaagatttgatgggatcgaggtccgacacgtatatcgcaaggacaacatcgaatcagacgatgtagcacggcgtgcgtccagacgagagccactcgaacccggcacctttctggacatcctgacaaaaccatcagtgaaagaggcaaacgacgaagatagcccagtcacccccgacataagctcgggggctacagaggcagagcgcgccgttgccgacatcgagaccatggatgactggcggaccccactcatcaaattcataagcagtgacgagttgcccgaggacgacgcagaagccgagaaaataactcgtcaagcaaaaatctactatatgatcggcaacgatctatacaagaaggcgccaaacgaggtacttcttaaatgtgtctcgtccgacgacgacaaacacctcctcctcgacatacacgaaggggtctgcgggtctgtcggtgacatgggatcaggagtatcatgactagaggtttgaggcagacacaaacgcccacgtggcctggcaccctcgggggacgtcgggcccgagggtgatgtgttcgccctcctcttagtccccccgagggggtcgggccgcacccgcctcggccccgagggccgaggcgccccgacccctcgtgggttttcgctcagcgtgtatgggttaggtaagcacagccgggctcacctaaccacatttattgcggtttgggtgagcgtgtcacgccgcatgtaacgcagtgcagtgcactcatttattcggtctgtgaccagtcacagaccggtcagatcgcgggttaggtggcgacaggcggtctgacgcacgcctcaccccatcccgtcaggacgagggcttctaggcgctcgtccccagctggagctagcgtgttacctcccagagatggcacgttagtcctgatcagatatatgccaggcttcatcctaaccattacaagcaagatgttgtgtgaagaagggcgaacatgtagattgctaagctgacatgtggtggacaagaatgaccgacgtgactggtctgactccggtcatgtcgtcagcaggcggccacgattccacgtcgcatctgctcccggtgaaagtggaggtagttgtgggccgtcccatcagaaggtgactcggacggcaacgatacaaatctccgtccatttatgaaaaggtgggggaagtccccacaaaaaagagggaaatggtgcatgtggtatccccttaagatataaaaggaggaccttgcccacttagatgagggagatttttttggacttttccagattgggaacctagaacgagggagaggctggctcatactttgtagctccttcatacacagatctcccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctctcgcactccttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggctgaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcctgtcgcccatgacccggagtctccagcccaacgttggctggacgatgtggccaaattggtcatgactgcaaggcagcgcctagatgctggtgggcggtcctccgccaccaaggcctctggtgctgctaccaccggctccgcgtcgtcgagacgaagggcgcggcgagcggcagctgccgttcgccattcggccaccactccttcgtcgactccttcgacccgggaagatctgcgtggggggccggacgcccgcactagcatcgagcggcggcgtaatggccgacgtgctacccacgcaacggagggcgcttcctcgtccagagtgtcacctcaacacggacgcaggaatcagccctccgtgcccccggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggctggctaatgaacttgccacccgcatctgtccactcttgggaggatttgtgccaacagttcaccatgaaatttcaaggcacatatccgcgcccaggtgaggaagcggacttgcacgcagtacagcgaagggatgatgagtcacttcgctcgtacattcagcggttctgtcaagtccgcaacaccataccatgcatccctacacacgcggtgatttacgcgttcagggggggtgtgcggcacaaccgcatgctcgaaaagatcgcctccaaagagccccagactaccgcggagctttttcagctcgcggaccgagtggctcgtatgaaaaggtgggggaagtccccacaaaaaagagggaaatggtgcatgtggtatccccttaagatataaaaggaggaccttgcccacttagatggaggattttttggacttttccagattgggaacctagaacgagggagaggctggctcatactttgtagctccttcatacacagatctcccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccggtgaggagccccacgctccgtcagggtcacatgcctccggtcgtacactagtcggaaaagcttttcgacaaggatttttctagcgaaccaccctcaaagacgcttgcgacatggtacaacggtgtgaagcttgtcaatttcatagcaaacacacaaagctaccagcgcaagcactacaaaccatccctctcacttggccgttctcgtgctgggggctcgacatactcggtccattcccacgaggataggacggctacaaattcctgttcgtggcgatcgacaaattcaccaaatggatcgaggcaacacaggcaacacccacgggggaaatcaaggccgacaacgccatcaaatttattaaggggatattttgccgatatggattgcctcaccgcatcataatggataacggctcccaattcatcagcgccgatttccaagactactgcatcggactgggagtcaagatatgcttcgcttcggtttctcaccctcagagtaacggataggtcgagagagcaaacggtatagtactacaagggattaagactggtgtctacgactggctcatgtcacatgataagaagtgggtcgaagaactcccctctgtactatgggccgtgcgcaccacaccaacaacgtccaacaaggagacacccttcttcctcgtgtacggctcggaggccatgctccctaccgtgttacgacatcagagtacacgagtacagaagtactccgacgaggatcaggaggaacagcgaaacgacgacgtgaacctactcgaagaacatcgagaacgggttgccctcagagcagctagctaccaacaggccctacgccgatatcacgagaaacgcatccgagcacgcatactttcgttcggcgactacgtcctccgacgagttcaaagccaagcagggcgaaacaaactctcgcccaaatgggaaggaccgtacacgatcacacaagtcttgcggccgggcgcattcaagattgcagacggcgatagtcgtgagttagcaaattcgtggaacattgaccaattgcgtaaattctatgtataagtcaatagtgtccatatttgtaagacatcttacaacttcaaagtctgttttaaggcacagatttcaatcacagtgccccttcccgatgatcccttacccatacgacacctagcgttgaaacctatcatcatgtccctttacgccgtcttgacaaggcctccgaggaacctaagggaacttcggctggggatgcccagagctgataaggccttgtcggatccttcagagatgaaagaccatgtaagatctggtcgtgtaagagttctcgccgtgcgtattaaccaagccgtgtaatcggaaatggatttttccaacttcatggctaggggctaggatcagtgcttgttcaactaaggcaagtcgaaggtccaagagccttatcttccgagaagagttctccgacgacaaggctgggggctcgggagagtgtataactcaagtgactgatcgaagtcgcgaagtgagaagacactcgtgcacaccgcatccagagtaagaaagcttagttagatagatttcctttctatttcacaagcatttcttacagatcgcaaagaattccaaaatatattacaattttcctaagatgtttgtcacagatatgcaagcactaccaggaaggccaacgccaatccattgactggatgatcttctccgctagcggagccatcgactttgctaggttgtctatctccgcaggattcctccgagaacgggaaaacccttcgtgaaggaactcgaggtgcaactgcggacgatgatcccgtatacacgccagcacgtgccctccggcgtatcggctcgatcgacgacactcctgcttcagggcctcgtcgatacgccccctgatgccttcaaggtgagcacaagccccgttcaaccacgagatgtagccagccgctaactcctcgggatccccgtgaggtactcggagctctctgcagataatggccatggttgtgcagcaactcctgaggtacgagttgaaccatacctcgcgacctcggagcgcctccacagcccggtccctcttcacttccaatatagtcctctcaggttcggcgacctcgaacttcgtcctccagtactggatgcgacggtcgcgatcaacaagcgcactgtcgaggtctgcttaacatgcaaacacctaagtcaagctaattaagacagacaaggtaaaggaaatagaaacgacaagaaccaacctaaaggagtcgacgccacgtccgtctcctcgggcagatcctggtctatgccgtcccgcggcacatacggctcgagctcaagtgccggaacgactaccggcaatttgggctgcccgcgctgctggacatcctcgacatcgacatctctacaaacaacaaacaaagtacccggaatcaaaacgccaaagaaaactaaggtgatgattgcatacacaaaggtagtcggaaccgacaaaagttttacaaaacgctattggttaaggggtacagaggagcggtggccctactcttcaaaaagtgggagaatggattcccccatgtcgccgatttcttccatcacatccttgcgcgcattgctagccgccccctgatacaagatcttctggagatcaagttcagggtgcgccaacttcacacacgcaaggacgttgcacgtcccggtgtagatcccgcttgacgtctcctccccgatcctggccgcatgcttggaggggatcacctccatcgccgttgccagttccgcgagcgaagtcgtcagcaagaactcgtcgggattcgccgggatggtagtcgtgacaccacactccctggcgagctagtgtaggccggtgtaagtgacccgcagcgaaccgcggatctccgacagattgttctcgagttctgacatgcggttcttgagcccctgccgttgccgctcgttgccggccaccagctccctcattttctggaggtcctctcgaacctccgccaagtcacgcgccagcttgtcggcgcgctcgttcgccgacgatgccgccgccgcccttgcctccgcaatctcatgtcttatgccgcgagctccggcctggaggatgcgccccatctcgacttggagctcctcccaggtaaggatgtcagcaggagagccttgagtaggcacaagatcgccgacagggccgttgggcgtcgcctcacggctcctggtcatgaccacgacatccgtcgaggccaccacgggagacgcgctggagttccctccagatctgtcctgcgccgccttagcccgcgccgccctgtgaaagactacaatcaggacagactgcaagagttcgatgaagcgacaaaacctcaaattcatccacttacttctcgccaagcgttacaagccgttgccgtcgcggaggcgggggagatgcatctgaggcctgaagtataacgagcatgatgtgagatggaagctttccgactacgcaatggacagacaggagagcttaccgagggggtgggtgtcttccgacgattcccgagcacggaggagaatttcctccccttttttggaacgttgacgccgctcgttgtggccacagcagcagcggcatcagacgcctccttggcgacgtcctccttcagcgacgccgctgcctgatggtccacgagtggcccgactagagatggcaacgggtatggacccgacgggtttccactccccgtacccacacccattgaaactaaatctgcccactaaaaaacccacacccgctcgcgggtgagaaattcccccatacccgcacccgcaacattttcaattgtgcacaacaataactcaataaggttataggctgtagtgatatgtacacaacaagattaaaaaactaaggctcaaacaaaccatacaggatacatacagcctaccacattgcaaaatcaacagcaagccatctctactcacggtctcggccccagccggatccagcgacctacctcattgcacctacggcggcgctcctgccgacagctgaccggcgcgcggcgtccctgcctgtcacgcccagaaattcccgaatagaattccaagcagaatgcgcattaaaacccccgtccaggaccggccggggtacacaaacgacaaagttgacatacagatccacgtcttacaaacatcataaaagtcttacataaatgcagtggaagattaaaagataactggagctaagccttgacttggactgcagcgggaacaccactccataggcatcctcgacggcacggacgaagcctactcctcggagaagccaccatctgacatgtactcaaactctagggtttgggggaaaatagagcaagactgagtactacccactatactcagcaagtcataccggaataggggtatgatgcaggatataaccaaaggataggtagagcggttcatttgcataaagcgagcatttaaaaacagtagttcaaagcagtaaaacagtggtagtaactaatcaatattaatcatccactgtccaacgctacaccacgttgcaacaggcccaaccattcacctgaactaaccaattccattagactagactagggtgagactaatcacggtgaatctggttgaccacccataaccgcgggcacgactatttgaatagttttactctgatcagaggtgtacaactgtacccacaagacacagccccatgacacgttaccgtgcgccgacatgccaccacgacataccggaaagaggctgtgacaggacctttcacataaccccctctagccaagcacaccacacctcaggtttcacccccgtccccagcgggcaacgggcagtcccctctcgtgcctaggtgaatccggaagcgacagaggccgtcgtagggcccgccccgctccatcacgcccacccttgcctcgatgcgtcaactagaggaaagctacactacaagcccagccgttgcccacgctggcttgtggtaagtacgataagttcttccagggcatcctgcgaaccggtccttaagtgccatggacgcgaccatcaaaaccatgcacccatagcccaccatttaatgcattttaattgactaacaccaggacggaggctttaatccaacaccaacactagaacctgaagtctatgcattaatgtgattctcccattgtgtgctagttgaactaaacatggctaagcaatccctagtgcaatatctagtcatgttatatcccaagctaacaaaggagcatagtacaaaaatagcatggttgtacagtagatatacatcccatagtaacattataaaacaatgcagtatttaagggaaaacaatagagcatttgcaatataggatcaacatgttcaagtgataagtatgacttgcattgctctgctgctggaggaacctcggcgactatttcaaagtacaccggagcaccgggagagccggaatctaagcgacatacaaagcaaacaatacaaacaggccaaaagactactgaaacagagaacaaaaccatttttaatggattctatgcatttttcttgatttactgagacttgaatgggcttaaacggagctcagatgaattttctatgaattttagaagattcactgtgtttttactataaacagaaaaatccttaattgatttattgcgcaataaataaaatcccggggagagagaggggcggcgtctacatgcgggccccacatggcagtgactcgggtggcggtccacgatgaaccaggtccacggaccggggagggagcagtgcaccacgtggcgctgacgtggcgcgacgtggcacacacgtggcagccacgtggcatccactcgggcagctgaaccaatggccccgagatcta

SEQ ID NO: 42845 - DNA, 19201 bp, Oryza sativa
cggccggagcggtggcggcggcggtggaaaggagggggacggtgctagggcggtggagtgcacgggagcgggcgattgcaaaacgaaaaagagagaggagggaacgggggtgctttatataggctcacgagggttgatcgtggccggggtggccgcgatttcgccggcggagtggagagaggtggggaggagagagaggcgggattcaaaaattgaatcccggccgtctcgtgcgcggacgcgggcagaagagagggagtgggcgcggggaaggcgggcgcaggcagcgacgtgggcgacgtggcccgagagacgcgggagcgagcggggtggcggttgcgggatgcagcggcgccggctggaggtgggagacgggcccgacaggtgggccccacctgtcggcgacctgaagagaggagggaggcggccgtctcggctgggccgtagccttcggctggcccagcgcggagggggagaggaagagaatgggccggcggcccattcgaaaaagaaaaaggagggaaaagaaaataaaaagaaggaaatgaatttcctcggattaaatattgcttgtgctcgattttaattggttaaaattatttctagagctctgaaaattccactaaaaatcttgttagcacatttcgacatgtagaactcaagaaaaattccatatgccaattccgattattattcgcattaatttatttagggtttctctcttgcttttacaccgatattttcttgaggccaattaaaaattcaatttaggcttgggaaaagaacttcagggtgtgacactgcccccaagcagcgatcgatgcggtggctatcccgcccctaggaagcagcgtccctggctccctggaccctgccccaggcggcgaccgacgcggtggatgtctgcccccacgctggcggctgcccgcacggcggcgccctactccatcggcgagaccgagaccggctggcggctggtgctgcggccgtgcgcgcctgcgcggtggcgtgccggcgtgtggcgtgcgcccgtgcggtgcggccgtggcttgggcgcttgggggatgagggacggcggagaaacggagacaggagggagaggataggaggagaaggggaataggatttagaggagtgaggaaaagaggatttatacctagggttttgatggttatgggccttgggccatctgcatattgggctaggcctacgggtattttcaacccacgggttaaaaaggcaaaagggctgccgagtacacttacattgattgcagcttcacgttcggctgcccaattctcgcagagaggaacagggacattgctcgctgttgtagggccgctgatcatcacttgaccgatgcggcgccctacggtctcgctgttcagacctgcagatcgagaaccaaaatcgataagtcgggaggaacatgcacttaaggaatggaacccagaatacaagaaaaataccccaaggagaaacccgggtcgcgtctttgggccctgagtagtcaaaggctggatgggctcgagcctggagcggctggatccgtttaccaatgaagtcggcagcgacttcatatcccgacaactctcgcactcggaggtcatcgacgatatcgatgaaggattgaagggagggggttaaggcgggtttgacggtccaagacgaaatcttgtctggttgttcctcaagaacaacaaagactgggtccgagttttctatctgaagatagaaccacctcgcccgtcatttactacgagaagaggggcactggaaggggatatagcgagacttcaggccatcccgaagtcggaacccaacacatccagataccctgttggattccatccaacgcaactcatagtagaagcggaagaggtcaagaaacagctctaccccaatgtaggcctcacaaatatgggaaaagatactgaggaaggcgatagaattgggattcaaatggagcaaagagagaccgtagaaattcaagactaaaagaagaaactcggatggaggaggaacaaaaccacaaagaatgtaatcctcgaccgcaaccatgcgacccaggacaggttcaggttcagtacctcctggttccctctccatggtcccgcgaccagggagagcgccttcctcctgcaacttctccagcgacacgctggtagaagtggacttgtcgaggtccattccggtcgaagatcgccggagaaggggccgagatgaacaagctagggtttgtgcggaagcggagaagacaaagagctctggaaggcttgaaagtttctcacaactgccggactccaaaatggattcccaaaactcccttaaataggcgcactactgacggtgcgaatcccaaggaaaggagagagatggacgccggaaatttctgggtccgttgcgcgaagcggttccttggacttcaatttaaattcactcataaccgttagacttcgcatggtgttgtcgatcactctttgtctctacggtccctacaccgagatcgaccagtcgagaacgacaacaactccgacatcagaagtcgcgattggttacacgagttcatttaagtagaagtcgggggctactgtcagggttacggataaggtataccctctacccttggatgtatgctatacggaaatacggtatagcggtgcatatacagacgttctctgaacacgctaaggaaatccatcacgaagtccgccaatggaaagattcctacccgtataggactgtgtcgttattatatcgtgtagggtccgatgtctccaagtcctacttggagaccgcctgacctgcgatataaaagggaccccttgggggacctaagggatcaaatctcataacctacacaacgaccacagcctacgaagccgaaaactacaggagccaagtcgccgggtgatctagtcgaatcaactcgactacgatctcgtcggtaccaccgagttctattattccctttgtaatctgtggttatttccatataatcccatatcaactggattagggctattacctgttaaggggcctgaaccagtataatctttgtctcttgtttccttgatgtcgtactacgtagatcctcgtaccagcgtaccccaataccctctatatccggtctacgggtacccaccgtcaacaaaaatgaaacgtgaaggaccaaattgagcctttggtaaaacttgagggactaaattagctatttacccttttttaaactacaactataatactataagttatatttaaaagttctttaccctaaaaaaacttgggacagtgttttagcaattccctattaaaaagcttgacaggaatacaggatctctgcttactcatttaggatgagtgtaaaaacaaaaaaaaaaatttgcaaagtgaactctgaatgagtgaagcgtagaagcaccccctgaattcgtatacgcaatgacgtatccatccatggaaactgcagccgagacagccgagacagagatcgatagacaaacacatgtcaatatcacaacacaacaatgagcaatgtttgtgttttgctcgatgcattggatcgttggcactgctagtcagcttcgttggaacatttgttaccattccagagctgctccctggctcccctatagcatcaaatgttagggttcaacttcaacctctcgcgcaagcaacaatggcgggatcgcgatggcctctcgatcgatcgatcgtctcacacacctatgctggcacacgtcacgtacaaatacaacaagggctctcggaattcacacgcattgtatgtgtacacaagctctcgacctcgatcttcttcttctctagctccggcgacgtcgtcgtcgtcggcggcggcggcggcggcggagattagaattcagaaggaggtgcccagcctggtgagcttcaggccggcgcgcttcttggcgtcgagcgccgccggcagcagctgctcgaaccggtcaaggaacgccgcccactcgtcgccgctcagcgccttgaacgacatgcgcttccgcgcggcgccgcgcccggcggcgccctgctccgccgcggagaagctcacgctcttggcgatgccgccgccgccgaggaggaagaggtgaggagggagcccggcgggcacgtcgtccatgccgaactgggtgctctcgtcgtcggagtcgtcggagtggtggtgcttccgaggggatgagccggcggtggtggtggaggaatcgtaggcgttcttgcagagggactcgagcgcgctgagcccctcctccatcgccgagaactcgcgtgtcatcatgtcgccgatgtcggcgaggcagagccccgcggcggccgcgcgctgcaggaagatggtgcagagggtgaggatccggatggccgcctccgtcagcgacggcagctcggcgcggagcatcgcggcgtcccggaacgggtcgagcgacgcgacgtactccagctcggcgccagagaatggcagcgacgactgcggccagtgcagccactcgaagtaggggtcgtcgagctgctccgggaggcagagcccgtggtcgatcggcacgaggtccagcggcgtcaacgtgctgccgccgctggcgcactcgctctccggcgacttcttgacgaggatgttgccggcgtggcggtcgatgttgaggaggcggacgtcgaggctgccgatgcggtgcacggacgccacggagaaccgcgacgggccgagctcgccggcgtcgcactcgtgcgccgcgaagcgctggatcgaggccgtggtcgtcggcatggcgggtcgcgagatcttgatcagcgcggtcggctcgacgcgggcgaagccgtcgtggtcgaggaggaatgcggccacctcccgcagcacgccttgctcgcgtagcctcctccaccgccgtgggacggcgaggacgcgtcgtcgaggagcggcttgatcaccgccacgtggtcgacggagcggccgtcctcgagcagcagcgcgccgccgatcccgccctgcgccggcacgaggcgcgtccccgtcgcgatggcgcccgcggcctccgcgatgagctcgtgcaccccgcgggcgtggccgcccgcgacgatctccacgcgcggcatcatcttctcgccgtcgtcgcgcgcgggctcggcgcggtcggcggcgggagggacgacggtggagaagcacggcgaggagaggctccgccgcggcgacaggccggcgtgcccgttgcgctctcggcggtccaggtccaggtcatggtcgtcgaacaccgggcagtctagctgggtgacggagcggaggcggcagtgccggccgcggacgccgccaccggggggactcagctcgcggcaatggccgaccgcgattgccatcctgaccgatgaaaacgaattcacgctacctccggcgtcggcgaccggaggtgaggccggccggctacgcaacggactgccatgcatgcatgcaaccaaaattactcaaatcatactgtgcaaactgcaacacaccaatggcgatgatcgactcgcacatgcaacacatccatacctttgctggtgttttcggctcgttacagcaacatgtcgacgacgtacggcgagcaatcaagctacatccacgagtcagcagcagacgtcacagacgcgcagggacgacgacgacgacgacgattcgacggcgagggcacgggccggcatggcagtgaacgaacgaacgagtcgtacgtgcgtgcgtcctcgatccgccaatgcagggggaggcagaccaccggaggaggggagggtgagctctacgcgaggttcgccggcgaccaccctgccggcgtgccggccggccgcgccgccttggtatatatgttgagccgctaaatcaatcagctatagctagccatcagccgtcgtcttccccgcggttctagatcttcccctcccctcccctccgcgggcgcgagcggcgtcaggctcgttgccgggggaaggagaagaaagagagaactcgtcggagaaggtcgatcgctacggctgcctatttttttgcacccgcccagtggggacgacggcattgaggcatatatagatcttggctgtcccgttcgtcgccctaattttgggcttggcttggcgcgtgtgtacgcattcctagctctccagccagtccatgcatggttgacataacgccttcgcgtatcggagattcagaggggtggagcggtccatgataagacagtatcgcatgcatgcatgcatataggaaggaacctggactggaatgtgggagaaatggcctcaaggagctagtaaacggttagcatatggcagcaggtcacggttataaattacttcttccgtatcatattaagttcattttcaacttatttcatttgtcccaaaataaactcattttagtgtagctattgtattggggtttgtggaagttgagaataattgtattggcagactgagagtagataaagtgatgaataatgagattgaatgtatgcttaaacgcttttgagggagggagtacgaatttatgtccaataaaacatgccatcgtagatagacaaagacgttttagttttctaaaattaataattgcaattaaataacgagtgggttgtgattgagtgagcctccatatctattcttcggttaagagatgcgaattatagtgtagtgttgagagatgcaatatggacttttttttataactcaatatggactttttcctagtaagattatgttatgcctaacaaggtgataacaaggtccctcaacttaacagcgagattttttaacgtcccttaacccttaaccacaaaatcagaaatgtatacccctaaactcactcaaaacgtacactcaagatcctatggtagtatgggtggtttcactgatgtggcatcctagtcagcaaaatatttaaaaaaggatgcggggggccacatgtcagctgcacatctttttttcttcccttttcttctccttctcttctcttttctctcttctctcttctcttcttcagtgagagaggccagcggcgggcggagtggcgatgcgcggatgcagacggtgggcggcaagcgagcgcggtaacggttggcgggtagtggggcaaagcggtttggaaggggagggggacgcggccggcaagcccgttcgagctcgtccaacctgcgcgcgagggagacgaggagagaagcagcgcacggcgcaccggcgagggagaggagtggagcgcagcgtgtcgatgggggcggcagcgggctcagatgagcgccagatgcggccggtggtgtatgtcccctccctctttcttgtccgcgcaaggcagtcgttgtggtcagcagtggctgctaccggcgaccggcaaagagggggctccaacgtcgacgaccgccgcttaggggaagaggcgcgaggagtggaggggaaggagatggggaggccggcaagcagggcgaggaggccggcaagcagggcggggatgccggcgaggaggttggtgagcgtgcgctcgaagagggaagaggtgggcgccacgccgctcctctcccacgccgccgcgccgtgccatgcgcctctcctctcctctcctctccctcgtcaccgcaccacgccgagctcaacgtcgcaccaactgtctcctctcccgccgcagccgcgagctggccgagctcgccgttgcgccgacctctcttcccctttctcgccacccttgctccgccgccggccacctctctccctctcctatcaccaccgtccccgctccgccaccggtcgcctctctccccctctaccgccgcgcccactcgagagaattaggagagaagagaagaggaaaagaaaagaaaggagaaatgtggggcccacaccattttctctcacttacatgtgggccccatatattaatcttaattatttttgcgactaagaagccacgtcagtgaaaccaggcctctatattgactcggaaccttttttgggatggttttacatagtttaggggtacaccgtacacttatctggtattgcggttaggggacttcaaatagactcgacgtaaagttgagacacggccggtgaacttattcctaacgctgatgacctagcccggcccaagcacacgatggcgcacacattacagcaggccccggcccggagacgcggatgcataaaaagcggattaattcccggtcgatctgcaccttaactccctgacatgacatgagccctagaaccgcagcgtgtcggcacctaatcgcattcaagatgcttggaaaatggaactcgtttgatgcaaagcaaatccaagattcgtaggaccgcggccattgttttattttggaaaaagtacacccaagttctctcaacttgtcatcgagatacaaaatcatcctcagaccacaaaaccagatatcccacatgccttaactaatcaaaatcggtcacaaaagttccctcggtggttttgacctcggttttatcctacgtggctgctgagtcagcgtgggacccacatgagttgcatatgtcagcttggcccacatcagcctcctctctctttcccctattctctcccttcctcatctctctctcacccttcccttctcttctcaggcaagcagcgctgctggggaggaggccgccggggcaaggcgctgccacgccgacgctgggtggaggaacaccgagatacagccggcaagcatggagtcgaacgtcgacttgcgggtgtaggagtcgctcgccgcgtggctggatgcagaacacgcggactcgaggagctccatgatccgcctcggcgagttgtagtgccccgagggcgagcttccgaagggtgcaggacggcgacgcggtgcactgctcgatgatctgggcgcgcacggtcttggtgctcccggtgcgcggcgcgccggcgaacgcccagagccaccggcggtcgcgccgccgcatgtgcggtcctgccaccggagcacgtcggcgtcaaacaaaagtttatctctagctctaccaaaaacacgcacgtatgccttcacgcaaaacccatccaaccactgcgccgcgccgtgcatgggcctccatctccatcgtctcttcgcaaaccagtagcaccacattgatttggttcttcgtgacaacaggctgtgccatctatgaagcaaagcaatgccttcgctgcccaacgaggcaacgacacaccgccatgcatgcaaagcccacgtgtagtatccgttaactcagcacacaaattcccaataaagcaattaattaagcaaatcactaaccagtcagtaatttggcaaaccaaataacccaactggccaaattacagtgtcaacagaccggtgcaccggccggcgagtgtacaagtacgagctctctccgcggttggtaccggctgtactcgaggtcgatggacgtgtgcaagctcgtcgtgaacgacgggtttggcccggcgctccccagcggcggcgctctgccggagcgggacgtgtacgacaccgaccagtacatgctggcgctgatctaccacacgcggatgcggcggtatgagtgcctcaccggcgagagaatggcgaggaagaagatccgcgacgcttggagcaagctctctccgccgccgccggacttgtcggacacgcacgacactcgccgccatcggagcagacgtgcgccctcgccttctcccgcgtcgaagctgccgccgccgcctcctctcccgcctcgccccggcggcctcgtccccagcagcgccgcccggcttgcctgagaagagaagagaagagaagagtgagagagatgacgacgggagagaacaggtgaaaaagagaggcggctgacgtggattaccttgacatgtggggctcacgtgggtcccacgctgactcagtagtcacgtagtacaaaactagggtcaaaaccactgagggaccttttgtgaccggttttgattagttaagggacgcgagatatctggttttacggtttcaggatgattttgtatctcgattataagttgagggaccttgggtgtactttttccttttattttaggctaaactacacttggcccacttattcccgtcctatgcaactcgatcggggtggcccaaccgactcgaaaatcaccagaatgaaacgaaaccaaaaaaaaaaaatcacccgtccctatagtggcctgtaccctgtaccccacctgcatgttcatctcgtatgtatcagccgtagcgatcgacgacgagccaacaggcagcagggttggttggtgcatggcaactggcaaatccgcgactcgttcgacgcgcatccgctaacagcgacccgcccgtgctcatgcatggcttgctcggcaacgacgcgagcgaggccatgtgccccgcgctctctctctgtttccgccgagagcgacgtgtgcgcgcggcgcggacgcgagcgcggcagctcacggtcgcgcgcactgtccacgcatatgcacgcacgcacggctctctcgcgcgcggggcggccacgatcgaactggcgaaacgatcgatggcatccaacctgtcgagagcgacggcctcgattggtcatcaatctcttaacagcaaaggcttgtgggttgcggcagctgcagcttaggctatcatgggccctaattaatctcgtaactccctgccacgctatcacggacacgatcgagtctgttacgcgtgatgtggacgtactacataacaaaaagaaaaaaaaacttaaaattcttagctacctagctgatcaaggatggacaggaaatatatatgtccaaaaaagaagaagagatcgatcgaaaaggatggacacagacacagtgcacaacagcacaagcgcaaccatttgccttatcatctcacgtgtagtgatataagcaggaaatccaacaagagaacatggggtgtgcacactggcctcacttgccataacctaatctccaccacgtacacgaacctcacgtcctcaccaggttttcgtccatgttctcgagtcacgggctgctgtggctgtgcacgacggcatcaagcaacatgcatgaacgcggagaatgggccccacccgtcacccatggcgtacagggaaaatatcaaatggaaaaagaaattaaaaggaggaagaactcgtagcaaaatgatcatctctagctagcaaaatgatcatctggagctgtcgaccaattgctcgtaggccgagagagcagaaacacgggaggaatctgtgtcctgagcttgccaggagacagggaggaaagctgaagctgacgagcccttttttctcttttgttttgtttcgagacggggtaggagaataatcgtaggcggctactgttgctttcagtagttcttcactcactccgtcgtcgtggacctgctgcataccccgccgccaacggcgtcctttatcttttctctcacttgcccttttttgttttctttccctttttttttgtttcagcaattcagcgttcctcgagatctgagctcgttcaaattttacatgagtttatttacagaaagattttgcgagaaacggtatttttttagctgtgtttagttcacaccaaaattagaagtttggttcaaattagaacgatgtaacggaaaaattgaaagtttatgtgtgtagaaaagttttgatgtgataaaaaatttgaaagtttgaagaattattttggaactaagggtgtgtttagtttacgctaaaattggaagtttggctaagattgaaataatgtgacagaaaaattaaaagtttatatgcttagaaaagttttgatgtgatgaaaaagttaaaagtttataggaaaagtttggcagagaaagaatctctctagtacttttgaaacagacgcccacatacagaaaaaactgtcaatgagtgctcatcagaccagtcagaaaagctgtgtctttcactgttcatcacgagcacaagaagtcaagaacgatgcagcttcaaagcctctctgttgtcccatttctgcatagcgcaagatagcacgttgagtgtcgtcaaatcagacgttctttggttgcctgccctaatcaagtgtcattcaaatgattcaaaatatgcaaacgcatggcgggagtgacgggacagagaacggagcaccttgctgatcgtgccaatggtgttcagattttcagaggcagaacgtggtgggatcagagtaggacaacaattagcgatgggattagcgctggggctagtggtgcaccaacgcacacatcttcaagatcactagtgggcgcagagaatcagataaactaatcctggatcgcagagaaagatgttcttgttatgctcgtgtcaccatcatcttagctggattaaacaaagaacagtgggagtagcagtagatttgtactcctacgtgcgtagtatctgcatgtttgtttgaagcagcagtggaaagaacgagctgcattctttcattcttcgattagatcgcgcgacgaaggccaagatgaacaaaatgtcacaccttgaacgatcgaatcgagcacttaacaaattaatacagatcttgggaccttaattaatcatcatggcgcacaatatattttgatcagcgccgatgaaacgagagaggagaagaagaaaaaaaaattcaagaaaccaagaagaaaatatgtttgtatggtgatcgtcaggattcaggaggcggagcggcactgcttcctgatattccctttgctgccggtgagcacgtcgatgcgtcccatcttcttcatggacatggagaacgcggcgtagaacttgatcgggttggtgaggtctgccaccatctgcgccgcggcggcgttctgggtgagcgcggcgtcggacgccagcgcgccctgcttcttctgcaggttggcgtagtaaccgctgtcgaacttgagcggcgtggcgacgtcgaggtcgatggtggacgacgacggcgacgggttggggcacgacgacatgagcgccttggcgtaggcggagtcgagcagcgggtcgagggaggtggtgttcccctggtacagccgcggcgtgacgctggagcagctggccttgccgatggtgtgcgcgccggagagcgcgacgaggtcggtcaggttgagcccgcggttggcgaagctctggaggagcgtgctgaacccggcgaacggcgacggcagcgcgccggtgttggacgccagagacacgggcccgtcgcgcctcccggtctccacctgccacagcgacgccttgaactggtacgacacggcgtcgcgcgcggcgagcgccacgatgtccgcgcacgacaccaccccggggcacgcctgctccagctgcgtcttgatggcgtcgatcacctcgtatccccccaccgataggttcggccccgccgtcttctcgctcccggcgttgtccagcaagatcgacgcgtcgcacccctgcacgcaaaaccacacacacaaaaagaagaaaaccgaccggtcagccaggcgccattgacacgcggccacaaacagctgcgctttgcagggtttgaaaaaaaatcgcgggagcaagggggccaaggccggtggtgtggccatggcccatgcatggcatgcatgggcgccgtacagggcgcggcagctttgataagcttagctgtcgcgcgcgatgcatcggctcagcgccgcatgtgagctgcacggcaacgcaacgcacgggccgcacggggaaaaaaaatggggggaaaaatacgacaagattcggcgtgctccccccctgtactaggcacgcagtatttttcccgtttgtctcgttgctttggcgcgtcgcgaccgcctcgcccctcgcctcgcgctgccgcgaaccggggaaaaggtgccgtaatgcttacgtatatgtgtacaggcacaggcgaaaagcaagataatatcttctcggctggtcctcccgccactgtgaaaatcagagtaaaagccacgaaccaccgcggtaaaaaccccggttcacttgagcctcgtttcgtccccaatcgacgccatgcaaagaatgcaggaccagtgaaggcctctagactgtagctagagctaggtagctcgaaatggtggctctcgcagttaattcctctcaggatgtagacagggagaaagaaaaccggccatggctggctagctaggccggcgcgcggcacggcgccgacacggcgaaatgggggcttggagagagctgaagcagcgaagaaacgggagtatttttgctggcactgacctggacgaagcagtcatggaagtggaggcggaggaggcggccggggagcgccgggttggcggcgacctgcgcccaggtgacgctgcggacgatggagtccacgttggggcacgacttctggtagaagttgtacgccaaacccgggttggtctccagcagcccggcgctgccgccccccacaaggccgcacaccaccacggccaccgcgaaccaccacgccaaatccatctctcaaactgaactcgagaaagaaataaagagagaaagaaacagagggggagaactatctgaagaagtgcctgaactctgcagtgattttggtcggtttgggctgctctctgtgtttgtgtgcctgcgtttgtgtggtgagatgacggtatcggagggggacggctgggagccggggatttataggaggagcagctagccagccagccggcgagatcgatcgttcgtttcgtcgtcgctgcagttgacacagccagctagcgaggacggcgatgtggtggcctggctactcgatcgatggctagctgtgcggcccctcgctcgctcccaagttgcgtgctttgtttatgggttcggctggaagctgtaggccggactaggggagcgcctgtacgcgccatacgttttgtccatatcgggtacagggagagcagcgctgggaatgctcgcgcctgtgcatgcatgcgcagtggtgtcggccgtccgatcggtgtagctgacggtgctgatctcgttgggattgggattggaagtacacatggatggatggatggattgatacatgtggggcaggggggcatgtgctccaaaggggggcgagttaggtggcccttttgtttaagctcccggtcactgtgttgttccctgcacacaactcccggttgcattgcatgtccccgagaccctgacccgcaggcgagacgaccgaccgtccacgaggcgccgtttgtgcgtttgacctctgcctcccgcctacgctatcgtccttcggctgtatttagatttaaagtttggatttactccctcagttctaaaaaaaagataaactgtgggtttttaaatttttttataattagtattttcattgttgttagatgataaaacatgattaatactttatgcgtggcttatctttttaatttttttcataattttttcaaataagacggacggttaaacgttggacacggaaaccagggtttgtcttttttgggacggagggagtaaacttcagtccttttccatcacatcaacctgtcatatacacataactttttactcacatcatctctaatttcaaccaaaatctaaactttgcgttgaactagacacagccttcttctcggcgttttaaacttttttccccgacccgacgggtggacggcgcgtggtggagtggcagttttcttttaccgttttccgctccgcgctcgcgccgcgaccgacatgccctcgcgcggccgccgcgtgctaaaccccttctccccccgatcgatgcgcctgtgtgccactgtctcgcggcgtttgctttcaccggctttcgcgacgcgacgcgtcgcggcgcggcggccgcaaaaccgcaggaaatcacgggggggggggggggatcaagcacgcggggggcggaaaaggtggtttctccgtagcgtatcgcgcccgtgttcgcgcaggggcgtttgtttgtttcccggcgggggggtggatagttcagtggagacgtggccgggcgcggcgcgcgcgcgggtcttggtcttgtctcgttttgtttcgtctcgtctcgtctcgtcgtgctgcttttgggctagcttgtctcgcttaatgatacgttcatactacacttaaaaaaaagaacatctgttttgaaatgttactattctatatgtgatttagcacttcctaatacaataattcttaacggatgtgttcgatcatgtactaggcagtgatattttggagcgagtgtagtgaaaatcacggtgaccgcacccggttttaagcacggagaagggggcagccactatacggtacgcctacgtgctgtgcgcctgtgccgcgctctttttgattggcgtgtgggggcaggaacaggaggaggccggcaatcatacgatgattggccgggttcggtagcgaaaggtggccaggattggtggcgccaccagggagagagcgagaggacagagggagaggtgtgtgtccctgcgattgcgagggggctcaccacttcgagttgcttggcgtgtaacctggtgctttcttgatttggggtattaattagcacatttgattgctgagtcctgtgaccgtaaaaaaatagctggagtgttctgtttcctgacattcaggccatgtttggattagagactaaattttagcccctattacatcgaatatttagtactaactagaaaggtagcccgcgcagttacgcgggcaatttatttattgtttacaaatttaattggtaaattttgagataaatctaatagtttagaaaatttgaagattttttttcctaagagagtaggaaaggaaagaggagatgaggagagtacgtccgtaccaggaaagggtgtggagaaggtgggagcacatactttttttattcgatctaatagttaaaaatattagacccaccaatttaaaaaaaaatcaatggatagattttagagtgtcacttggcttaattcaaacaaattaaaattaaatcagatctacttgaaaaaacacaactaaattgttttatttttttcgcaattacgtagtacatttatcaagtgatatttgacatcctaaaatatgatatgaaattatttaaaattatcataacattaattattatatattttcccaagaggtggtgatgtatctagaaccgcaatataaaatttataagacacaaatattttatttaattaaagaaatacgacaggatcacaaattgattatataatttaaaataatttaaaagatgaacatttagagataattgatttgatattttttatttatattatagatctagtttatatttgcacatatttgtggagtaatatatttttatatggtaaaaagttatattttaaagaccattgattttgttctgacgttaatatgtattatcgattttaatttattttgaatcttaaattgttggtttaattatgtatagagcaacagttagattagatataatatgtgtagcttaaaataactgtggttgtttctctttatcatagctactaaaaattatagagagaagtggagggggcacaaagtgttgtgcgtatctaatggtgagggtgaggtggaggggactttgtttttctatttttttctaaatcattcaggtcaaaaaccaattatcatgtattttgttttttagaaaatcttttttaattttaaagtcatcataatgagttaaaaaggtaatcttagatacaccgatttaagctggacgatttaagtggagattgcttggttcgaattagctacgtaatatcacgataaagccatataaactgatttaattagctgtatatgttatattaccgttaatttccttccacaaatcatgtataataactaatttaattagctatgtataatcttcttgttaatctcctagcttccatatatatattgccgtgcatataataaatatagatatgattagtagcaacacaatatgacagctaattaatctcaacttctaacaaccataaccatagttactaatccttccggcaaaccatacatacgtacgggagaaggtagatccaattcattggtataaaataatgggtccaccaatttaagtgaaaatcaacggcgggtaaagatctaatctaacggtataaaataatgagtccaccaatttaagcgaaaatcgacggtgagattatattgtgccacatggcggcctaggagcatttgtaggagcgccacgtggcggcttgagagcgtttgtaggaagtttaatgaacttttagtatataatagatagatagatagattagaagtattaaacctaaactaatgataaaacccattctataatcccggactaattcgcgagacaaatctattgagtctaattagtccatgattagcctatatgatgctacagtaaacatatgttagttatggattaattaggcttaaaaaatttatctcgcgaattaactctcatttatgcaattagttttattattagtctatgtttaatacttctaattaatgtgcaaacattcaatgtgataggtactaaaatttagtccctaaatccaaacaccacctcaatctgcaaagtgaacttcgaatagcaggagttcaaactttcaaccttcggcattacttctttcattaaaaaaaacctcaacctataaggatcattttagtaccttcagattcgtggtaataggagaggttacatcccttcctaagattgagtttttttttatagaaggaatactcctactagtatactccatccatccctaaaaaaattaatctagtatcggatctaacacatcttagtgcttgttcattttgctaccattttcaaccttaccaagttttggcattaccaaattttggtaaggttgtcaaaaaatttggcaatcatatgtgcttactaaaatttggaaataaactaaatgtagcctttttttttggaaaaagtacgaattacaccctcgaactatcgcggtcgtccgaattacccccctgaaccacaaaaccggatattcttcacccctaactatgcaaaccggacgaattacccccctggttcaatccatggtggttttggtctacgtggcgtacgcgtggcagtctagtcagcattgtatttataaaaaaaaattgcgggacccacatgtcatactcttcctctctctcttctctctctcaatctatgcctcacttttcctctctctcattcacgggtgggtcggcgacagcgggcgagaag

SEQ ID NO: 42846 - DNA, 12957 bp, Oryza sativa
  unsure (1)..(12957): unsure at all n locations
tcgccgcccgccggcgcttgagcgacctcggctccttggctgccgcccactatcgcttctgaccccgcccgtcgccagcctcgcgcccacccgccgcccgttgccttctccgccactgcccgtcgccggcctcggctcctcgaccgccgcccgccgcctcctcctccatccccggccgtcgccagccttgcgcccacccgccgctcgctgccgcctccgcccccgcccgccgcccgtggtcgcccgccgccgccgacccacccgtgagagagagagagagagaggaaaagtgaggcatacagagagagaagagagggaggaagagtatgacacgtgggtcccacaattttttttataaatacaatgctgactggactgctacgcgtacgccacgtagaccaaaaccaccgtggattgaaccaaggggggtaattcgtccagtttgcatagttgggggtgaagaatgtccggttttgtggttcagggggtaattcggacaaccacgatagttcgggggtgtaattcatactttttcctttttttttaactttaccaaaaaaaagataaggttaaaaatggtagcaaagtgaacaagcccttaatactattaagttgattttttatgtgatggaggaagtatatatcatcaaagagagctagtcacttgtattggtctagtccctccgtcccaaaataactcaacctaggacttagcctaggacaacaaatatggacaatcgttgttctaggatgtgttgtccagatttattgttcttatatgtgtcacatctcactatataggttaatatataggttaagttattttgggacggagggagtatatatatatatatactacattactagactaattaatcgccatttcacatgtgttctggcgcggttgataataaattattactagtcatcaatccctgtattgcatgaactaattactccctcggtccctttgtaagcggggttataaatttctatgcctatctttgatcatccgtattatttatttttttaaaaaaaataaaaaaatataagacatgtataaaatattattcatgttttatcaattatcatctaataacataaatgctaatcataaaaaaaatcaaacaagacggacaattaaagttggactcagaaggagtactagtcaccaatccctatgttgtataaactattataaatattataattttaatcatattgtaaatatatggctttttttagttataatggttagattaattaaaagaagagtctaagcagttaagtacaacttgttaattattgatttcggatttcaggaaaataaattagtagtaaagtactaattgagatatacaagttcgtataattttagcacaagattttggagaaatttaaacaaaaattcttgattttctagaagtaaaaaaaacctaagacaccataatatttccaatcgcactttctattgcgatcatgtttaagggagctcaatattctaagacaacaactaataagtatctagtggttgagaatataaaatagtctattagctcattttctagattatatagctacttagtcttatagtcttgatgtgaatttagacggagattatgagaaaagttttaccgtaagaatataaatttggcatggcaagggattacatcctgttccataaaaagtttaatcctaattataaacttggacacatgtatatttagtaggtttacagtcggtgttgattttttttttacagagagcccatttcgtttttaagctatacatgcaagttacctaggtggtctcacctactcctcgtaattagcttgatataccctgtatatgtacgtcagtacgtagttcgcgtagccgcgcgatcaagctagagcacgaggggatcaattattttttttacaaactataagcttataaccctggaaggccgtaaccatgaaaactgaaaaaatatatcactacctacacaccgacagcgccaacacatattcaggagaaagttagcactggaccgaccgccgctaagcgtgaccgaccgttgctaagtcaacaaagtaacataggtgtgatcatccaaaactcgacccttacgaccaacacaacgttctactctattctaagtctttagaatttaggaagagagggcaagagacaagaatggaactcctctccgagggaatcaaataaaggtcaaggcacacgtcaagctagctaatccagctcgtcggctaggactaatggccgaagcactttagtttatctaaattactctggtcctagctacattgtgtgatacgtatcatatagatatcattatatccagtgcatgctccaccagacagcagttgccattaataattagtcagctaaccaagctggatctatccatccatccatcttagctcacactgcatgtacacattagcaactagtaggagtagtagctagcttgttcctgaaaaagttcagagattgcttggtttgaacacaacttggaccgtatactgcaggcttgcagcacgcatatggtgacggtgtccccgtcgtgctaatgcataggacagagcagaggtacacacaactggtcaagattccagggactaattgtagctaggacgactaattagaccccggattaggtactaatataattaactacacaccctcatggacatggagccatgcatccggcactggctgccttacttgctgtcgcctccatgattaactagtggtgctaaactgtgtacctctttgttcctaattatgagaatctctagattgattaacggaaatttccattcaaccatcttagctagatttcaaattggttagaatcctcctcttaaacatctgattggctggaaatgctttagactcctgtacatttgaatcgttatctaaaaataactatgatgtgtgtaaaaacttaaattctagagatacttatatttaggaaacgggagaaagtactccatctcaaaacaaattcatttttgggttatatcatttgttccaaaataaattcacttttcttttctcaacctatcccggtcaacaaatcgatgaattttatttctttaatatccttaccaatacactcatcaacggtgtttttttacgaactactcactccgtccaaaaacacccaacttaggacaaccattcgtcctgattcattgtactaagagggtcacattctttttcagggttagatttttttagacggaaagagtaaagatgatcgtattttgggactaagggattagtacgtgactgaactgtttcttgattggaggccatggcagagagccagaagaaggatcatgcggcacatgacatgagacgaggagaacacatgtgcagtagtagtacgtggtactatacggcctgtagccatgtagtgagcgagactgtgtgtctgtgtgtgacagtgtgagagtgagagattagggagcagaatatggttgggctccatggatctctgcacgctgcctgccaagctagctttgcagtttgcgtgacaggtgcccgtcgtcctacgtggagcaaggaaggaatccgatggagacgacaggttaattatagtcattagcggcacgtaggattagtgagtaaaacaagggagagaacaaggtgaacatggccgggaaatcggcgataaggttaagtattaatgacactgattgtttagacgtgcaaggggcttctgaaaagagtacatcgggttggcatttccattctggctaagctctgttaacattcgtaatacggattttgcccccctgtttcgatcgaggacaagctaactaaacagagatggattaatgttctacagagatgagatgattcaggtgtggggcatgacgttgcttggtggtgtttagtagggcgaaggtaggtagtacttatggttgacagagcatatatacatggattgtcctctgattgggtcgacgtaaagctaatgatgcatcatcatgcatttaggaatatcggattatattaggcaggaggcgatccagattaatcagagatcgatcgaggtgtatgtactacacagtacgtcgtgctgtcttggcgacgacatggagatcaaggtagatgatggatcgaacctaaacatcttggaattagcacgaggctgcttgcagcccggtgctttatgcccctgcggctctgcaatgcagctaagctaacacatcattggttgattaaggcgcagagatctggagttgaatagttggatgagcccagatgcactgtcagtgcttgtcggtgatgcatgattatcgaataactgatcggcgccacgtgaacttttggagggagatcgatggttgatgacgacggtgactcaatcatttagccatggctcctgttgtttttgtcctcttcttccttttgaggagaacccacacatgtttgatcttcatttttttgagaaagaatgtgcatacacatagttaatactatagttaatgtatctttgcgatcagcggttgatttgagtaggcacaactcacaagctcgtcccgctaattgtcggcttcgacaagcggtagcaaactagcaaccaaaaccagctaaaatgtgtcaaaattaaaaaaaaaacaaaacaagctaatctgggccgttcatcccgagcccattgcaaccccaatgcttataggccttatgttagtgcacgatcttgtttcggcccaatactaatggcccagaggtaggcggcgatcctgtcccgtgccaacaatatgggccgcacgttggacgctataccgttacggcccaacatttctcggtcacatgtaggcctcatttccattccagcccaacatttatcggccgcacatagtacgtcgacccgcgaatctacttatttaaaagcgattttgctatatctcactcgaaagattttttttcttatctatcactcgattttctctctcaattttacattgcattttcttgtaagttacagtgtaatttatgaaacttacactgtaacttttgtaagttacactgtaatttttgaatcttcgcacgtaaattttaaattttgtattggatttggtctttttcttgaggatatggtaatttagtgtccattatggtgtttcttaattgtcttttgctttttattatatctatcggattttaatccaaagattaaaaatctgtgtgatacgattataaaaatctttcgaaagatgtataggtactccctaggccgcattcatatatgggccacagtgaggccgcgataccgaatggcccaatacatgtgggccgcacgtcggtcggagatccagttccggcccaagtatggtggtgggccccacgccccaccgtccgaatcgacgccgcgtaggcgtagcctgcaccttccccgccacgtgttccgccaccgctctcaactctctctttctagatcgactcgcctcaacagccaaaccgtcatccccgttcgtcgcaaagagagaaaccccccgcacgaagcaaagaagccgcaaccgcaagccccaagagcgaaaccgtaacgaagggaaagtttgggatgcgcgttgctgcgacgacgcggcccgcctcctcctccgccgccgctccgctccccctcttcctcctcctcgccgtcgccgccgccgccgccgccctgttcctcgtcggctccgcgtccctcgccatggccggccacgtcctcggcggcgcgcacgacgccccctccgccgccaacagcgtccagacccacgcgctcgccgcgttcgccgtcgacgagcacccaagcgngcggtgaagccccctcccccccccctcccccctccctctctctcgcttcctccccagtggcgattttgtgggtactgaacttgtgagggttctctgggtgtggtgcttgcagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaaggttttcgctcccactgatctcgcctgtcgcctgcctctaatctttgcttgttttgagatattgcgtgcttgctcgcacgctagcttgtgattctgcgaagggaggggattgggcatgggtggtgatgacgaggtgtatgtagaaatgcctagtcatctatggaatagtttcgttggaaaaaaaaacgacagtgtagagtcgagatcatcgactgggaatgagtgacggttgggttctcaatttcttgcacaaggaattgccaacatttccacaatcatataaatgttgacaattatacaacatttctacatgtatagcttgaaatacatttctactgggaataagtgacggttggattctgtgatagcttggaatttgacaactcacagcggcaggtgactgtattcttgtcatcctctgttaaaaacctcttttactgaatttagatagctgtggcatggttaatggtttgctgttgactccatttagttaatagtgatctgagttgttgttaccaagcatttgattctacatacagagagcacaagttgtaacgtgtgaagctcaacctttatgtttttgtttagtttcttattttgtttgttagttacacattcatgtctagttgagtttgttatatgtgccctgttgaacttaaaaggtaattagtccaaaccttagttttcttcttcttatatttttttgaaaaagttcttcttatgtttggtgggtataacttggtagatcaattttatgctgctgggttgcgtagttatatatttgaacatcctgcgtaagctgatccctgctaatatgtccttctaaaactttggcatgccatgctcgatctatattctggtgacatacccctgctcgatttctattttggcatgacatgctcctgcctgatctctatattcactctgctatgctgcttgaacagccgcccaatcatggcggcatgtgtatgttcatgctttaccaccttgtctgtctgaacaaactattacatgaatcccatcagattgatgcaacacctcactgcatgagcatgagtgcatgacgatttgattacatttgcttgcctatcaccacacacaccctgtatgtctgcatcataatcccactattatgtttcaatattgcattatcacctaatgtatcattgggtggtactggtatatttagaagaacttatgtagatgtaaaatttcatgagaaaataatattcacaacatacagtgtctagttagtgcattctcctgttttattgcttgtagaattctattatagggtacctgtgataatgtttgttttgcattcatgtgagctgcagcggactgggcataatctcatttgtagcatggatagcagtagcattacatgcttatatttatatagtgcattttgaattccaatcagatcaccacaccagctagaaagagtgctcaaggattctcacactaattatttgtttgagtgttagaagttttgctgtacgtctatatgtttatgtcagttcttcataagctagtttcagacagcagaatgttacacctgtgccacaggggttaaagcaaaagaagttcctccccttctggcatatttgttcataagaatttgcattccataatatttttgagggagggaagaggtgtgcccagcatctacaggtagtaaagacatggtctaattatattgtatttgtaagagtgtaattaccataatcatgctaaactgtgaacaaatgggcataattacacactatccatgcatatatcaaatgctgacatgatgccatgcaagcctggtgcctggttttccttctaccagtttaaagagggttgagcaccccaaggcacactatgcatccttctacctatttgaatatgttttcctttcagtgaaacgtggcagatgtcaatgtcaacacatatgatacaaagtggctaattagaatgtgatagtttcttcatgtgccaattcatggatgttgaaagttgatcacacacttgtgctgtatatgagatattgttataacttctaaacctgatattgaactcaatgaaatttcaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggtcagctattgtgaattcatccatccaaagattatcttttcttttttgtatctaatttagtaatgctgagcttatagttcacttaggcagcgttcgagagggtgagagagtgagtttgtttgtttcgttttccgcgcgcacgtttcccaagctactaaacggtgcgttttttgcaaaaattttctataggaaagttgctttaaaaaatcatattaatccagttttgaaatttaaaatagttaatactcaattaatcatgagctaatagctcacctcgttttacgtatcttcttaatctcctcaatccccttctcctcaaacacacccttatttctgatatggttatcaatcaggttgttgaagacttcgcaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctcaagtcaccactctttggttgcttaacatgccaaatgtacttgcatgaatattcaacatgttataccgtcggatctctgcagatattcgggttagggatccgatttttttctgcattttaactactatgtagagaaacatgccaaagcaagggagtttggggctgctgatttctgcttcatgtcctgtctgctgtctccattatagatcgttttttttcccatcttttttagtggaggagatcaattgatcagacggaacctagcgaaggctagaagtattcaaggttgaacagatagatacttcatccatccctctgaaaatatacctaatataaggtataatcattttttatccatgtctcgttatatataactctccaatcatattactttcatattatttgcatacatcgaggtgaccttactgaagagacgattaatttctttttttttaatttatgtgttagtagtgttgtgcgttatattttgggatagagggattatctatagctgctttaaaaagaaaaacagagaaaaatgggttaatttgatccatgcaactgcaagagtaaattgcaccgctagtgtatcaacttgataagtgggtgcaatatggtgtaagaacttgataaatgagcaatctagtgcaacaatttggtaggtaggtgcaatttagtataagaactttataagtgatcacataaatacaacaactttgtaaggtaggtacgattttgatacaataaattaagaagttatgtggcaactttattattgggtgcatatttatattggtatcataataactagtaactgaaaatcaattaaactgaatgtataaattattatatttagttgatatttgagaaggtgaagaaaacaaaaaattcttaaaaggtaattggatgtaaattatatgtgcaatataattcttaaagattacattcaatactataaggtaatatccgtaggattatgtaatgttatattgacatcgtgaaaaaaaaatcacctagcatatgcttagccaagttaatgcaccaaaatactacttcctccgttttatgttgtaagactttctagtattgcccatattatgtctagattcattaacatctatatgaatgtggacaatgctagaaagtcttacaatatggaacggagggagtaaattatcaagttcttgtattagaacgcacccacttatcaagttgttgcactcggacgttcaattctcaacttcttgcactatatcgcacccacttgccaagttggtgtaccatgggtgcaatttactccaattgcaaatatgtccatttcaaatatatgccattacaattcgtctattcgtaaccatgctaatgaaattatacaaaattgaaatcgtgccactgccgtcacattttccatcaatctcttttttcccgttttgtttcttctttctttcgtcttcttaccacaccaacgcatggcgggacctcggcggcccggcacgcacgaatccaatccgatgagtggcgggacctcggtggctcgacacgcacgccgtccaatgcaccgtggtctcaaccacatgctcgtggacgcggttgtccatcacgatgacgatctacaaggaaggggatacggggagaagggcatagaggaagcggggcaggcggggcagaggaggtgagttatgcggcaatggaagagtttccctgtcattgatcccgccagggctccatcgctggtggtgtcacctcgcctaaactctacccatatcttatgatagagagagcccccggctttaacagtggaggcggcggcaacgtaaagaagagcaaagatggtgtacgaccgcctcttcgtgccgctcgcgagacagtgggtaggcgccagcccctctctccctcgtcgcggttggcctgaagggctgcgcgagccttctcacgcacggtacggagcaaaacaatgatttttttaagtttaatagaatggttcacttttagtttttgaaaaataaatttaggttttctcttgaaaatattagttttttcacttcctattttcggtttagaaaactcaaaaataaaaatttagaggtggattatacacttttgttggtgatgctcttacgctattagggtgtgtttggataatgggaaagagggtgggattagaattgagaaatgaatgaaaggttatgattaaatggaagagggtgaatgaacggttagaatttaaagatatcttttggtaggtgaaaaattatttcccattagccaaacgctgccttaggtattacagttctaacgctcatatgctctatactatatgtctatatccaacggccctccccgatttccccgaaacgctactacccctccgccacagcgtccacacccgcgccgccgccgccctcaccctcgccgccgcgcatcccgcggtcccaccgtcgccgattccaccgctgccacggacaaccccgccgcccctttccttcctcgccgtgggagcgccccccccctccaggttggctagcagctagctccgccggccgcccttccccgatgggggcagcggcgtaggcgccgccatcagccgccgtacgtatgtgagcggcgcctgcgcacgcctccagctggtccgcgcgaggtaactgtgtggggtaaaattcctctctagtcttcgctttcgccatatcgcattttcgagaatacctaatgccgtagtaagccatacgggggtcgttttattgcttttatgcttaagtcacacacttcgagcaagtctattgaatctatactcgggtagaagtaatgcgcgctcatctccaacgcctattttgcaaaagaagaagaagaagcagaagagagaaacagtggcttttgtactactcttgcacatagaaccccttctcgacttgctatcaacagttggtttgaaacttagcatttctttgttatgcgcagttttgctgaaccagatgccgatgcagtgacgattcgttggccgaggatcgcgttcttataggcccgatttgcaaaggtactactgcagtggcggagcttgagagagattctagatggggccagctattatagagtggaaatgttggtaatggcagaagtagaatttgtagaagggctattcatattgtaaaataatttccaagcatgtttttgttaagaaaaaatatatgttatacctaagtatagctgttaaacaggtggaaaaggatcactcaagttataaaagacaacatatcaaagttattgtaaattaacaggttttaagagagctattttattaagataaaaatgtttgtcatccataggaggaaaatgatttagtaagcaattaaactgaagaaaaagaatggacttctcaggatttgaacaccaaacttccaagaaagcatctgccctcttcacttgctaatcaattgagcagaaaataaattttcttactagatacttgttaagtatatatgtgtttgctgccaaagctgagggggcaacacccaggttggcctccatgaagctccacctctgtactattagctgttgttggaactatattggtcgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42847 - DNA, 10125 bp, Oryza sativa
cagatgacattagcctcccttgccagggggctagtctggactggcacttgtctatcagcggctgaatgtggacctttttcaatctacctaccactaggggtagcccgaggtatttcattgggaagcttgtcaaagctgccgggaagatgctcgtgacatcagtaaggtcaatgttcccacaacgaatgggggcaatctggcttttgctcatgtttgttcgaagacctgaaactcctccgaaagctcgcaatatttctgtcagattcgtcatatcttgacactagggtttacaaagatggccgcatcatcagcataaagggaggttctgaatcttggtgctctgccgcgcaaagtagaaagtagcccaaggtttgttgctttctccagtaggtgatggaaagggtcaatggccagaataaagagcaagggcgacagaggatctccttgtctgagtcctctaccatgctttattggaattcctgggcaaccattaagaagagcccttgacgttgaggagattagcagatttgtgatccagtttgtccatctggttgtgaatcctcttcgttgaagaaggtcaatgaggtagtcccatctaaccgaatcaaaagccttggagatgtctaatttgagcagcaacgctggtgttcttgtttggtggaattttcttgccagattccgaacgtacataaagttatcgtgaatgctcctttttttaatgaaagcactctgagcctggcttatcaaggagcccatgtggggttggaggcgaagagcaagaacttttgagattagctttccgatgccatgaatgaggctgattggcctgaagtcgcctatgccttcagctccttccttttttgggacaagcaccacattagccgagttcagaatctgaaggttgttgcttcgcaattggtcgaaggagtgaattactaacatgatgtcctctttgatcgtgccccatcaagctttatagaaggctcctgtgaaatcatccggcccaggtgctttatccccaggcaattgttttaaggcagcaagcacctcctcttcggtgatgggcccgttaatcattgccaagtctacaggtggcaactgcagggcatcccaatcgaagtctaccaggcatggtggcgggcgcgctagaaaagcttcgaagtgatctttaatgatggccgctttttcctcatgcttgaatttccaaatattccccacgcggagccgttgaataaatttttttctccttcgcgcattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgcatctttccttgggagatgagatttctgctccaagctttcagtctaccagctgttgcgcccagcttgtggtagagtctgtgatgaacttcatgatatggagggctcacagcccatgcttgagcaacgatctcctggaaacctggaaggtgaatccagtagttctgaaaacggaaggttctagcgcgcggcgcgtctccttgtcccgataataagagggggcagtgatctgagagcgaagtcgagagcacatggaggaggtgcttctcaaaggcggtatcctaatttgggctacaaaagaaacgatcaagtttgaccagagtcgggttatcttgctcattgctccaggtatatcgacgattttgtagtgtgatctccttgagctcgcaagcgttgagggtttctttaaatattctcaattgtcgcaggttaaggttggcattgtttttatctgaggccttgtaaattatattgaagtcccccactaggagccacttggagtcgtttctaggcttggtgtctcgcaattcttgtaaaaaggcttgtttcgctctatctcttgtgggcccgtataccacggtaaggaggaaagtggtttgacactcttttaggagaacagtggcagtgagggagaaggtgcctaggacgaagttagagaggtcgacggtgtcttcattccagagtaccagtatacctccacgtgttccaaaaggccttgtagctggcttataattgtaagaccgtaggtagctcccaccgagagatccaacaatagctacatcaatattactcatttttgtctcttgcaggtaggcgatgtggggcttcgccgtttgcagcgtttctctaaccgttgctcttctacccggtctatttaacccatgaacattccatgtcatgatgtcaactataggggtatgacataattagcaagaactctattattaaagcagaataccctaaaagattgagccccaagtagtatgaggttttgacttggtctacgccaatcctggattgggccggtatgacggcctagcaatctcaaagcgtatggattggttttgtgggcctccggctgatttaaactaaagtggcgagggggcaggccggcatcgcgcggagacctgggctggtgcagcgtacacgggctagcggggagagcttggcctgcttgggatggcgaggcagaccagttgggcctgtttggccaagttgagcccgttcggcctcgtcgcaccagaggcgatcttcttcgcaaagtcgcaggagccggcgccgcatcagcgccgcaggcaaccgttcttcggcagcacatcagagaatcagctttgtcgcacgagtgggaagagggcacgaagaaggtgcggaaatgcggcaccgaagaatcgctagtgggggtagagccacggaattgctgcggaatagggatgtttccccgaatcgaagtgccgtcgctcaggacattcacgcgtgtccattcgtcacgccactacaaagctagcaaatatgaaagatacatggagatatcaatctcctggacatggagcgcagctcccagatcatgtcgccgccgccagttcctccctatagcaggcgtccgtcggccccaggtacttcgcgagcaccgcgtccgccgcctttgcatcctccctattcagaccgaacagctgctcgagggcatcgatggtgtcttgcggcagtggtgcgttgaacatggctttgaagtcagccactactttgtcggtgagagttccttcctccggcgtcaaccccattcggcggcacaggttcagctgtgccttcaaccccgacggcaggccgaccgttggttgctgggctagtcttgaactcctgtgcctgtcctgtcgtggcatgggtggaggcggcgtctgcaggttcacgtcggcacactgcaacggtggcgagggaaggattgaggggtgtggagatttgaagaggacacatggcatcgccggaggtacctgagggaagtcgactgccgaggtagagagcatcggcgtgtgtatcgccgcctcaggttgcacagtgggccccagtgttgcttgcagatcgtcgaccgggtcatttgcagcagcctgtcgcgctggttcagcttgctcggcatttgcaggatcatcaagagcgagggtgtccgtcggcgccacggggctggcagcagcaaaaggagtgacgacaccccctggcgcaacaatggttgctggcgctgacagcttgtcaatggcaatcgcaacccagccgccaggacgagctggcatagggccccttccgcagaggccactgagatggcctcttgtatgcgcgagaagaccctcgccgcgggattgtagctccccaaccagcggaccgggcttcattcccgaacccacggagcagaggcagaggggagagcgatcttggtggctggaattcccccgccatggcaaggccaggagagatgtcgttgtcgcggtcgccacccccgagatcgccaggctcctcgcagatgtcgtcctgtctacggcgcccatcacgccgatcattgccgccacggtcacgagctcttggcgaacgcgtgcgctcccgtcggaagtgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcgttcccggcgtctgtcagcgttgcgccgcacatcccggtcatcacggcgtccatcatggtcctctcgacgcctatcacgatccccgtcgtgctgacgccatccgccatccctggcggcagcttcccttgccgtcctgcttccttggtcgtgtggctccctcgcgagaccggcattgtcctctacgccctccgcccgcccctggcggaaagcataggtcgtcggcgttggggggtggtgagggaagttctcgaagaggcacggcggagcccgttgtccatcaagaacgcccagatgccacggagggagcgtacgtgtcgctagcctgcatgacttcggattgcggaggtccaccgccgccgccgtgtagtcgtgaatctcttcaatatggaacaacaccgggtgcttgacgccttgctgccagtgctccggtggcgtctccgagatggtgactgactcaagtagggggtcacgggtttgacgcgtgattgtcacccacacgcgcttgtcgatgcggctcgggtttggcatccaagcccatagggagatcaccctcgtgtcgccagcgtccacagggtggacgaggtccgtctccactgactccagagtgcaggtcctgctgatgatgcgctcggcgatgtccggcgcccacaggtgcattggcacgccatcgagacagagcttcactctgtacatgagggcagaaccagcggcgttcttcaggcttcgccattggatgaaatggacttctatcccttggcccttagcaaaacctttcttcacagcttcttcacagtgccggtgatgtttgaacttgaggaggaaggcctcccggaaatgcagtgacatcgcaatctccccagaacgcaggccgaactcatcagcgaggacacgctccacatccttggcggtgacagacggcggggcgcgcatcgcccaggtgatggccgccgtgctctcctattcccgcagctccgcgtcgatggcgtgggacgtcgggatgaagacgatgtcttctaaaggccttgtctcggggtcacccagctgcgccatgatgcccgaaggcggcggcggcagaaggatctctggtacttgacgccggtgaagcagaggcagcggaggcgaagaaggggtggaatcacggggtgttggtggagagcatcggcggcgaagtgtggttggaggaggatggcggaggagaggaggcaagggcgaccgggctctgttcttgctgggcggtgggcgagttggtttgggggaggggcagaccggggggcgaaaattgcagtagcgcgctctatggctagagcggttgcacacgaagcaacgaggcgggtcttggcacaccgaggcacggtggtcgcgagcgaggcacacaaagctgcgacccctggttcttgccttgaattcctccagcgagagagccactctcctgccagtaccgcggccttgtcgccatgaatcgggccggtggtcgggacttgaatgttctccccctctccgcctgcgacaggatctcaccactgtccatcccggctcagggggtgtgaatgctctgtgcagtgtcgtatacctaggaggggagctccttctttcttccatctcataggcgcggcggtaggcatcgcgtcgaggcgacggcatagtaaatgtagacttcaattttgcccgcggcggtggttgggcgggaggcgagcttgcgttgactctggcgggggagaggacgacctcagcaaacgagcgtgggcgagttggagttgcaaaggcaagggtgacgctggtcggtgaccaggtggagcgagctggagtcgcggagacgtgggtgacactatccggcgaccatggagggcggcgggggtggtggcgtggcctgccagaacttactaggggagggggagcccatgctgcggctcaggggaggggcggactgcggccaagagacggcggaaatgggcgcccaaacctgcgaccggcggagaagcgtgggcaccgtcggttggagcaccggcggcggcggtggtgaagcgcgctgcggcatttcaaaaaaatatgtgaagtggtggtaattcttcatagggcctaactagattatcctagctactagtgcgtattaggagctagaattaattcgtgcctagctgggttcactgtattttgacacatgggtgtttcttgcaaatttgatgcacccccgctgattcgtccacatttgtacctggagaggcgttgtgtggggcccacatcctagaacgcagacgggtccgtgatgtgtggggtgacacgtatataactcgagtcagtcaagctattgactctttctgattttgttttccttcttctttttcatgttattattgctgtgaactactactagtgagcatgaggtttcaacttcctacttctagtatttactactactaggggtgtattatgtttacatgtataagactagttctagtttgaccgtatgatagtacttccttcgtttctaaatattaaataccgttgactttttagcacatgtttgactgttcgtcttattcaaaaattttttgtgaaatatgtaaaactatatgtatacataaaagtatatttaacaataaatcaaatgataggaaaataattaataattatttattttttaataagacgttaaacatgttcaaaaagtcaacagcgtcagatatatgcaccagcggtccttaaacttgtcaggagatttcacttaggtacacgaacttgcaaaacgcacatcgagctctctaaacttggtttattgtatcatcctggtccaaagccgcatttgaccgtggtcttacctatgtggcacgccacatggacgatgacatggattttttttattttttcttccttcttttttctctttcttccttcttttttctcggcggtgacatgcggcatgaggggaggggctgtcgtggtggagaaaaaagaaggaagaatgagaaaaaagaaggaagaagggataaaaaataaaacaaatccatgtcatcgtccacggccacggtcaaatgtggctttggaccgggatgatataataaaccaagtttaaggaccttgatgtgagcattgcaagttcgtggacctaagtagaatctcctgacaaatttaaggaccgttggtgcattttactctttagaaacggagggagtatgatactatgtgtagtcaggtggtactagatcggtataggcttcgagcttctaacttccaacttttccgtcactgttaacagtgaaatttggtaagcccggagtagtcatcggcttagagtcagaatcggcttcgaagtcctaagattagttgatgagagttatcaagtcgtcagttgtcggattcttgctatattcggttaaggaaattgatctactaaaggaagtttatccagaagagatagagttcaaagagaatgcggcatggcaagttatctattaattagaaaattagcaatagtctgttagttttcttttatatttaggaaaatgtgtttagtgtcctataagtactttatgtttttcttttatctttagtttctttcttgtctgacaaggactggtatctccctataggtataaatatgtacacccagggtcattgtaatctatcaatatatcgatcaataaaactactctcggcgcatcgccaccctctataccgaggtttttacttatcatccgacggaacttggcacctaacgcggggctgcatcggctttcgatctccggcaaaggggtaagtcctacgttccactggccctagtgaatttgttggctacattggtgttgttcaaggctgcatcgcttcgatctcttggatcgctctggtttggttgatatatttgcctacctgatatctcaattctatctctaattacattgtgtttagagacgcatcggtttagttggaactgtctcggttaggtccgatcttctgtcttagccgatatatctctacaatcacaatgttgttctaaatagatttgtcatatccatcacattagatagatctatcggctcatcgagtattagattatcatatacaatctcgtgctgcatcggttaggttcaacctactagattgttattgataatatgaatcttgttaagccgataggttcatgctagtgttttatcggggtgctgctgataaattatctggacgttgcatcggcttataaggatttgcatatacatataagttggatttagtcgatgacaataaaggtttcattgatttatctaattgtttggattttatgacatcggacctttagctgatttatgctttaaccttcggatcaatgcttattctatcatattgtattgctagccgattggtttatactggattatattattgttatactatattatcatcagtcgattgcctgtatatcattattaaagacaagtgtcagactatacattggacataaagccgatagctcagaaccctatcgctatcggctagcatcggctatcggctggtatcggcatcggctggaactacaacatcggcttgtcagccgatcggcttattgatctactatttgcatatcttgtcagttgtagggtcaaactgactggcacgcctacatctcagtaacctttggacctgcactggagttaagcagatctcctaggccagtgtgtgtttttcgcatcaacagtcacatcaaatgtttggacacatgcatggagcattaaatgtggacgaaaaaaccaactgcacagtttgaatgtaaattgcgagacgaatcttttgagcctaattacgccatgatttgataatgtagtgctacagtaaacatttgctaataacggactaattaggcttcgatttgtctcgtagtttacaggcggagtctgtaatttgttttgttattagtttacgtttaataatttaaatgtgtgcccgtatacattaaatttgtttttgccaaaacaactaaacacggccatagtatcctctatcctggatggccgccatagtatcctctatcctggatggccttcttgtgaagacgccggccatcatcaacggtggagtccaccaacatagctttggagcttgtcactagcatccatgaccgattctcatgtccttcgcagaagtgaaacggatttcatcaacaaactacacgagcatatatagtgttgagctattgatggttttttttatacagaagcaggacacccggtgaaggggcccaccttgctctcgtgttgttaggagttgggcccatcccattcgactcccgtcccctatcattactgttcttctaagacgcatctgatttaggttattgggtgaactttatgataagcatatttctcgaactgcaacgatgtttttttaaaaaaaaaactttgcgtatataaatgtatttaaaaaatcaaataaacccatttttcttttttataatagctaatactccgtatttaattattcattcgctaatgaaacgttgtgtttttttcaccgatcagctcagccttccaggtgaagcgaacagtgccaagccggtagtgaaaattgccttatttatataaaaaaaaagtaaatgtgaatgcttaatttggtttattattgttttgtcatatgaaatagggctttgtctactgtcctcagaacagtatcgccgtcgtacgtagcaaatgaaaaatcaggatttgctaccttactgggatcaggccgagtttagttacaaaatttttcttcaaactttcaacttttctatcacatcaaaaattttctacacacataaatttttcaacttttctgtcatatcgttctaatttcaatcaaacttctaattttagcatgaacaaaacacaccctcgatagactcgaagtttcagcttaatttggtgcatggtcttgaccaattgacaagccggaagctgaag

SEQ ID NO: 42848 - DNA, 12906 bp, Oryza sativa
cggatggagcagatatcactactttccttgcaccaccctatataagccagatggaatctcagcattttttgcatgtgaatggcttagtttattttctgattggccagaggggttgtgtaaatgcagaggcaaacctttaagtgtgctgatgctttctcagttgttgtaaaaacaccagatgattcaacaacatattcagctccaaagtttccccaaggaatatctgagggatctctgaaatggaaaggagaagcaccaacaaataattttagcaaaactaaagcacgtgggagaattattacaacccaaaactatataacaagaatataaggagtcaagtatgtcaaaagtacaatttttaaacaaaaccgtggattcaaccagacctgaagaattcatgttcttaccttttgcttgtaactgaaattttcttcccattaatctccaaggttgactcatccacaacctttatggtgcctttaaatggaccatgtgtcgaatcatacttgaacatataagcctagaacaagaagaatatcacgatcaaagaacttgaaatagtctaaatgaaacatatgaagttgtagcactcaatacagttatgttcaaaaacagtttagtaaaggtgaacctgtcaattttctcattaagaataattatggttatctgaaattaacaaaatagtaaaaaaaaaaaagtgaatagcatgggttgggttcgtgttctcatgcaagacacacctccagcatgtaaaggaccttatataggaatgccttttctctttaagatcttatgtcagataatgataaacaaagcatgtttactaagttaagaagagctaaagagtacttaggcatattatcatattagagtaacaagcatttctactcaacatgtttacactgttatttgtagaaataatataaagatacattgaacatcatcggttccactgcaacaggacgtaatacatactgtgcttttccaaaatctatcaacagaacttaccatgtacttagcatcgataaaaggatcattaacagccacaacttcaatgtcatctctattagttgcaattcgtagaaccaacctcccaatccgtccaaatcctgcaataacaagaataaagagttcctttacaaccaaagactaaataaagatcaaaagtaatttaaggtcacctacagaagcaatgaagttgaacaagggttcacttcaacgttccaagttgagttagcatagcgcaacttccaaatagtaatcatacattacaacaacttgataatgtcattatttttccaatctacaggaggaactcaccattgatgccaacctttgtcttctccgtgctagaagattctacataaagaagaaaaaaaaataatcataacaccactgcagtcctcataaaccccttttagtgtttgatggatggagcaacttacgatgggtggcaaggggtgcttgtgtagcagttgctctcaccggctcaacgctgctagcactgcagtagaaaagcagtttattgaaaatgcaatgtgctacagctaatactgatcaaccgtatccatgatatgcacagagcaaaaaccacaaaaacacaagttgagaaaacgaggggtcaagtccgttttgctctcagaaattttccgctctaaccaacagctgtgctctcggttgtcaaattttgttattcaaggaattcgaataatctggatgatggaggcactcacagtgaagacgaagccccaacggaaggaaaaccgcaggtaaccttgctcctaacgcacgacacctgcaacacagcagcaacatcgatcaatttggtggaaatttagcaagtttcaatctgcgaaatcatggctaaacaaacgcgaacgaatctcaactgaactcggaaaatcaagcgaaatacaagcaattaaagtgggaaacagctgagtgttcactacaatactccattactcctacacatagaaacaaaaacatcgccatacgaacaacagtttcatgcgcatgagttggcagctgtcagtcacacgaaacaggaacaggttctcaccgaagagaccaaaaaaaatcagagagggagagagatcgggatggcgaatggggaccttgacggggtcggcggcgcgtgatccgccgccgctgccggtgccggcgatggccggggtggcggaagcgcggagggggacggcgagcgacgccatgcaggtgcggcggcgctggaaacttggcttcctctaaggaaggcggcggaatggaggcgggggcggaggagacggcgagcggagttgtgcggcggcgggggtcgtcgtcggcggcgtggttccgtgatgcgtctcccggtatctcggcctcgggcggagttgtttatggctttattattacttgtaggttttttttctttctgtgcctcttttgttttatcgcctcatcttttaacttatacttatacttataaacataagctacaattaaaatttttaatcttaaatttaaatttaaagttgattttagaattttttttaatttccatcctagtttatttttcagcttaaacttttaatcttttagatttttagattgttaataacatgtatataaaaattttatttacaaactattttctatttgtaaatatgttatttcacaaaactatggagtccttagtttgttctctctttacatttgaaaaacgtgtgaaaatatttttattgaggattgactccgataatcatttacagttaggatcgggtatatctatcagacactgttagtacagtacaggtgtagttttgcaaaggatccatatcagtaaattttggaaggaaaaaaaccaaaaagagaagtcacgtgcttttcttgtgaagcatctactacacattttgtgagcgactcatgcattctgttgtaggttcttcaagaacttcgtatgaccatggacatttaaaacttcgtatttcttttcccttgtgttcgagaatatttggaaggagttattgctcctttcggtgtatgaaaacagcaaagaataagaccaaaaacctgcatatattaaaagcgcgaggtttaacgtgggcctacacgaataattgcacagtacctttcacgaatctacggtttgtttggtttcggtcaggagacggatcaggcgtcgcgaaacgtttcgttgcatccgtccgatctgaggcgaggcgagcccggcccggcccggcccaactgttcgtcggagctacccgcctgggggcccaccctcagaggcgaatatgccaaactttgatgcggacgagtccttccctgtgtccgccgtctccatcgacacaccccaaaggcccaaaggtgaccccaaatactactctacattttgaaactgtggggtaaatcactcaatgtcttcacttagggcctgtttacttggggaaaaaaaaattttaggtgtcacaccgaacatttgaccggatatcggaagggattttcgaatacgaatgagaaaactaatttcataattcgtctggaaaccacgagacgaatcttttgagcctaattaaaccatcattagcacatgtgggttactgtagcacttatggctaattatggcctaattaggctcaaaagattcatctcgcaatttacacgtaaactgtgtaattagtttttctttttattttatatttaatgctccatatatatgtccaaagattcgatgtgatatttttgagaaaagtttttgggaactaaacagggccttaatcagactatagaggtcctgtttagttccaaagtttttttttctaaacttccaactttccatcacatcaaaccattcatacacacacaacttttctatcacatcgtatcaatttcaaccaaactttcaaacttcagtgtgaactaaacacagccagaggctcttttttttccctaataggtccgctagttcaatcccaatagctatgatccttccttttaaaacatggtataaacacacgtactcacaacacgagcgcactttataaacacacagagacaaaacaggatgtgaagggagattgtgaaacgagacgaaacgatggtcgggtaggcaggcgccaggcgcgcgggagaacggttggctagttgaggagggtgtgaaataaggatgttataatttattattatattgtttttaaatatacatgtaggacgtgacgtttgactatttattttatttaagattattaaatattgaaaaaaataagtcattgctgaagtatctttgatgacaaacaacggattaatacttaaatagattttcaattagactaatgataaaatagcatgtctaaatatactagcttcattttctaaccatagttattttctatatgtccagtgtaatacttaattatcacatcaatcacgtatatgtaaatattttccttatgttatctcaaacaaagtttcctcccaaccttcatttaacgggtagcattacaaattatgatagaattatcttcaaaaatattgtaagttttatagtgggacacttttaaatataactacattatatttataatataattccaccacaactatacagtaactacaatattagttgtatataagtataaaaaatatatgtaaatttatacctaagttatatgacaacatatcctatgcacacagtccttcacgtgtacacacgtgcacaccaactaaaaaatgtcaccaaaaaatctagaaaaatcatacacatactttcaattgtattacacttagggttaaaatcttaacgtcaaattcattatattttagccataacaaaaaaacaaaaaatctgacagttttaaggttgtaattttgtcagaattttatcttttttttattctctatgtagaatgaatttgaagatatgactttgcacgtagatgtaatactattaaaagtacatgtatgaattttcctagaattttttgtgataatttttagttggtgtacatgatgtgtacacgcgaggacctgtgtgtataggatacgctcccaagttatatagcgattataatgtaacaacagtataattacgttgtagttacactacttacattttaaagctttttgcgacagtttttagcaatttttttgttaaatcctaatctcacttaaacaaccaaacaatatttatatttggaaactgagagagcagtatcaaagcttgccttgaagtcaaattttgtatcaaataatcgcccgtaattacgccgtgccgtcaatcaaatctggcgagagacgaagcgaagcgacgcacaaccaccactccaccagtgcgcgcgacttccgagacgaaccgatctgacggacggagagaacgccatcctcgatccaacggcctagatcctccctagcctcctccgttcccgtgtcactataatggcaaggcacacacctcgtgccacacacaaactgcaaccaagaactgccgccgccgccgccgccgcctgtgacctctcctctccctccggcgacgtcggcgaacactccgtcaccgatgggcagcgcccttttctccaccattgccacctcggtggaaagcctccgcgtcaccggcgccaacgccgacgtggacggcgtcgccgcggagaagaagccgccccgcaacgacaggaagaggaagaggaataagggcgcgagcgggaggacgtacgaggagacgcgcgccaggtacccgctgctcgtcgaggcggtggaggcgctcgccgctgccggcgagctcggtctgccgccgccgccgcacgtgcgggggcaccgtctcctgctggaacgcgtcagcgaggacgacgcgcggcggctcgagcgcaagctgaaggtggaagagctcgcgagggggaagttcgagcttcgccggcggcggctcaccgcgtcgttgaaggaggcgctggtcaaggccggcgggcgagcgccgaagcttgagacgatacaggaggaggaagacgacgacgacgacgactcccacggcgacagcaagaggaggaggaaggcggcggcggcggcggaggaggaggagtgcgggcgcgggaggcggcagtacgaggagatgcgggataggtacccgttactggtcgcggaggtggaggcgctcgccgccgccggcgagctcgcgctgccgccgcacgtgccggggctccgccgcctggtggagctcgtcggcgggtgcgacgcgcggcggctggaggacatgctgaagaatgatgcgctcatgaaggtcgtgaccaacctccagcgccggcggctcaccgtgaatttgatgtctgcgctgatcaagaccgaggagaagcacaaatgaatccggcgagccgtcgatcgccggtgcaatgcagcagtacagctccagtgttttgggttttgcagtaagctcacgcatggctgcttaaactaatcagtatcattagacaataatgtagtatataatagactggagtagtatcttggaagaagaaccctaaacccttgtttggactttggatagtggagggaaatttaactgaaatcccgggaaatctgaatggattggtctgattgatccccatgtatctggagtattttttatggcagcattagctaatcagcttagtggtggcaaactgaacttttggccatgcatgtcatgtgtgataatgttggaacttggaagaactcaattatgttgatgttatgatgcttgattagaacttggaagaactgatggcagcattagccaattagcttattagtaagtataatgtcaactttcagaacctgaataactcctaggtcctagctcaacagtgctgaaaacctacaacttgattaccagttgacacggctaaacttcattggtttggtttatggaggagcatcaatccccatatttctcaaccgttgggcttggaaaattgaattggagaggttcaagtgtccaactcaaatccctttggtttcgcagggatagcagtagaaggttttcggatttttcataatacctatttctatacaagcttgtaggttcatacgattatatattggcagcaacagaaataaactcatatatgttttgtttttttgttttttttttttgtttttgctgtgttcttaatctgatccgcagttgcttcccatgtcaatccaccggatagtccagcatatattgtttactgtgaacttttgattttttcagatatgtactgcttcatggccaagctcaaatttaaatcgtgaatgttccagtaggtcgagcatgatcaaaacaccacttcatgtatctgatatatgcatccaaacttgaagttcaatccatgttgttttactgaccattttacacttgtacttggtgaactgaaccagagttcctgcatggtcttgttaacagaatgtgaaatatctaaacattgaaaatagaaagctagaatttacaattctttatagcactgctcaattgctcattgttgggagagagataaaaggcttacatatttgctcctagtattgggcattgtctactcccctcttcatgcatcagggtattttggcattgttctgaaacaagaagcaatcttcagtccttcacaatcattttctccaataacacagccttcaactactccttcatgaacagagtctccagtgttggatcgagctgcattgccattggccaagctcggattaagatcacgatactaattgcactcggccaaaattccacttaatgacaattcattcatacggccaaggtcaaagatccggggttgcctggctgactctatttaggtctcattacccaacttgcttgttagctactgaatgataaatcaaattgaaaggcaaaacacaacatcaactacgtgaaaaataaaacaagcaagcagaagatggattagatagctagctgggcgcggctgcttgaagttgatcagcgtggttccctacttcattgcgacaaggcaatgtgacgacggaggttcaaacgggtcggactttttttaactccgaacccctcctggtagagtggtaggctggggccatctcatggcccaaatggagatgcatttacatgtagatgggctgggattccggcctggtaaggcccaataagtagcccaatatctccatacccttcacagccagccgcactaaaatgtgagtcaagtggcctcaccaaataaattgtgcatcctttgtgtaataatttattttcagtgtttctgaacctctttttcatagtataattgcagtaatatagactaaatcagctaagaattttttttaaaataagcttgaagttgatcagcgtggttaacaactacgccaagacaatgaaaaaacggaggctcaaagggaattggaattcggagtttacgactcttggtcccgtcgcatggcccatatgaaataaacatgtggatgtgccaggtctcgggccctggtgagtcctcaaggcccaatatctgcctctgtttcaggcctcaattccatagcccatcagtacatcgcctccacgaattcacagccgcagacgcgacgcgatccattcgttcatctaccatttcatgtccgaagcatatatactatatagcagttaccgttccgattctgggaattgatcatcatgtcggcatccatgtcagccatcaggctatgacaaaagccaaaggtaattaacataccctaaacatggcagtttaaagtggctgctcacactgacgacgacgaatctgttgacgatgaatcttactaatttgtgaattaagtgacacagagagtcagctgcatgcgtgagaccatgtgatagatcgatgttagatgcatagtagcttgcaagttggggaaatgagcaccacatgaaaagaggtaaagctagttagcatgtgtagcttgaatgcttaattagatgcaagagtacgtaaaggcaacaaaatgtgagattatcatattatattcctagattatataatctgttctagtgtagcatttgatggattcatcgtcagtgagccaatgatagatcgatgggctctacacacaaatcttgtcggatctcttgtcacctatgtttatctagtgtaggtttacatacagtccggtggctttgttaatttattcaatgatgagtagtagcctttatctttaagcaacaggacacttctctcggcttcccgctggtgttctccagttgattttaaatttgtatacgtctacgagtttttagctagctcgtctgcagggttcagtattttgattgagcgccggatagaccttgaaacggcatggagtcttttttaaaaaaaataataataatcaaattttgatatacttcgacttacttcgataacattatggtcaattatactgtttcaaatttgaattctcgaaaaccatttgaaattttaataggaatctactttcggacggtgtcaaaacctcaaaatttcacaattttcgatcacaacgtgaatcctggtcatctgcagactgcaggcatatggtaaaaccgtgatgacaacaaaacgtactacatagtttatggtgtttctgcaaatgagccaaataatgtgtgatcagctatagttaattgttcattatcagtgtgccaggatttttattaaaaaaagatgaagccaaaaaagggatcagaatgttgactagggccatgagtcatgctgccgtggtagtagactggtgagttggtgagtcgcaagtcgcaactgcgcgtgcatgtgacgaggcttgtgggagagcctccaaaaaccatgtgatccctccactgttcccacatggcgagcacgcagatttaaaacgctccgatgagatttaaaacgctccaaaatgtttgtgttgttccgtggagcatgttcttctgaccggtcaaatcgtacgaaaattcactagtttttgctgccaactatgggtacatgtgtggtttgcacaccacagcagaggactgtgtacaaccactagtaagatgactttattcccgctctaattatgatttgtgagcgttttcttgtttcctgaactaaacaaggctagctaggtaggagtaggccggattattcctccgttcaatttatttttctcagaatgttgggggttcctgaaacatctcaatcaaacaaaactaaaggaaacttattacacagtgacatatgtgcatgcatctcatctctctatgtctatgctgtgttttccgaccgttgtcaccgttgtgggccacaatgctcactctttgtgggggcagaatcgatcgataaaaagctataaacactatcggatgttcagcacacgtatcaacggatactatccgtcgcatcactgttgacaagtcacaacaacaaatgctgagttgttgcgatggcgatcgatctggcgagttgagtctcgcgtcgatcgatcggccgcaccgttgtgcttttgtccctgatatacgagtctggtaggcttcggatccacatatcagtgacaaatgagcgttgcaatcgactgcagtggatttgatctcctttaattttcggacgcaacgggcggcgcgcgcgacattggcacggcagccgcgcgtggctccgacgctcgcatgcaccgacccaccgccaaatgttgtactacagtagactactccacctcggtacgaccaaaaaaacgttggccgatgtctctgccaatctgccatgcgtcaaggtgcacggttgtcattgtcaacaagtagtgtcgtagtggtacataccgatgcaggttcatgcatgcgtgatttcttggttttgtttctccggtaccactacactcgactccagctgccggcctaagctttttttgttggagaagctagcatagcccacaggttcccttgattcctggagctggctcatccagagccagctgctccctaatcatcatcacttacattattctctttaacaaaaaacaaaaacaaacaaatgatactccatatatactactagtactagtagccatagtactgttgtagtagctacaaagagaggctcatgggttatccttgtgtttgaagccaaagaaagaaacttaatcagagacgaacaagccacaccaactttacactggtccccaagcccacatgggccaacgggaaaccacttcccactctcccactcccactccactgccccactcacctctactcctataaaatctcaccgtccacatgtacccgagacctcgaaccatccatccatctatccacccaaccactctctcgctcgctagctcatcgctcaccggccggttgagatggcggcggagggcaatgcgtcgtcgtcgtcgacggcgacgggaagggggtgcgggctggcgctggggaggttggtgaggaagctgaggaggcagagcaggatgatgctgtccacggcgacgtcgtcgcggccgccggcggcggcgaggtgccagtacgacccgctcagctacgcgcgcaacttcgaccggagtggcctcggcgacgacggcggcgacgtctccgcgcagctctaccaccgctacaccttcgcctcccgcttcgttctctcctcttcgtccacggccgctcgccggcagccgcaataggggccgagaccgatgctagctgaggcacgcatggccggtctgcgcgtgccagtgctgcgcgtagctaagctagctagcttagctctagccattagaggtagatgcactcttgttcttcatcctgcagtgttgttaattaattagtgtgttcatatgaggagggagtggtggttgtaagggatttcttccatggctctctccattggccgagatgatggtttcgatctctcgtgctgatttcttggaaatccatgcacattattcctgatataaatcgtcccattaattcctttttttcatgaaattctgaaattggctgattaaatcgccgagatcaagaaaaattggatgctcgccaactttgtagtagatgttgtgttgattgcatcattcaggctacaatagttgttacggcgtcgttgcgttgtcgctgcattctacagtagtcggtcactactactactcactagtgtcaccgctgcgccacagcgattattcgcacgggacccctgtgcccacgggtgacggtgccgaccaccggcgaggacgcgagatcgatcggtgctactagtaaataaaatttcacattttcactgctcctgcattgattcgaggagcggaagggctcgaagaaaaaagagaggaaaaatagagaagaacggttgctctgtgcagcaaatttccaacgacggaaagcaaagaacttttttttagaatcacagtataaacgtgtgcacacttaaccgtatgaatgtattaacatatatacactaattgacattatactcctactactagatttttcacgtacctgatcttgaggcccaatcgtttgccaaattgaaaacccaagtccaattataggccaggccctcttgaaggtgcagacttcagaggagactgcctgtttggggttaggctctactaatggcccattgtacttatcggcctatagcttttggcccagttctccatcgcataggctgaatatttctgcccaaagtatcacggtgatccaacaatgtaaaaaatcaagaaacaccacgagcgtaagtctcttcgctcgagaatttcgttacagccttacatacaggtagaccttcttcgacagtcaccaacatgaacacagacatgggttttttttcattgctccttccatgattactcgcttaattagtacgtcaacagaaataattttttttagacaagtacagcaataatattttgttcctagcagttctgaacatgctatgctattgggatatcaccacttcagcaggttggagccaaaaaatctggatgatgcctcaaaattctcca

SEQ ID NO: 42849 - DNA, 13727 bp, Oryza sativa
tgatcaaacagatataggaagtctgactccggcactttcttctctttgaaaccaagatggagcgaagtagaggaatacaaattattatagtcatatatgttggccagattcaaagaattttcggacatgcaaaggcttgagacaaggggatccaatgtccccaattctttttaacatagcggctgatatgttagccattcttattgaaagagccaaagccgatggccaaattagtggggtaattcctcacttagtggatgatggtttgtccattctccaatatgccgatgatacaataatatttcttgaacatgattttgaacaagcaaaaaacatgaaggccattctttgtgtgtttgaacatctctcggggctgaaaataaactttcataaaagtgaaattttctgctttgggggagctaaggaaatggaggaccaatatagacaactgtttggttgtaattctggatcctttccattcagatacctaggaatccccatacactatcgaaaacctcagaaattctgattggaaatgtgtggaggataggtttcaaagaaaacttagcacatggaagggaaaaaataactcctatggtgggagattggttcttcttaactcggttctttcgagccttcccatgttcatgttatccttttttgaaatacctctagctgtacttcaaatactggattactaccgatcgagctttttctggagcagtgatagccagaaaaagaaatataggttagcaaaatgggattatatatgccggccaaaagatcaaggtggactgggtgtcctaaatcttgatatcatgaatagatgtttgttgagcaaatagctattcaagcttcttaatggtgatggcctatggcaaaaccttttgcgcaacaagtacttaaaaggtaaacccctctctcacatgtcacacaaaccaggaacatcccaattttggactggcctaatgaaagtaaaagatcaattttttcagtatggatcttttaaacctggtaatgggatagaaataagattttgggaagacacatggttaggcttgcaaccactcaaatatcaatatccttctctgtacaatgtggttcgaaagagacattctactttggcagaggttatgagcacaacaccgttgaatgttttattccgacgatcaattgtaggaccaaagttagttgagtggaatgatttgatttctcgactagctaacataaccctgtcaaatgaaaatgattgctttatttggtcgctacataaaaatggccatttttcggtcaaatccatgtataatgcgatcatcaattccaatgtaagaatccacaagaggatcttatgggaggtaaaggtactactaaaaatcaaagtatttatgtggttgcttcacaaaaaaagtaatcttaacaaaagataacctcataaagagaaaatggaggggaaacaagcaatgttgtttttgtaatacacaagagaccatccaacatcttttctttgactgtcatgttgcacgttttgcttggcgatgtgtcttctttgccttcaatattccccctccccacaatgcaaaagatatttttggtaactggctaaggggagtgcctagacacacaaaaaaatgattttatttggagctagtgctctatgttggtcaatttggcgttgccgtaatgatatggtttttaaccataaaaaaatgcctaacatcatgcaggttatattcatgtgttccaattagctccactcttggtgtatgatgctttcacaggaacaacaggatactatgcgtaatggtgctacacgcttgaaattggtagccaaggaacttttactccggtttggatggcgtagtacctacagaatttcgtgatagaatctacgtgatttaaaaaaaatatgattttagtatatcatattatcggcagaagttggggtttgtcctatctcgtttttttaagctcttttctattcacttctggactttttggctgtatgcctgcccggagatgtaacccatttccattatcttaaaaaaaatgttggccggattatgatttccgcagggtgtatgaacaattttgcttggattgtactcgcaataggtgcatcgacctgattacagagccaaaataaaatgggaggtgaggatatacaatggagatagatcggtgtaaaaagtctgataagagaaaagtatagatgccatccaaaattagatgtatatgattgctacattatcattgtattcattttaaggcaaaaacagaaagtggatgttactgattttaagagccatagcacacgattggtccactaccatagtctgttaaaattaattgcattttgggccacatatttctaccaaaaattcactttgaaccactcttgaagtgcttttttaactttagattaggtatttttatcaaatgttattactttgaattgggtggcccacatgtcaataagactaaccacctctattgtctatgtgtctcttacatgcgggccacctggtcgaaacatttgacaacaatatttagttcaaagtgaaaaaaaacattataaaggtggtctaaagtaaaactttagtaagaatatgtagcccaaagtacaatttacttctaatttaatttatgttgacaaaattacatatatttaccaactaccatagctgcacttcttcaacatagtacacaatacattaagataatatcgtaaagggctcagtgactcaccgaaacatgtatagtaatcttttgagtttttttactagtgaagcccggtaccaaatgtggaccgctggataggtatgatcggatggctgacatcaattggtaccttcaggtaccatttactccctacgtggtacctgccaaaggggaatgaggtggaggggtaaaattgtatttgcacattggaaaggaatttcgtcgatttgattcgtgttttggataaggctttgcagaggaaaatctacggcagtggcggcgagccggcgacgcttcaggaattacggtgcgctccaccagtcttctgaggccacaacggtgctccaggagttgttgtcagcggcgacaacggcagcattccaggagttatcggcagtgacggcggtgctccagggatcatctgcaactgcggtggcagcgctccgataattgtcttcggcgacgacggcatcactccacgggtcattgctagcgacgacgatggttgatttggttgaacagtttttgagcaagaaagatacatacaggaataaattgagaagcaggaagttccccgcaaaaaaaaagagaagcatgaagttgatttgcctaaatggcttcaggttgatttgtcagacaaacacaaaatcaatactcatgcgaaaagctccaacacaacctccattccggaacaattatagggtgcagactacagcggcggtggcgacaaagtccggcgcgtcaggatacatgttgcggcagcgtcggccatcggccccactgtcgttgccgcagagcaaggacacgctggggctggggggaggacaggcagcagcgacggcggtgacagagacgtgcgcgacggagcgagctgaggaacgatgtcatgcgtcaaggagagcagaatgcgacggcagcggcgactcggatatgcctgtgaagatgaggagatttcgtcgtcgcacgctagctggctgctttacttcatttccaatcgtaccccagtttattgaacggccggatttcgtttggtacctgtggtaccagtacctggaggtaccaacttctggaccagaacaaagctcgttcctgcagcagcaatcacaagttcacaatccagtggatgaaaaagaaaagttagtcaaataagcaatcgaaaatttgagcaggagttcaaatttgttcccaatttgattacccaaggatgttgtctgcaataggtgcctagcaattcttcaaacttggcaagaagaaacttctctcgcttcacaaaggctgatctcaccgttgatatttctgacagggcttgtgtattcagtgggttttcagatgatgatctctttcttttcagtcctcggattggctgatgtccgtggatcatcgtgttcagcttctcccaatcaacgtcagagatcacgcagccggaggaaccgaaatctcgcgcgggtttcagccattggcgcaggcagtcgaggttctcgccggagagggagacgaggaatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctcatgctccgagatcggcttgccggcggcggcggcggcggcgcggacggcggcgacaaggccgtccagtgaacggcattccacacggagcatggcgtcggtgtcaaagatgtctcccggtaggtcagcctcgtcgtcgggcggaggaggagcggcggcgtcgtaccagacggtgttgaggatgatgttggaggcggggtcgagagggccgtagcagtgcccggcggcgaggagggagcggatgaagcggccgcgccgccgcgtcgtcgtccaaccgtcgccggcggggagcacggcgagcgcccggatgtagaagccatggatggcgtcgaggaggcacatcttcagcgacagaatgtgctcgcatggggagaggtcgtagttcagcgctgcgccggcagcctcgtcgccgtcgtccgccgcgcgcgtcacacccgccaagcgtctggacagcttcgcctccatggtttcgcaatcgaacgtcaggtcggagatgtacccgagttgaggagagtcgatgcggcttgcgtctgcagcgatcgtgattagggcaacacggccatcttccccgatggtggttcgaagcgtcaccgtgccatcttggccgccgccgaggccgtacggacggcgcaagaagtctatgttgacctgcggccattgatgacctagcaagttcttgatgtccatgacgtcgccggcggtgagcagctcgctcccttgcagttaggccatgataggggagagctgaccggcggggaactgcgccgtcatgaggcgcgccagctcgtcgagcgcggggtgcgccgccttcagcgccgcgaccctgagcgcggccttgatcttgccgccgtcggggagcaagcgtgggcgctggcaccgacgacggcggtcgtggaggacgagcctgacggcgagggggaggtcgatcgtgggcggcgaggtggaggtagcgcctagcctgttcgtcggagatgtaccggaagtaggacgacatgaaggcgacgaggccggcgtaggagcgggcggcgaggataccccacagcgacttgccttcctcgcgagggagggcgaggtgcggcgccgcggccgccctgccggaggcgtggtgggcgatggcgttgaggatgatgttgccgacggggtcggcgaggccgaggcagtggccgccctcgaagatgcagccgacgagctccgtgatctcgtcgatcggcagccgccgcgccgcctcgtcgtacaacctcttgatcgacgtgatgatctttgcgctctcgtcggggtgaggccgcttcccctcctcgccatggtagcaggcgaagctgcccgtgcccgaccatggcggcgccaccaggtgatgatgggacgaggaggaagacgacgacatggagcccccacgagttggggattttctttcctccaagatttgctggtccaattagtttttttattattatttttgccctcgatccgacggttgctataaatcggtttaatgtggagaaaaaaaaagaccacttccttatatacttatctgtaccataatatcggatattatgaaccctcgactattaaaactagtcaacactgtcgtgtaaacgtcacgtaagcgaaaccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaacttcacacaacaaatttgcatactgaagaagataaaaaaaaaagttcgatagattcatcgctcatactagcaagcatggcaatgccagttggagttgcaccggtgttgttactgttgcttttgccattggcggcggcgacggcggcggcggagagtgacgacagggacgcgctgatggcgttcaaggccggcgtgacgtcggacccgaccggcgtgctccggtcgtggaacgagacggtgcacttctgccggtggccgggggtgaactgcacggcggggcgcgtcacgtcgctggacgtgtccatgggccgcctcgccggcgagctctcgccggccgtcgccaacctcacgcggctcgtggtgctcaacctcacctccaacgccttctccgggagcatccccggcggcctcggccggctccggcggatgcggtacctcagcctctgcgacaacgcgttcgccggcgagatacccgacgcgctccgcaactgcaccgccctcgccgtcgcgtacctcaacaacaacaacctcgtcggcggcgtcccacggtggctcggcgcgctgcccaacctcgccgtgctccggctcagccacaactcgctctccggccgcatcccgccgtcgctggcgaacctgacgaagatctttcggctcgagctcgaccagaaccttctggaaggttccatccccgacggcttgtcgcgcctcccggcgctcggcatgttagccttgtcgcagaacagcctcgccggagagatcccggtggggttcttcaacatgacgtcgctgcgtggcctcgcgctcgccgacaacgcgttccgcggcgagctcccgggcgacgcgggcgcgcgcacgccgaacctccagtacctcttcctcggcggcaacctcctcgccggcccgatctcggcgtcgctgtcgaacgccacggcgctggtggctctcagcctcgcgaacaacagcttcgccgggcaggtgcccggcgagatcggcacgctctgcccgctgtcgctggagctgtcgaacaaccagctcacggcgaccgacgacgccggcggcggctgggagttcatggacaacctgaccaactgcagcgccttggccgagatactcctcgacggcaacaagttcgccggcgtgatgccgccctccgtcgtccgcctctcgccgcagctcgaggcgctgaaccttgccggcaaccgcatatccggcgtaataccgccggagatcgagagcctcgtcgggctgcaaacgttgtgcctccagtccaatctcttctccggcgagatcccggaagcgatcggcaagctcaagaaccttcgagagctgctgctagagcagaacgaactggccgggccggtgccatccgccattggcgacctcacgcagctgctcaagctcgacctgagcggcaactcgctgaacggatcgattcctcccagccttggcaatctgcatcagctgacactgcttaacctctccggcaacgagctcaccggccatgtcccgagtgagctgttcaccctctcgtcgctgtcgctgctgatggacttgtcggacaaccagctggacggcccgatccctcccgacgtcggccagctcacgaagctcgcgttcatggcgttgtcggggaaccgcttctccggcgaggtgccgaccgagctggagagctgccagagcttggagttccttgatttggcccgcaacgtgttcgtcggaagcatcccgccatctctgagtgggctgaaagggctcaggaggctgaacctgacgggcaacaggttgtccgggagcattccgccggagctcggcgggatgccgggactgcaagagctgtacctctcgcggaacgacctgtccggcggcataccggcgagcctcgagaccatgagctcgctgatggagctcgacgtgtcctacaaccgtctcgccggccaggttccagtccacggcgtgttcgcgaacacgaccgggctgaggattgccgggaacaccgcgctctgcggcggcgcggcgcggctacggttgccgccatgtccggcgccgggcaactccacacgacgagctcatctcttcctcaagatcgctctgcctgtcgtcgcggcggccctttgcttcgccgtgatgttcgccttgctccggtggcgccgcaagatcaggagttcgagaaccggaaacgccgccgctcgcagcgtgctcaacggcaactactacccgagggtcacgtacgccgagctcgcgaaagccaccgacgacttcgccgacgccaacctcgtcggcgccgggaagtacgggtcggtgtacagggggaccctgtcactgaagacgaagggggagttcgcgcgcgaggacgccgtggtggccgtgaaggtgctcgacctccggcaagtcggagcttccaagacgttcatggcggaatgcgaggcgctgcgcagcgtcaagcaccggaacctgatcaacatcgtcacctgctgctccagcatcgacatggagggcaacgagttcagagctctggtgttcgacttcatgcccaactacagcctcgataggtggctgcatcgtgcgaagcatacggagaccgggaaatggtgcggcggtgccggcggcctgggcgtgatccagaggctcgacgtcgccgtcgacatcgccgacgcgctcaactacctccacaacagctgcaaccctccgatcatccactgcgatctcaagccgagcaacgttctcctcggcgaggacatgacggcctgcatcggcgacttcggcctcgccaagctccttcttgatccggccagccatggcgccgcggcggcgaacaccgagagcaccatcggcatacgcggcacgattgggtacgtcgcgccggagtacggcacgacggggatggtcacggcctccggcgacgtgtacagcttcgggataaccctcctcgagatcttctccgggaaggcgccgacggacggcgagctccgcgacggcctgacgctgccggagttcgtcgccggcgcgttcccggacaacatcgaggagatcctcgacgtggccctgctgctgcaggccgaggagctcgacggagcagcgtcgtcgacgacgtcggaggaggagagcgaggcgcgcgtcacggtgcgcgattgcttggcatccgccattagggtcgggctcagctgctcccggcgagctccctacgagaggatggccatgagcgtcgccgccgacgagatgcgcctcatcagagacgcttgccttcgtgcttgtggtaaataagtaggacagtatactgattatttgtagaactttgacagccgaattagtcgatggataattattactacgtcatcggcatcgaattctatcactattcgaggcttcgagcaagctgttgtggagtaaaaaaaatgaaaatgtaaaatccatggaattcaggagctctgatctcttgatttatctagtgtactgtactgacagaaaatggatgtactctgcatattcagatttcagaatagattgttctgtttatgtccagattccagaatataatgggcctgggaaattgatcagtaactgggcctaaataggcctttagactgaactagtcctgcctcttgtttatttggagtagtctttgtttcgcagtagttttttcttttcttttacctcttgtttttttttctttcttcccctccggcataggcctggccgattgtattgtataactaaaactctttttcttctaatatattgacgtgtaattctttcgcgcgtttgagaaaagaactagtggctattgctgattcatcctcttgctatcgccgttgctgaacaaagtgtgagagcataagaggaaaaaggagacgttgcgttgtcacttgccattgccagcgtgaaaccgttgaagatgcctcataaatgcgacggattaacagtttattagcacagcactggataaattggatatacgtgcatacgatggcgtccatggtttgcttgcttttgctgtggataagttggtcactactccactcactagctgcaaaaaagcaagggaaaaaaaaaaggtaattgcaatgtgctgcgtacgtgcgcaccctggatggtgatgtgcttgtttaccgtaggaggagcatttgcgaattcgttcttatcctagagaaattaatcgagccatttcacgctgtcaaggtatatatgatcgggtttcagagtttcagtgtgatttgccatttgccaacaaagcaacacctcaatgtaaatagcagtagcataaaaaaatggttcttttggattgtaaaaattttgcagattttaagtagctttataaaattgtataaaaaatatttatttttaaagaggtcggaaatgtcaaacactgagagagatcggtagcgcttgctgctgccgccgctgcggctgcgagagctaaaaatcagctacagcagcagctgaaaacggccacagtcgtgacggctgcagcagccagcagttccgatcaggcccaccgttttttgtcaagtgctgtaacagtgtactttgtgctgtaacagaaaattggctggttgtcaggtgctggttaaaaaggccaattttctgtcaagttctggtttgtgatttgtgatgctttggctattagttaccctacacaagtactccctacgcaacaaagaatggttaaggcatgagcccctactgtttgtgtaccaagtgacaataattggagctttcgatacaaacaatacttaaccaactaccttgtacggttcccatctgccgccattttccaactaactcgagctactacaactaataatcatcagtaacacgagctaattaaaagcatcttccagcacggcaggaggagcacacatccctcatcctctgacaccgacatgtggccccacaccacaggcacttgacctgtgtcggatccggacccgccaacccgccaggtgttccctccaatgggaggcgagctctccctcccaagagaatttaagaacagagagaggaagtggagagactacttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctgggtatgaatcggacatcagtttttgtgtttccgaaatttcaaaaaatatatgcatgtcgggttggggggttcagctcgccacgttgggcaaagccgtccgtggtggtgtataagttattgctttccacatttgttaggaaaaaagtatgcgtgatttaatccgatggtagtttgactactaaaaatagtggtcgtctgatagctgtgtctccttggtcaaattgggggtcaaattgttgggatcattgtcgttaataagtgattgatcggtccaacagttaatccgtttgtgcttttgtttgcttgtacggaatctgaatcatgcattcacaagtttttgttatggaaaacagtagggggaaaaatcctatatgaagtatctgtttgttgaacagtaggaaatacgaccgtataattgtattgaagatcttgtgattttgaactgcccaagtatgccaacagtagagttggtagttttgcatatacaccgagtactaattttgcaaggctagtgttttctcccctgttctgagattatatccatgatcccatggcttatcttcatccattctgtgaagagcaattgcttcttgtctagaaacctttctacatttgctatcttggtatggacaaacttttgttgtaggaaccttaggttatgtctttactcggtaattgaaagttcacacaataatccagcattttgatcaaattaattagatcgttccaacatacttgaatttagtggccaaacataattgtttatatcggttatctcatggccacgttgttaaaaaccataacaatctccatgtacctctttttccatcaaagttcgttgagagtttatacataaatcagaaaatagtaaatatgagattgtaatgggaaggaattgtagctagcgatacacatttatccctataggtgatttctgccctagtgtattttgtaggttaagagagtcgatggattgtctacactagatttgtacaaagttttcttcagctgtaattcaattcaagtctataagaacagaacatgaattaaattttattgagaataatgccaaaattggcattgttagcaaaatcctctaactggaagtaatcaaataaaagtttctaatctcaagccctactaccccctaactcagtagggacccaacccaacattgcaacctccagctggactaattttccttgaagacaggctgataacttaagctaggctgaagagtacaagggccttgacacattcactagcccagtttaatgatattttttgggccttgacatattcactagcccagtttaatgatattttttgggccttgactgacataattttgagcatacctagcaggccaaatccttgtggggcttggtcaggttgggccacttgtgttatatctggtccatcgctacattcgtaacctagcataatttattagttagtttcagttgtcgcttgtcagaaaaaattgctcaggtcacaagtcccctgtgaaccaaaatgtttgagtcacgaaattgtcgatggcaaatttttatcctctgaaaaggtctagaaagtaacaaaaaaaggaagtggacccatatctttaattactgccatatcaataccaaatcatgcttatccgataactgcgactttcccatcatcgagttatatatatacccttttgttga

SEQ ID NO: 42850 - DNA, 8369 bp, Oryza sativa
ttccattttcttattagtactttttaaattagcaaagaatcaatttgcagagaccgatcattttccatgggagcaaggataattcagaaacacccctcaagttggttggatattgtcgagaaggtccccgacacttggaccgtgacgcccaattggtcctttgaccgccgaaccccatggtgtccccttgacgccattgccccacaccacaccaagctcctcctccttctccttcaccttctcccgctctatatataccctgccatggcttcctccattgctatccaccactaatccctcccaattctcctctcctcgcctctccaaactcgcatcgatctttaatttctgttctcacctgtacatacatacatacgcacgcacgtacatacactcaatcagagagagattgttggtagctaggtagctgtggccaagaaagtgagagaattgggaggaggattggaggaagacgaaggggttgatggggatgaggcctggatgggtaggggggctcgtggaggagagcttcttcgttgggtgtcccgcccacgagagccgcaagaagaacgagaagaacatcttctgcctcggctgctgcgccagcatctgcccccactgcgccccctcccaccgccaccaccctctcctccaggtaatcaatccgccgtcttcgtcgccggcgccggcgccggcgacccaattgccatgccatgcatgtcctcgatacactgcatatatctctagctacatgcatcatatgatgcatgtctatcttcttcgttaattaattgcagtatcttaactgtattcagaatttcagattatgcatgtgatgtgagagtgtgttagtctgttgaaattcttcaattacaagtttatttatctgctttgaaatcgttgggggtgtgctacagtgtgctgaattgagtggatttgtgggggtgtgggctaggattttagcttttgcatgtatagcagctactagcttgtacttaacaaaaaagcactagctttggcctaattcactagcctttccgtcttggcttattccaagatttgcttctactagtaccagtagatgtgggcagctagaggatcttgttgattcttccatgtgccatgacatgctaattgtgtcattttcagaggaaagattgctaattgcctctcatcagcgaccatgctagtgtgccactaggagtactagtagcagtagtatttctagcataatttggttagatttggttgggcttaattgcggcggtgcttgggcttaagctgcatcgcatggggtgtctcacttaaccacttgcagctatagctctcgacccttttagaaccctgtgcccatctttcgtcttccccttgtcgttttccggccttcgttttgtgctccttgcaaagtgacccctcggttaatcaccctgattagtcacctaaatcacacattagtactttcacactgctaatcaccaccttaatttcttgcgtatttttctttgccaaacttaatttttcttcctgtccttggctgctgtttggtgggccatgagtagtagaaatgtggagtggttaaaattgggaagaagggtgaaaaatgagtctctctctggcaagaagttactgcgagcctcagtcccatacgcctgaaataaccatagtcttataattaagcctagtcccatcttacatcttccccattccggtgtgcaaagcatatgcaatgcattgctctctcttctcttctgttcacctcaccacctgcaaaagttacattttgcagcagcagcagcagcagcaaaggccagcacacacagtcatcacctctgatgaaaaaaggccatctctctttttgacagcggtaaacaaacaatagcccttgtgtcctgctctccattataattaaccagtaaaaacttctgatcaccacataaaatgaaccacttctttttgtcaaacttttataaaatttgtgtgtttccagagagagtctggtgcaactacaaaagctctaattcttaaatacatccaaactgcagcagtgagcaagattgatctattagcacaaaaatgggttgggttatccggattgtttagccatgaatagcaaagcatgccgatcttgatctctatccctgcaaagatagacggtgccggttggttgataaatggatgggcaatcctgtgtctatctagccatactagctacgatccatccatcgtctcagccaaagccagagctgttaagatcgcagctgcagtagtcacagtgacagaaactacaggctacagaccacagagaagccattggcgagatgcagtaaaaaaaaaagtgagcagtgtctctgtttttttttttaccatatgtgtgcttggtaaaagaccctgtcctcctaccaaacaaggccccaatactgttgctccggctctgtataatccaaggtcgccgtgacgatactgttcattcgttcaggcagtaacacacactctctatcttttttttacagtgtcatggggttaatttggaggtgtttttttttttacatttgtgacctcgggttgtgtgaccgagagaagtggaaggtgtaggggtggtatggtaaattagggtttgtttctccctcccacgatgtggatgacgacgagccgccggtcaaaggctcgcaattattaccgggggagtctatcctttccctgcctggctcagcgtccggatggaataatggaatttttttttacctcatcaacaattacaacttctagaagggtctcatctaaaatttgaatttggatggaataatggaataatggcctatgcttatcagctaaaatttaaatttttaaccttaaatttagagctgattttgagagttttttcatcgaagtttatttttcaaactttacttttatattgtctaaaacacgtatataaaagttatattcacaaattactttttgtttgcaaacgatgggtccgaagattcttttactagcactagaattaaacggtaccgtacgtataagtatactgtgcattgaagtgcttatacgtgtatataggttaggaggtatgtgtacaacgacgttgttcgcctggatgatctcgacaagctcatcgactgctcctttgttcaggtaaattgaacggcaataaaaactctgaaactaatctgttcagttttactattatgtagagctaattattaatgttggttctaatttgatttcagccatacacgatcaacagcgcaaaggtgatatttctgaagccaaggcctcagtcgaggccgttcaagggctctggcaacatctgcttgacatgtgacaggatcctgcaggagcccttccatttctgctgcctctcttgcaaggtacagtagtgtagtatagccactgtacacatcttccagaaaatttttttactgtcatggcgaattggcgatcgattgagaaatattaattaacgacacacaactctaatgataataaggttgggtttagatctaggatgactagttttagcgtgtcacatcgtagatgtacggacatgtatctgaagtatcaaacgtagactaataacaaaacaaattataaattgtgcatgtaaactgcgagacgaatttattaagcctaattaatttgttattagcaaatgtttattgtagtaccacattgttggatcatggagcaattagtattaaaagatttgtctcataattttcacgtaatctgtgtaattagtttttttttctatatttaatactctgtgtatgtatcaaacatttgagttcgatgtgacgggtgaaaaattttgtcacgagagatgtgagagtgagctactaactacaacgactgtgtgtcgttaattaatttgtgcatgcattggcatgcaggtggatcacgtgatgatgcagggcggcgacctctccaacatcctctacatgtccggcggctcctccggcgagcccgacctcgccgccggcttcccgcgcttcgagaacctccgcgtcgacggcggcggcggcggcggcggcggcctctccgacgacgacgacgaccaccaggtgaccacacccaactccatcctcgaagaccccctccaccaccaccaccaccagtactacggcggcggcggctccagcaacaacggccggagcacgtcgccggcgccaacgacggccgatgtcccgaggaagaagaagagcggcggcggcggcgggttcttcccccagatcgtgctgtcactgaacaacaggaggaagggcgccccacacaggtcgcctctcgcgtgatcatcatcagatcgtcacgtacgcgtaaaccgtgtttcgatcgctagtacagataatcatgaacacctccccctactattatataattagttgctctcattacctatcttaattgtaatccccttatgattattagtagcattgtagagagagaaagagagtgtgtgtgtggttgtggtgatggatgatggtgtggcctttggctggctagggtcaccatctttagggcaagcagtgttttgacgagatttgagagaggagagaaccagctaagcttgcaaactcctccctgttacaagactaggtaggcacggactttgtgggggcccctgtgcagggaccccaaaagattggctaccaattttgtacttgctgtaatgggggttaattaggtttgctcgctacctatgtgtacacttcccaaaaactatatatatatatatatatatatatatatatatatatatatatatatatatatatcttcttatatatgtaagatagtgagaattcttcatgtgtttattagcctcatttccttgcttattcacatggttatccatactatttattaacaaacaaaataatttgttttgtttctcggtaaaacttttatatacgtgttctcagctattgaaaaacacatgttataaaacactaaactgtaattaacttttttccataaatcaacttcaaaatttatcttgtaaacttgaaatttagctttataaacagataaatttgaattttagttttataaacataaacgaagctacgaggctatatactccttctgggcagataatacttgtcgttttagacaaaaagtgaggtcaaactttagaatctttgattatgaatcatttttaaaatatttgtctttcaaatattgtgatgtcgaggagtgatcctctctagcgggtggtcgtgagacctccctttgtgagttcggccgggggagatggcgcgatgatcaagagcgtacttccgcttgggatctaactactggatcgttcacgagtttgtgtggaagacaagggattatacaggttcgggccgctgggaagcgtaacaccctactcctgtgtgtgggattatggttaggtcttacaagagatcttgagctcctagggaaacctagctgttattcctctagagctcaagcaatcgagagtcgtcccttttctcgatgggcgaggttctccttttatagttcaaggggataccacatgcaccgtctatacctacccctcccatgggagggggacccaccctgtctggatcagaccgccattcatgccttcaaccaaaagcaaggtggtcgtgcgtccttgggtggggcccagcaccgtcccccgcctgacacgggggacatccctgtcattcccctttaaatgtatggagactttggtggctcaccacgcgcggagggcgctcctggcagtgcatcgataggacggggcatacctgcccccactccgcctgacacagggtgggacgtggggacgctaccgcccgtccaatcacccgtgaccggtcataaaccggtcacgcccgattgacatgggtctatcgggcggcgccgcacgtccacccacaccgcattaaatgcagtgaggaacggttggagtgccgcgcattaaaggccctaagaggcgccctctgcctcgcccgctctccccgccacgtggtggctggtcgagggcctcggggtagagcgtcccgaaagcccgaggggtgtgatgtggcaccccgaggctccctggccaccttagcgctatccgtggggcgtggggagacgaggccgcgtggttatgcgactagatgggatcgatactttcctttactgtgcatattcccgggcccatatcaccgacaggtgactacatgcatagattagtattagaaagtactttaataaaatcatatatttattaacaattatatacatattataataaaaaataatgattaaagttgttttttttaaatcatgtctttatccgaaacaacgggtattacaacctggagggaggaactatattttgttgcgatcaaggacaattaactggataaatgatcattggaaatagtgtgaaacgatggtagcgagagagggtttgggcattgaattaatctgcaaatggccatggtacttgcacgcatgtagctgtcgcctgtcggtcccgggccatgcatccaccaatggcagcttgtgcatgtcctttgaccggcatggacagccgacgatcgagctcgccacttgtgtgttgtgtgtcgcgttggagaaaatgttgcccctaggctgcttggagttggatggagctggagctagcggcggccgtgctttgcttgcctgttgccagtggttgccttgcatgggccaccgtaccttagctcgtgcctgccgccatgatcgattgatacgatccatatcgacctcgacctacgccgtggttagtttcaaaatatttttttaaacttccaacttttatattatatcaaaactttcatacacacataaacttccaactttttcatcacatcgttccaatttcaacaaaaattccaatctcggtgtgaactaaatacagccctacccgtgttcaaactatgtaaagacctgtttagttcgtaaataaaaaaaatttcaccctgtcacatctaatgtttgacatatgtatagagtattaagtatagaaaaaaaactaattacacagattgtgtgtaaattacgagacaaatattttaagcctaattgctccatgatttgataatgtggtgctacagtaaagatttgctaatgacggattaattaggcttaataaattcatctcgcagtttacagacggaatctgtaaattgttctgttattagtctacgtttaatactttgaatgtgtgtttgtatatccgatctgactctttgaaacttttcgtctcgtgaactaaacggggcctaaaagtttttagggaagaaaagtccgctctttgtaccaagaactgttacttttgaaaaagtctgttttttttttcttttgaataagagggtagaaggacagtctcctttcattaacaaagaagaaggtttagttttgtgcaagtgttaaggggtgttacataggggactattctcacaacaacattagctctttaagcttttttttttttttttgccctcactaggcaccaagctctggcctcctcttttgtttatgctacaataattatggggaaaattgtaaccataccattatattttgcaaaatttaagatataccatcctaatccatatgtcattgactcatgtgggtcatatgtgtctttgagataccaatgacatatttcaaactttgaaaatttataatgacatggttccaaattacccataattatgatcggtgttgtggtgatgtgctggaagactcacgtatttctctctttccaaacttccgaggtgattaggaggatgagtgagcggagtctgcggtttaggtgctcctgttgcacgggctagtgttgtccacatgtttgaaccgtgtccatgatgtcccaatgctccaatgggacagttttatgtatggtcaatttttactacagaacatttgataattccgatttgtctatgtcgtgatcttaacatttttgtgataattcagtagaaaaagaatttttttttgcgccaaaccaaactacagttttagtagcacactgttacttgtgaaaacaagacgaatgggacagttactttttgctacataacatttgacaattctgatatgtttatgtcgcgttctaatcatttttggtgcaaaaccaaaagaaaacttttagtagctttgctaaactactaaaaaaaaccctaaatacaatagagttactatttattaattcaagtcagaattcacaaaaagttttctcataatagaaacaataatcattccagaccataggtcgtgtgagtgggcgaaaggtgttattttctggggactagagaagtgtcggcttcggtcagaaagctatctcatgagatccatttcgattttgatcgaccgatcctactggatcgaccata

SEQ ID NO: 42851 - DNA, 4578 bp, Oryza sativa
  unsure (1)..(4578): unsure at all n locations
nnnnnnnnnnnnnnnnnnnnnnnnnnnnnnnnnnnnnnnnnnnnnnnnnaacaaagcataatcaaatatgttacatccagaaacaatatggtattactagtacattggaccaatgaagtgaacttatacatgtaaaaggagtattagcttctagtagtactaatcgatgtggtcatgggcactgcttaattgaagaatgcactatgcagcaagcacaagtcctataggaatagatcctgaaatcaaaatttcaggatgccagaaaagattaaatcagaaagaaaagcaagctctagaacatgaaccatcgaaagatttctagtgataatgttgaatgcaaggaaagcgatcccaatttcccaaatccactaccaatcatgaagaacactacccatttgatcgggatgttaatcgaacagtacccccaaacatttatctggaatgctgagtgaaatatcaactgcaacaaataaatgcaatgctaaatttctgaatcatcgcacacaccaccaatcaccacaaagaactgaaaactcagctaaggcatgcagatatatagaaatcaagattagagatcagcacacacacacacactctctctctctttcttgtttcttttaaagcagatttttcattggcatttcgtcataaacaaattaacaagaaacagagatagaagctagggccgggcggcggcggcgcacatgaccggcgggctgcagaagtcgaagagcttgcccttgtcggagaagacgacgacgccgacctgcgcatcgcacagcacggcgagctcgttcgccttcttgagaaacccagccctgcgcttgctgaacgtcacctgccgcctcgtcgcgtcctcgatcctcttcatctcgatcttcccttgccccatcgcgacctcgcctcgccgcctgtccatcgaaaaaaccaaaaaaccccaatcaaatcgcttgaattaaacgggatccagccacactgaaaagatttctgcacttgcctcgatgaacaagggcagtcaaagaagtgctagctccaatccaagccggacaaacagaagaaggagaaggagtgagcagagaggagaatcaaatggtgttcttctcttgatttccttctctgtttttttctctctcttttttttctttaccttggcttgtgagacactggaacggcttccttcgagctgaaggagaggagcaaagcaacgaagcgtatttataggccgcgatctccacggcactagcactgtgaattcaccgatggctgtaactttcgttcactgaacttctcgttcggagcgcctgagttttacagtctaccgttcgttcagcacttcagctttcgttcgttcgttaactttcgttcgggcgcctgagtatttacagtacagttcgtccgttcgttcgttcgttcgcgcgcgtgaaaatgccaggaagtttcaggttcgatcgggaacgaacgtcgctctccgcggatagaagttcgtggcagccgcaggcagcattgcagcaggagagcaaaagcaacgaaacgaggctaatcggcaaaagcagctagcaacgtcatggggcacaagaaaaattcagagagagcacctcaacgcaaacgttggttggagttggatcagtttgtcaccatcgggctggtctctaacccaaaagcagcatatgggactatggtcgtgtttagttatttggccaaaaaaattttaaagtatacggacacacatttaaacatagattaataacaaaacaaattactaatttcgcttgtaaacacacccttagattcaggggtgtaaagttttgcgtatcacatcgaatatacgtacacacatttgaagtattaaacgtagtctaataacaaaacaaattacagaatccgcctgtaaaccgcgagacgaatttattaagcctaattaatccgtcattagcaaatgtttactgcagcaccacattgtcaaatcatggcgcaattaggcttaaaagattcgtctcgcaattttcacgcaatttgtgtaattagttattttttcgtttatatttaatacttcatgtgtccaaacattcgatgtgacatggtataaaattttaccaggggatctaaacaggccctctgtatcatgatagtgcacacaaccaagtgaacaagacactgcacacttaggctaagttctttgcctcaactccaaacttcaacttttttccgttagcatgtttttcaaacagtcaatgatgtgtttttttttgcaaaattttctatatagaagttgtttaaaaaattcagataaaatctatttttaagtttataattattaatatttaattaatcatatggtaatgaggtttctcgttttacgtgcactaaaaatttatctccaaaaggatagatcaaacgaggccttaaaagaagagagaaaatcataaaaactctcgagatcaaggtcttacaactcgaaaactaggtcatcacccaaatgccaggtataaaactccttaaccacttgctccaaatataaataagctgaagtgataataccatataaaccgagcttctggagaaataatcaagaaaacaacctgcaaaggaaaataaaccgttttcccataaaaaacaacatcattatttgagagccaaaattgctcggcacgttgttatcgtctctagtaaaaaaactggtctaaactttttgttatgtcgcaaaatccattacccaaagatattggacgcgtttatggatgatcaaatacgactacgagtatactccctccgattctatattaattgacgttttagacacggttgaggtcaaacttttataactttgatcatcgataactttaaaaatatttagtttaaaggaactagaacaacatgtatagatttgtctttcaaagcactataataaaagtaaacatgtatttatttattatttatattataatagaaaaataaggttaaagatatattttgtagaccgtgtcattgtctaaaatattaattaaaatgatacctccggagggagtaggagcgtactaggtgctactgcgtttgactttgactgggagcgcagcgttagggtgcatcaccatcaagttcgtctctctcactctctgcttctcactactcgtaaacagagagtaggcaagcatggaagcagctagcacatgggagtgtaggcggtactgcgcttgaacttgtctctaggcgatgggcggtgggagaacccgggaccgttagctgtgtgtgcatcactgcatatttgcatgcagtgcgtgacgaattatacttgtgaattttaagtttgtaaatttttcagttgtaaaatacaccgtttaccatttttcttagttaggaatgaagcccgcgtatttacaagacaatatgcatcgtaggttacttttgagatacttattgtttttaataaaaatgccttcgagtggtcaaagcgtaaactacctaattgtaaaaacaattaattggaagtgcggtctagcgggccatgcaaaggcaggcaggttcgatgaggcttccggccttccttatctctcggcaaggtcttctcacctggctgaggtcctagctaaagcatgccgtttgtggcaaaacgcaaaagcgagtaaaagaatgacgtgtgggtcgtctggtcttcttttcaacgttataatgggtgtattcactttgacattatttttaaccataccattttctttaaaattgtcaaaaaaaaatgtctacgtttagtttgttactaaatttggttaagaaatcatactaaaattttaacaatattgtcatcttgctagaattttggtattgtcaaaacttggtaaagtttttgtgatgttagatttgttagtccgtgtactaggcgagaaaaatctttcgtttttcgtgcaaatgtttttgggactgttatcagaaaataataaaagaataaagaaaaatgatacgtttatcggaaaaaaaaaagacaaacggacaaggatacgttaatcgaatgaaaataagaaaaaagaaagacggacaataattgtttttgcaaacataagatagcaataagaaacatgcacatgcatgggcatcatagcgtaggtaacgaactacagttcttgatccgatgaaaataagaaggaaaataaacaaacggacaaggattgtttttggactcggtattactgcatatccttgactgctggatcgacaggaaacggccaagaccaagctgggagatcagcatgcgagcaaagctgcaggctcgacgtggcttccgggcttgcctatctcggcaaggtcttcttctcggggcctccggcttggacgaggaatatttgccgtttgcggccagccggcgaaagcgaactgagattaatggctggcgagtagtgactggcgtcatgtttcttgacgagctctggtcaccgtggagcttttgacatcattaatgctatgaagattttgctatgtactccttctgtctcacataggctgtgtttagtttctgaaattagggagaagtttggagaaaattggtagtttggaaaaaaaaattagaagtttatatgtgtaggaaagttt

SEQ ID NO: 42852 - DNA, 1477 bp, Oryza sativa
cattcctcgcaaaagatactcaatctattaacttgtttttctttttttttttcagaggtagttacttggcttggttgcatcgtgccaacggtaagagtaactgagtacgctccccacgcccaatgcacctatactgcctccgttaaaagaaaaaatccaatacgagatgttatgtttaaattcatagtatcaacacatttcgcgctagttttttttttccctgacagagaaagatacccttgtacacgccctaataagccagcgtaatgggttaggagacatcatggcatcatgcatttgtacactactttctgttatttgtaatgtttattccgaattttttttctattttacttgtacactactttctgttatttacgaagagaccacagctgtataaaacggcttgactacactccaagaccatactaatcagccctcaccatggacagtaccgtttcatttttttttctttgacccgattgcattagattaacaaacaagcacggagctataagctactaaaacacaatgcaaaattgcaaatatcacagcgcactaacgataaatcattcaaatggtggaaaaaatcaaacaaaatggttagattaatatagggctgcatgtgaatgccacaagaccagttttaccaaaccattgtaggctttataaactgtagttttctacattaccttggctatgagttgtctgtttactagcaaatcaagagtacgctggggatgtatcccccacccgtctttttatttcattaaaaactcatcgggtatgtgttatggcagatgccacgaatgtaaaacattttcattgtctaaacaaagaagattccatgaaaccatgcaaacatgaaatacagaatgacccacatcagagcttacaaacgttggcatgggcagttcaaccacattaggttcaatatcaatggcctcgcaaaggccaacttttggattgacaggaaacggtatagtaactgaaacccattagtctcatactctcatgtcataaatccttttccactacagcagaaatgcaactaccatgagagaatcctaatcctattcataaattcagaatagacgacaacctggctaaaagtaaaattctgaatcaggtggtaagcttcttgacaattcacagggatcatttactcttcttaatcactttgctgctctgcaggaggctcttcctgctgttcctgaggatcctgccacagataccccggatgaccttgctgaccaccatacgctattcctgcacctgggacctgctgctgtggcacatagtagccatacggatatgagtcagcagggacacccaagggcggcaatccagccctagggagcccaactccctcctccttcaagtcatccctgggaactatatctaccaagaaatcgtacatatccgtcctggtgatggcagctgctatgtcattcttctgcaaggtacggcgcttgtt

SEQ ID NO: 42853 - DNA, 1150 bp, Oryza sativa
tccggtgaaggatgatagcctcgagctgctcggcgttgtatgattgtgtcgcgaagatcgatggggcggcgacgaggtggtgagcgaggccgttccactcggcgctccctatattggtcgggaggtgagtgaatggaccgctcgtcgtgacccctgctcctgcgattggatcctgcgccggtgatgctgaggcttggatgacggtagtcatgagatcggaagtggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgac

SEQ ID NO: 42854 - DNA, 3854 bp, Oryza sativa
aaagttccttacagagttttactccgtgtttagttccaaaatatttattcaaacttctaacttttttatcacatcaaaattttttctacacacataaactttcaacttttacatcacatcgttccatttcaagcactttcaattttagcgtgaactaaacacagccttagtggtagttcagttcgcacaaagctccttcaaattgcctgcagtttcgaaggaggcctttgaatctggagtgctaattcggcaatggcatattttcgttcctgccgcctcgcatctgtccgtgcgtggccgttttgattggtcaggttttctttatgtccatctattttttttcacctgttcaagaacccctgcatctgtccgtgcgtggccgttttgacctttggagtatggatagtctggatagtggcctagtgggtagagcacgatcacagtatacggtgcaacgcaccagattgctcagaaattcaggtgaaactcaagcatttaatttattttttttcactttcgagacgccaaacatcgtaggttcatgattaacttgtgccgatggcgagaaaaaattctgggggacttgtagcccaacactggaatggttgaactatgacaaaggcccagaaaaacaatggatggactgacaggcccagaattccttcacgtctatcccaacaaaattagtgggttgctgcatcccaacagaatgtttgcgttgattctgatattagacatgcagactatacaaagttgtgctaaataaacaagaggtgcaatgtactgaattcagcatgataaaaaacaaccagaaggttcagaaatatcaatgtcaaacacgttgatggaaggcacatggagacatctggccacctcccggtcatattcttccacaaaacttctatagttgcctgtgcaacaaaagcataataccaggggcacttagtaagtgatggacacaagtgtatgaactcgtatgcatatcttatcatcacaaccaaggttttgcttgttttgtagtgacaggattaaatttaattggtcaggttttctttatgtccatctatttaacaacagagataacaagggaataatataaattgaatttcttacttgtgaagactttccatggttgattcaagttttgtcgcattagcaccaaccacctcacctgtcttccgaccttggtagtagaaatggaatgttggctacaagagcaaaacatgttggcaacaaagaaaaagagatctagataactggaggaagctgcgcagaaatttaggcacacagtcatgagctatagtcatagtacaatgcaacttaccacagagaatatttttagatcacttagtttgcttccaacaccatcctgcaaaagcaacacaggtcagggaagtgcctatcaataaacatgtccaagcatggccataaggttcagataattatttcagccataatcaaaattggtaacatagtgaaacacattttgcctttcaatgtactgaaagtataggagtgttctcaatagagtattccagttattgagtgaactaaccaaacagtgtagcatattagtctttgaaatcagaatacaaaggtaggaagctctgaaccggacaccatcttgattaacagtgattcatggaacagtattacggatattcagtgaaaaattcccatctcataactttgccttctacatatgcagatcccatacttgaacataagtagtgctagaatgatgcgaaatatttcagactagatccagattggtcaattgactcgaggctttctacagaagaacaggattggttcaatcactagcacttgagttttaagcattgtagtttactaagggcacgtttggatttctggaatattttgcctagccaagcaatgccaaagtagtcaggttaggctatatagcctatggcaacaagagagttcatttggtttcatggctgctcaagcaaaactaccaacgatcattgcttgccgctggaggagagctgatttggctctccctggtgggcaaggattttgaggcagttattgcctaacttgccctcaaaatctaggattttttgtttgtaccaaatgcctctcctaacttagcaaggatagaacttcccttgctcaagattaaaacacaccctaaaaagcataagccaaacctaaactttgaaaggacaggggtcaaaaatactactctgcagttaacacatgggaggtaatgcaattatacatgacaaacaatcttcaactatgaacatatgagtaaccaaacaattttgcaattttaatcccaacaacacctatttgagcaagaagaacacttcggcgcatcacaatcgcagcgagatttggatccgcccacttaccatgtcaatgtcaactttgtagataggtatcttggggtaccggctgctcagttttgaaatcacgggtgccatcgctctacctacaaacaccaaacaacccatcttataacacctcacatcatcatcaaccatctaattccaaaaatcccaatttcggcacgaagatccggcacttacaaggcccgcaccataccgccgtgtagtagaacacggccggaagcttctccgctgcaaaaaggaaatcgcgcgcatccatgagaccatgatccaatcctacccaccaaaacactaacaaacaacagcagcaaaggtggaaggggagaggaagaggaatcgggcgcgccgcaccttccaccttggacatgatgctggtgaaggactccgccgatccgaccaccaccatgctggaatcacctgcaacaacaaagaagaaaaagaaaaagaaaagaaaacacgattatctcgagtccagtaaccacttgaggagaagtggtgagtacctgaggaggagggggtggtggagaagaggcgggagagagagggaaacggcggcggggaggagaggggaggaggaggcgcggggctaggttttccggggaggtagggtttggaggcggcggcggcggcggcgagggggaggaggcgaggaagacggcagagtcggtgagccagagccatactgtgccacgtcgccgtgaaagattttgcctcttttgtgcgtaaaagctcggagacgccaagcccacgacgaaaccgcatgggcctgaaagtttctcacacagtaggatgggcttccggcccagtgtatttcaggcccatttattctttacaagtctgtttatctttttatttgattgattgaataataaatactctctctagtttttaactgatgacgttgttagattttgaatatacaatttgactattggtcttacttaaaaataaattttacaatatgcaaaaatatcgattatccttattttttaataagacgaacaatcaaacatatgtctaaaagtcaaaagtgtgatctactgaaaaccggatggagtactaaagtagcaaaccgatttttaacaaaaatttaaaatgagttttttctttaggaaaaccacctaagctcagacagtgagcgacagttgcaaagctttgtttgagaccttataaagaatatctttatctttagaccacaagtagagattactaaagaatgggatagtggagcattattgcgcattatcggtgactgcaaaatccatcataaggcttggttataaaactcttcactaacattcactagttgggccacatgacctaacagaaaggataggaaattatttagggagagaaagaacctgatccaccatgtaaaattgagttgcaaggaaagaccaggacctaccaatctatccatatttgtccctaaaggctccaccagactgcatgaaatggaagtagctatgatgatta

SEQ ID NO: 42855 - DNA, 2394 bp, Oryza sativa
tcggtccactcggcgacaaaatcagctaacgcttgggacttgattgaaattcggggcttgaatgatatgtccaaagacatcaactccaaagcccacttagcaatacgtccgtttgcttcgcggttgtgtagtatgtcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaatagatcggtcgctggactttttggacatggccttcttcctcgcgctcaacgaccaagactgtgctcacaacctgggatgtggctgatacatacagcaacaacggctcttgcgggtgtggtgaggctaagactggtggctcggtgaggagtttcttgaaatcttcgaaggccttctgtgcttcaggtccccactggaagttatctgttttcttcagcagcttaaagaagggcatcccccgctcgccaagtcgtgaaacaaatcggctgagcgccgccatgcatccagttagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcacaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccaaacggcatggtgacgtagcagtatgccccaaaaggcgtgatgaatgaagtcttcaagcagtcggattccttcagtcggatctgatgataccccgagtagcaatccaaaaaactgagaagctcacagccggcagtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcagacgccatctcgcgagtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtttcgaaatcagcgacttcaaagctgatgttctctgtgcggaagttttcccgagtgccaaaagtgactgggagggtgatctggccgagtggagttgcggataatcctggaattactccgtgaaaaggcgcattgcttggttttagctcggagcgaggaatctgcatatcgtccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcgtccttcttcctcgatgtgctttgttcttcgtcatagttcttccgtgcagtcttggtgtattgatccgcgaattgcttgtaaacgaaacaatctttggccacgtggttggagttaggatggtgcgggcattgggagttcatgatcttgtcgaacgtg

SEQ ID NO: 42856 - DNA, 2396 bp, Oryza sativa
ttgttatctacaatttttctgtcagtcatcataacgcgtgtcagtgtttatgttgacaatcatcctgacgagcctactagctggctccaacactgttatctagctgttatctctcattcatataatagtggtatgttagttgtaataactaattggaagggactgtagacaggtttgaaaagagagagaccttggtgagagagctcttgccgaagtacggaagtttgtgagaatctcctacaagacctatgatagacttatgtaattaccgattctcttgagaaaatttggggggggggtgtagctaatgaaaaaaaaaagtgtacgtgcggtacttaaacttgtattaattaatgtgtcatctaggtccctaaactcttaaaatgaatatccaagtcccagaacttctcatagtatgtcatataagtcctaaatcgtcacaaccccttcaggatcctacgtggcgttgacgtgtcatgccacacggaataacgtggcatcattttaactgacaaataggtcctgttaaaaaaaattcctttttctttttttcttctctttttttccctttcttctcctttctctgtgacccaagcagaagaaaggaaaaaagaaagaatgagaagaaaacgaagaaaaagaaaagaagaaaaaaaaaagaaaatggcacgtcacatccatgtggcatgtcacatcagcgccacgtaggatactagaggggatgtgtcgatttgggatctaaatgatacactttgacaaattctgggaccgggatatatattttgagagtttagggacctatatgagaaaaccctacaagtttaagaaccgcaaatacactttactcataaaaaaaagttggctcgatcagttctcattagccgtagcagtgatggagctaactatgtacgttattgggtcttaggcaatgaggagctcaggttattgatcaatatttttttgtcgattattcatggtgcacaagacaattcggtttgccgcctcaccagcttggtagcatatgctccttttctttttagagaaaaggcagacgcccagcttttcataaagcataacagagagtacagaatgctagggtttccagctttacaagaagcaacacagttcaaaataaaaggaggactaatgctgctggcacagccaaacaagccagagataaagcaaagaaaacaagtccatagaggaagcagctttaagatcaggacgccaaatcttctatttttgcctaagcctagctgatcaaattgtgctgtctccatttactccccatagtctttgttgtagccatccttcacagatgcaaaatgctggggtttccagctttacaaaaataacatagaaacaaaacaaacgatgagcccttgctattgacacagccaaacaagccaataagacctcatgttgacatcatcatcatctgttgttgtctccgagcgcgaggatactggcaagcagtgagctttgtgccgtctccaattctccccttagttttgctggagccatcttcctccactgaattgcaaaagatagagctctgtgaggcaaagtcataatatctttcattagacgattattaaacacccagtcatttctaattagccaaattgcccagattccagcagcaacatatacccacaaagttttgttatctacccccctctgatgttgaatgatatcgagcattttacttctgtcagtaggaattctatcccacccaaaggcatctctaaaacaacaccagagaaactgagttggtgggcatctgaacatcaagtgatccacatcttcctctactccacacagcttgcataaggggctgccaggccacttcatttttttcagttgtttagcaacttggattctccccttaatcattaaccacataaaattttttatttttataggcatcggtgacttccacaaaatctgaagctgagcatctttaatgcccccaaaaaccatctctctatataaggactttgtagtgaactttcctgacttttctagcttccaaagcatcaaatctctttctgtcgataattggatagtagcaagctttgcttgcagatctgtccattcagccacctcctcttgggttaaggtccttcgtagattaatttcccagtgccttctttatacacttgcttaaccgtcatccctggatcagcactgatgctataaatgtatgggaacatgatttttaaaggaacctcccctatccagatgtcatcccagaatctgatggccgccccattacctaccacataggcactgccaaggttcatccatcttttaacctcgtgcagacctttctaaaactgggagcccccctcaacagatgattgaaagaaacctcccccattagctagatattt

SEQ ID NO: 42857 - DNA, 2528 bp, Oryza sativa
agtagaaacccatcatgtacatgggaatactacttaaacaagagttgatcagtatcgatttacctccataagagagaaaaccacatttccaggtagccaatcttttttcaatcttcgcgactggcactcctaaatcttttgctgtcagtctcccctcactaacaggaaggcctaggtaaaaaataggtaactcccctcttttgcagttgaagagatcagccacactctctgtgcttcctgttcctctgctccaatcacaattacttcactcttttggaaatttatcttaagtcctgacatagcttcataacagtataagagaaatttgacagttattatgttctcctctatgtttgtcatgaaaagtatagtgtcatctgcatattgcaggtgtgtcagccctccagtgaccagatgtgggactaacccttgtaagtgaccaccctctttagctttatttagcatctcagaaagagcatctgccaccaagttaaacattaaaggagacaggggatccccttgtcgaacacctttgtgagtcctgaaaaatttctccacttctccatttatattgatagccaccctacccttagttgtagcatctttcatccagccaatccacttttcacagaagtctttcctctaaagtacatcaaacaggaagtcccaatgtactttatcatatgccttctcaatgtactttattatatgctccttttcttttggcatactataagtaagaaaaacttcattgttcctaattatatgcaaggaatatataggttttggtttcatgtacctttattttaaaaactcctatgaaaatgtgttgtacagttggttatctacacgcgtatgaccgaacggtgagtgagattctagtgtaatacagtaattttcagcgcttttgttgtcaatattattccttaactaccttaagcctatattggttaattatctcagtataaatgagataaaacatgaggagtaattgcattggagcatatataacgtgttggtgccttaatttgtcgttgcaaattaacatatgacaaccatgttcacgacgtactccctccgtacttataaaggaagtcatttataaaaatgtttaagtcaaaccttaagaatataagtcatgaataactctcaagttgttgagtttgaaaatataaaaattatatgtatagatttgttttgaaaaatactttcataaaagtatacatatatcacttttcaataaatatttttataaaaacaaaaagtcaaagttgtgttttggagaccgtgtcgctgttctaaacgactttctttacgagcatggagggagtactaaataccccctatagattcacacgtgtgacagtgaactgaaccgcatgcagcaataattaaccagacgtgccgtccatggacgaaacaacagtacatggcgggcaactgcgcgctgtaaaaagccgtcaaaatgtagcccccaatgacccgggacggacgaccgatcagagaacagaacaaaaacgtggagcaatgttgatcgtaaggtgattgtgggctcgatttatatatcgttcgcatgcgcaaattaatcaaagtggccatacatatatcagcagctcgtagtacatgttgctgggccatgcatggagaacgatgatcacgggcagtaactccaaattaatcaagcttgcatacacatgtacgaatattgttcatgtaatgcaactatgcaagtagatacgtacgccgtatggttcagcagaaatataatcggctgacaagtctgtctgtgcactctgcactgagagcaacagggagcggatgtggccgtgcgtgcgtgcgtgcgtgtggtcaccgttgcagtcaagttgacgaagttcttcacgggttgcccggtcgggggagcccctgcctgtgccgcccgggaccatcgatccatccatccatccatccatccatccatgcgtcgcgcggcgccctgtacgcctgtacgcccgcgccgcacgtacgtacgtacgcacgccatcttccgtggtccaccacaccgcccccgcggtttggttggataaccccaacacaactgcatgcggcctcgtgccaaaaacggcttctcccacaggaaaaaacggtagaaattttcctctcctcccggatcgcgacgcgcatgcagccgcgatggggggagatggcgcgcgcgtgctacaccggtgcgggggttggtgattggggaccacggtggttttcacgtacgagcgccgctagctagctgtggaagtcgatcgggataggggaggggtcgcgccgtcgccgtgtaggggtgtgcagctcgatgattgagttgtgtgtggtttgcatatgcacctgcaccaattattaattgtggcgcacaccgtccagttatatgcatgtttcgtacctgggtaaatccaactttggattcgcttgtaccacgtgataattggtgtaggatttggcaccatagtaaacagcactagagcagatcagcactgtcattcacattagcagaccgg

SEQ ID NO: 42858 - DNA, 2882 bp, Oryza sativa
  unsure (1)..(2882): unsure at all n locations
atcaccatgtccatgaacactgtttgccatgccgtcccgggagtagtagtagtagtagtaggattgctcgatcgtttcttcgtctcgagatcgtcgtcaacatgcatgcgctgcgggcggcggcagtagctagcaagcagcggttgatgggctaccatggacgaacacatggatcacatacgttgtgctggtgttaaggctgtgtttagttggggaaaaggaaatttttgggtgtcacatcagacgtttgaccggatgtcggaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctaagtgtgaagcgaagatgatccagttcaaacaccatgaatgtgttgtctcgtcaatccgtcactctggtcgccgttatcttcatactggtatttgatatccgtacaaggaatccgctccactgctgccaaaattgaatcaaacagtgtgtgttgacaccaaaattagaagtttagttgaaattgaaaagatgtgatgaaaaagttgaaagtttatgtgtgtaggaaagttttgatgtgatgaaaaagttagaagtttaaagaaaaagtttagaaataaactcagccaaaagttatataatgtaagctcactgggcctagatttttattgctttatgttggctgtgtttagttcatatgaaaattggtttggttgaaattggaacgatgtgacataaaatttggaagtttacgtgtagaaaaattttggtgtgattgagaagttgaaagtttgaagaaaaagtttgctactaagattagtattatggcatagtaatattgcatactattccaaaaagaagacaaaaaggtaaccttagtagagaccataacaaaatccaaaacgacaactagaaaaccataatacatttccgcctacaggaggaggaggagcatcgcatggtgcagctttcctcggacagagcagcatgacaaagagcatatggagggccctgttcagttatccccataaccccgtttttggcgtttccctgcagttccattccatgcagcgttttgtacaactgcatgcagctgcctgtgccctgtgccctgtgccctagcaaacaagaagtacttgtatacgattgctggagtaatttgcacaaatgatgccctctttttcctgcgatcgatcgggttcagagtggctcttctcttccatcactgatctgatcatcgtcagacaaggctagctctgtagcagcagtaaacagggcgtcgtttcatgccgtgtcatgtcagctctgcttgccacggtagcgagatctacagttgcagggcttagctatagctcgtcacgatcagcaggtcagtttcgttagagttgcggcgagatgagaggaagcatggatgagccgtagcaacagtctctagatgccaagttcaggacttcaggtttgtgccactcctctctgcctgccgctaccaacaaagcctgcaactgcaagagccaagagaccggctggcctgtggcctcttctttgtactctcactctctaaagcaaagtgatttgtcgaagctgaaagcatctgacgatgcaaattaattagtactcatgaggcttaatttctgcagatctggtttcttctggcaaacacagctgattgattgtagcatgatttcagagtttggagagcacaaatgtttcgttgacagttttcaggacatgcatgtgaattccaaagcgattcagaatgaactgttccatttctccctgccagattcataggccatgcatgcattgatcttgctttcttgtggcaaggacggcgtgagtgtctttctttgtccactaatcatcagaggagtagctgcaaacggcacatgggttccacgcaaaacaccaagaacaatggcagatatggtgtacggtgcacattaaaatagacgatacggtcgtagaagctctcccgtccctccattcaagtactcccttggtcccatgtaaaaaaaaacaatatattctgataatctagataggtatacaatatagcataccctttaacctaaaaagaattaaatcctaagtacgaatctggataatgcttattcatgttaatagctatgatntaagttaagacatgtcttaaaaaaatatcattaactaaattattgattagaattatttacttgattataataataaaaataattttaaaaatagattcaacaaataacttctagcacgtggtctaagtaatgcagccgaagaaaatttgttaacaaaacttatttttaaacatgtgatgctggaaataatctatggcaataatttgatgaagtgttttattcacccattcattttacaacaagccacataaaaatttaaattttagaattgactcagagctttttctctatattttgtagccttgatttttggataactaattagaagttaaaaaaagtgtcgaagttaaaagtcttaccgtcattttttttgttgcttcattacttttttaggtttataacccatagctcaaccaataaataatttgttgcataacacaaatgttgtagtagtaggctggaatctccaaggcatggtactagtttcaattaaaccaacactagcttaaactatttcgattttaaatagtaatctgaagtcaaacgata

SEQ ID NO: 42859 - DNA, 9604 bp, Oryza sativa
catgaagctcgtctcttggtacgacaacgagtggggctacaggtgagcatccacttaatggcataacgccttagccagcccttttcagaacctattcgctttcctgattactgcagaaactgaatgtcatacgcaactcgtgtgttccaaatggtgccttgcatgtattttttccatctatctttatctgacctgaagattttgtttctttgctccagcaaccgggtcttggatttgatcgggcacatggctctcgtcaacgctaagccctgatgccattgataacagcagatgccctagtaatgtaggaagagaaggctgcaaacttgatggccccttctgtatctcggaattatattaagcacaccgaacaaaaccattgccgacatgaagatacatgctgtgttgtgataatccgagcttatttttggcctgtttgaattttgttattttgttgtgcgacacatggactccatgagttggggtgaatgaagcaagtagtaacacactgcttgcacacaaaacaaacagacctgatttcctacacttggtatggtgcattaacgtacaccatggaatggatcgatatctccaaaaaggtgtcccgtattcctatcttgatgatgatattctccctctctgtccatggcaatttgggttccgattaagctttcgcggagcaatgacactgacaacaaccggcagtgtcgccctcggtcctcctcatcacatcccattcctgccctgccagccgtcaagtggtttctcttagtggaaggggcatcacgccctccagataaaccgtgggaatcacttcatttttccccctccttttttttgtgtcgtctctatacaatgacgagagtcgtgagacctgcctgttgtatttttcctaactgtacaatggccctgttctttgctggttaagataaagattttatcttagtttttgttaacacgctattcaaattgataaacggtatattttgtgtaaaagctttctatataaaagttattttaaaatatctgataaatttatttttcaagtttgtaacaattgacaatatgaaactcaattaatcacattctaatgactttatcatttatcgtgccctaacttcatttccatttttagtgaaacgaacatcgccagtctgttcatatctcccggtcctatgaggctagatcgattttcattatcgaaaaaaaaatcttgagttcccatagctcataaaaatatttatagtaagatgtttattcttttagggatggagtggtaatgccgtcgattgtgcttttttatggtattttggaaattttgattgatgaagtaagtgaacagtacatctcttagagttttaggttataagacgttttgacttcagtaaaagtcaaattacttcaagtttgactaactttatagacaaatataataatatttataataccaaattagtttcattaaatcaatcattgaatatatttttataataaatttgtcttgggttgaaaatgttaaaacttagtcaaacttaaagcagtttgactttgattaaagtcaaaatgtcttataacctaaaacagagggagtagttaactataaatactgttcctcgccaaaaaaaaactacaaatactgaggaccgagcttagctcggttggcaagttcgctgtggtgcgaacggctggtcgtgaattcgactcgcggggcctcacctcgacgggtttttccagtcttttctttgggactgtccttcagggcagtctcgactagaaaatagggagtggtagtgcagtcgattgtgtatttttttaggtcttttgaaaattttgaatactaaggatcgagcttagctcggttggcatgttcgctgtggtgcgaatagtcggtcgtgaattcgactcgcggggcctcacctcgacgggtttttcccgtattttcttcgggactgtccttcggggcagtctcaactagaaaatagggtacacacgcatgtgcgttcagtgggactgcacgtttcccgtgcattgaggcctagtgcctccattctcaatcctagcgtgtgttagggatacgcacacgtgtgtgttcgtgtgttgtgatgtgattgtggtgtgtgagtatgcgttctgagttgtttcctttaaaaaaaagggcaaatactgtagacccattgccagttttaatgattagctttgcattattatgcagtaacaactaacaagggatgctcatacataaaagcaactgtcattcaggatgattttcctggatagacgaaaataataactactcactcaagatggcgaagtaaaatcatcagccattatacaagttatttaccggataatgagcatatataggtcacgctcataatctatagtaaaaaaagtttagccgatcaattaagcagcagtcaaaacttgcaggcgatggtggtggtcttctccgacgacggcgccgtggccgtcggcctctggcgaggggcggcggcggcacgtcgggcaggagcagtgcgccaggagccacctgtcgatgcacacgacgtggaaccggtggccgcacgccgggagcagccggaccctctccccgtcggcgaagtccgacaggcagatggcgcagccggcgacggagggcgccggcgaggcgacgtacgtggcgacgggcagcgccacgacgtcctcgcgcttgagccccgcgccggcgcggcggtgctccacccagccgacggggtccgccacggcgcgccgggtgcaccgcaccacgcactggagcatcgagttgagccccagcgcgcacaccagcgcgcacagcatcgccgccaggatcaccaccacgtcgtagtcaagctgcggcggcgacggcgacgacgccgctgccgaagacggcggcatcggctgctgctccggtgaggagacgttgctgcagttggccatgtgggacacctccatgccgatacgacgacgacgacgacgacggcggcggtggcggcggcggtggcgaggcgatcgatcagacaggcaaggagaagaggagaagagagtggagcaaccacgacatcgcagagaaagacaaggagaaaacaaaaggtgacaactgaagagctagagctatagcagtaagcaaagtgatcgaaacaaattttagtgccaatatgctcatacatttgtaggcttttaaggctgtgtttgagagtaagggttggaaatcctcctttcaggtacacaaaacgaaacatgtatttacgcatattaattaaatattagaaaaaaaaccttaaaatagattaatataatttttaaaacaactttcctatagatttttttttaaaaaagcacacaccatttatcagttgggaaacatatgggcgtaaaaaaacgagaagtaggaaatgggaaacacacccctaagtacatatgcatcttattttcagattatccatctgattgttgaaacaaattattgctccataatttgaaaaacacattttctaaaaaatatattcctttaactatattatttagaccacatgttttaaattatttaatttattcttataattgagtagataattcatagcaacgatccgtccaatagtctgttttgaatggagctttagattcatgatggacaattggacacatcaaaaaaattctataacctgaatactgttctgatagagtgacaccggtgtttcatcagcaggacgtatcaagtacgaaaaggtatgaatactggtcatagctatacaagtattggaaccaaagcaacagcacaacttgcacgagaagaatctgttcttacctttcttgaaaaaggaggcgaattgactgataaggagatcacactagtattcacttgcccgagatcaacatataatcgacacaattgtgagaataattccttcaatttgaatctttaaaatctaagcatatgcaaaactggaatatatttggccgctgtaaacatcacttccaagataaatggtgtaactacataaacaatacatgctttaacaaaggaggaagagagggtcctgaaatctgaaaatgtttttgtacaggcacggaaaagagagttggtttttcaaccttcatttctgaaacaaatatattttcacatgatctcacatgatcacgtgatcagtaattcagactttcagagctttaaaactttttttagagagagaggtttaagctgttgactgaatttgcagtaaattcacagggtttccgttcactgaagtgtgctttgtcaatatgcttgatcaactctctggttgcacctctgcgtgaagattacactgcttgtttggtaaacaactgggagtattggcaactccaatatcgtatcgatctaaggcaggagtaactaacaattgacctatagcattgttaaaacttgtcaggccagccagcagacagaaactcattgaacactaatctgcccaagttttaaacgtatccagatttatgcatccaaaacatctgacaccaagatcttaatttcgcactgaattaccccggtagatgcctcacggcacacggccggctcaggcattctaaatttctgaatattaggggttggtttcctatctgctatatggctcttcaccaaactttgctggtagaacaagttggtgctggtcacaaacagtttatcagtttttgacagatgagtgatgaccgaaatgactccacaagttgtatgagaattaaattagcaccatagaagtagatcaacaagacaacaagaacttgggaattgcagaatcacaaattcacttcacaggcttcactagcagctcactaacaccagcccatatatgtttgtatattttcagcataatagctcacatgcagttttgaacttccaaccggtggctgtacaaatcatggttctgaatattttcctaagtagaaacacatagccgcatcaaggattccagttccaggtcatctttataaagccctgtcataattttattaaaacttaatacctagttagccgtgctcatcttgatgattagtaaaagcttcagcattttcaagagaacttttacagtaaaatacactcgtaatatatcctgctagtaataagtaacctgtaaattcttagcgtacagtggaacaactttaggtgctttcgccgctcgatcccattcctcgttatccttcatcacgacgaggcgcctccaaccactgtggatccacatgtgccgccgccaaccaccacaatgctatgagcctttgactcggtgatagttaggcactaaactacaaatttactaatccctccatcctaaaataagtacagttttacactgttcatctccaacgtttgaccgttcgtcttatttgaaaatattttgtgattagtatttttttgtcattagatgataaaatataaataatactttatacgtaactatttttttaactttttataaattttttaaataaaacggacagtcaaacgttggacacggatatccacgactgcgtttattttggggcggaggtagtaaaatattgtgtggaaattttttttgttatacttcctctgtttcatattataaaactttctagcattgtctatatttatatagatattaataaatctagacatatacagaagtatagaggaatggtacatggcggtataccatgggtgtctcactaatcgtccaaactacccgtgctcatcttgacgattagtagaagcttcagaaattagttttctgagcctcgctccccaaaagcagaacagtagctaaataaagcagcatgacaactctgactttgaccctgcctcgtcaccaccatgacttcacgcccacgtcacacgcacaccccgaaatgtcgtgggacccacccgtcagcccccgccgaccaatcaaatccgtcgacaaaaaaccccacgctagtacacgtcgcgccacaaacatcgcatttacactcgctattaatccagaagaaggagcagatgcgatgcaataataaacccgtgaaaacaacatgtggttagcgtgcgcccgccacagctttgcttctgaaacttggcaacccaaatcaaaagttgattcctcccccggcctaatcaaatcacgcagaatttttttttttactgcttgtcaaaatccacacatgggctatgagagtgaccaaagagcgaaatcgaattgaagaaaaaattaggagtatttacatcgctgcagcatggatagctgatcagctgattttagtgatcttctctcttaactgaacaaacatgtgaaagtaataagaagaaaagaaattgcacacgatcgaggagagggtaaaattaacttgtagggggttaaacacaactggtccatgaatcttctttgcttgtgatgtgtcttcgattaaccgttggttaattaggcgaagtaaccattagcgctgtggttagcggcggaagtaggcatctgagctgactggaggctctgcaggagcaacctgtcctcggccgagctcagcgcgtggctgaacatgtcgccggcgccggtgccggcgccgccggcttgctgcaggttgccgtaaccgaacggtgcgccggtgtactgctgctgcggtcggaggagctgttggtggtcctggaacgtcggccggcgcggttggaggtggtcggagaagggaaggacggcgccggtgaagccgtagtcggagccgaagttgatgaccggaacgccgccgggccccgcgaacgcgcccgcgggcggcgccgggatgccggtgaactgctgcaccatggcgcggaagttggtggtgtccgtgttgagcagcgtcacgggcgcgcgccgcgacgccctggaccgcctcctcgccggcttccccacgcgcggcccctccacccccggcgcccgcgtcgggctcccgcctgtcgatcccgccggcgacgccgggctcgtcgccgccgccgccgcaccgttcgccaccacgccgccgtgagcagccgacgcgtcgtggtacagctcggcccactgcgccaagctcgagccagtgtcactcatggccgccatggcgatcgagcgagagacggatcgcgtcgcgaattgcaaaatatcggagtaaaaacggtggaaacgaaacggtatttatagcgacgcggcgaccggtcaaacggccaaccgaaccgggagacgatctcagccgtccgatcatgacatcaacggctgaggatcgttgacaccgtcgccgtctcgaatacgtccccgatcccgtgacagcggccgccgcctcctcacccctcaccttcctcgaaacgtcgcggagaggaggtggtgggtgggccccgcgcggggtgccacgtggacagccaccgtgctccggtacggcggggcggcggcggcgttggcgttgggtcacggcgcgcacggcgcgggatgattaattccgcgaggaaatatcgggcgctcgccgtcgacttcgtggcgcgagcccgcacgtacgcaacgcgcgcgcatgtcgccatcgcgcggcatgtgaaggcggcggcggcgggggagctgaggccggtggtggtggtggtggtggtcgaggcgaagcttccggtgaagctgcggcggcgtgtgcatgcatgcggcggatggcgaccgcgacgccggcgatcgagtagtaatgcggttttgtgtgtgtggatagtgtggtggatagggcgtcgtcgtggcacgtgcccggtttgaagaaggcggacgtcgctgtcagtatccacctcggggatcgcgtttacattccggccacacggaaagtttccacctccatcgtggtttgttcgaggtaaaagcgaaacggaatacttccaccgtttcgaaatatttggcgccattgattattttttaatatgattgaccgttcgtcttattaaaaaaatttaagtaattgttacatcttttcctatcatttgattcatttgattcattgttaaatatatttttatgtaggcatataattttacatatttcataaaagttttcgaataagacgaacggtcaaacatgtgctaaaaagtcaatggtgccaaacatttcgaaatggagggagtatttgctaacgaaaaataatttgtaaataaaactctaacttttattgtattgtctatatatctattgatataaaatctcacatcttattttttaaattttggaccatcgaatatgctttaagattcgtgcagagatattaaccctagctctcctcctcatatatgtgttttaaattatctaaaagaaaagactgaaaaataactataatgaacaaaaatcttaaactcaactctaaatttaaggttgaaaattaaaattttgactgacaagtataaatataaggaaaaaaatgaggatgttcactctccgtttgattacactaatgaggatattaagcttggacacgtaaaacgagaatattattagctcatattactaattaattgggtttaaattattttaaatttagaaatgactttataagatatttaaaagaacttttatataaaaagttcccgtacaaagtaggacgtttaccactttaaaaaaatgctaacaaaaatgatataaaatcagtatctttagcaattccctcagtcgaatcaagttatgggggatgcctgttttggttatatcaagcatatattcgacgaccactattggatcgtagtacaatggagtacgcctcttcggactgcaactgttgagaaaaaccatcataaaattgggtggcacaaagattgtttatcatgtgctcagtttctatttttgaaatttatcatgtgcttaaaatgatctatgaaaaatggtttgctatagcatggtcaccagacttggagcatgcttgctgatgtcacttgagtttaaaagttgaatcttcctgtttctaatttactttcgaccgatcgatttgttgataagtcgtagaaaaaataatgaaccagacaaaacttttgaatctgtattattcgtaatttgaaagccaagattaaaataacatactataaatttatagtgaaaacaaatcaaaatcgcttatatataagtccacgtgtagatgattagagtgttaaggaccctttttgtcactctgtgttgcctggctttcttttcatgaagctttaacaagagcttcaaaattagcttaggttttaagctgaagctgtgacaaattaaagcacgatcttgtaaaggttgcacattatatgttacactttcaccttcatttgcgtgattgcttccacgagcacgtctcctagctcgtaagcatggccaacactacaagtcaagcactaatggacctgatgaattagtggtaactacaatgttatgtctagctcttagttaattttctgatcaagaccgtagagtgattcaacgtacggcatgcacagtagtcgatcagggcgcccattttttacttgcaccgcaagccaaacatcgattaatatacgcttaccaaattgggtatatatagcaaagttagattagctcgttcagttaactaaaatgttcaaatgtcgatcgttcgaggaaatactcagcgtgttcacatattatgcacatggtttctcacttaaccaagtgtccagacc

SEQ ID NO: 42860 - DNA, 1376 bp, Oryza sativa
tggacctcaccgcgggtgacaaaatggtaagtgcaatgcatggttaattagccagccatgagctagcaaattctacgcaacaaatcacctgctgcatatatatacactccaaaaccatcaccaatatacagacgacaggcccgttcaggttcaggccatatatatatatgctctctaacctgaaactcgatcaatgcaagagtagcattggtagctaaaacaatacaacatctcgatcaaaatgtcattatctgaaaataaaacaaattgcaaatgcaaatgcaaatgcagcacatgttgtagtggatagctactaccactagtggcatgtactagtgctaccccggcctgcatgtacttgctacatgtgatggatggatcaaagtaggggcaataagtgcgagaggaggggttagccgtcttgacgacggcccttgtcgtcgagcccgttttcggcacgcctacacgagccctaggggtgtccatttccggcctcgcatgtgccttttaactcttgctccagtaacctgatcatattatgaattcagggtgtgcaagtcaagagaggaggagagaaattcaattcaatagctgatcctggcccatgtacatgcattgcattgcatatatatgactctgtgctagctgctgccattcgatcggtttatcttatccatcaagtgtgtttgtgtgtgtgtgtgcaagcaatattatggaaaccctgtgccatgtgaacggtttctttctctctcacctgaacaaagctaagagcatgccatgataggattggtggttgaagaaggcatggaattttatccatgtgcgtgcgttcgcggttggactatccgcttggttcaaggtagcttttagcagctgcagggtttatcttttcgtttttgaaataaaaaccgcttcgtattggtttactgaaaacataaaactggtgaccttcggtaagcgatgtacgaaaaccagctaaaacggatcggttttcacaaacagacaattaatgtttttacagaagatgtatgaacggttttgcgaaaaaaaaagatcggttttgtgaactctaactttatttctaatctccaactctctccaaacaattcatatttttcattcaaattcttaaaatctgtagttataaatcctaaaaaaaaataaatcaaagttggttattactacctttgaaaaaaataaatctgtagttattgctttatgaatttgatttttatgcttcttcttctctctttctttttaaatattcagctttgatgaggtttagcaggattgcagctaactgatgtctatgcatatgacaagagcaataactctgttcttgtcaaatcaggatatatagtataggtgggtgaaat

SEQ ID NO: 42861 - DNA, 8653 bp, Oryza sativa
aaaaaatcttcgtgtgctagtgagaatttgggtgaatagccaaaatggtccttcaagtttcatctgatgctcggtttagtccttgatgtttcaatctatctatattagtccttcaagttttcattttagttcaaacttatccttgaaccaacaactctcttcataaatgacatttataccctcatcattcacatctataagagaaaaattgcatgcttcaatttttttatagataatacatagtatattatgtaaaacgaaaaaaaattatgtactaacaagtgtatacgatagcaattgcttaagttttatgtgcacatgttgaaataatgggaagtatatctgtaatgttgtttattcatgttgcctttctcttttctagtatatagatatatacaaattaagggtaaaaaggacattttctaatagaaatattgatagaaatagccatatggcatattaagtgcacccaaggatgatttcaagtcaaaacaaatatttgaaggacctatgtggacaaaatgaaacgtgaagaaccaaattgagccttagctgaaacttgagggactaaattagctatttacccataagaatttcagtgtggttggtgtttttgaaatccatttcatgaaacaatagagatgcaagtgggtagtctcactacctgtataaaaactcgcttgctagtttatttctcacacaataatataaaatttaaaagaaaaaataaattaaaaatgagataagcgggctaaaaaaaacctacatgcccgtccggcttgcatgcctacgaaacaatcccatgtgtggcagcagtggacaccgtgtggccgccatgtgaggcgcgggcgctgcacctgtgcgacgatccaggatgtgacgcgtgcccccttatcgtccgtacgatgggccccaccgtggcctgaagtgggggaacatgccaagtggggcccggcccggccgacctctttggagttgttcctgggccgtcagatggtctcatggaagaggtccaagaggaggacgtcgctcccgcatgttaggacagtttgtggggcccacggtgtcagtgacagggcgttgtgcctagtcaaagttgttgactggctgtattgcgtacggaaccaccgactcttaccatcgagatggattgtgacgtgcagtgttacagcttagggtgtgttcggcagctcaattactgtggctgtttagttggtgaaataaaaagttttgggtatcatatcagacgtttggtaggatgttggaagaggttttcggacacgaatgaaaaactaatttcataactcgcctgaaaaccgcgaaacgaattttttgagcctaattaatccgtcattagcacatgtgggttattgtagcacttgtggctaatcatggcctaattaggctcaaaagatttgtctcgcgatttatatgcaaactatacaattagtttttccttttatctatatttaatgctccatatatgtgtctaaagatttgatgcgatgtttttgggaaaagttttttttaactaaacaggcccacagtggttgtgcagtgctgctgctgtagcggctatggctgaaattgtatggtgctactgtagctattggctgttagtacaacttttttttaagagctacaacatgcaaatttcaaatttgattcgagcttatatgacatgcgccggtgtatttgataggtctaatctcgcatttcagatgtgccgaaacatataagctaaaatattagcatccatcccaaaatataaaagttaatatttactgctccatccgtcctaaaatataataatttagaactggatgggacatcctggatgggacatccggttctaagtttttatattttgggacggaattatcttgtggcattaaaattttagtgtaaaatttagttatctaaagttacttttgtaaaaacagtttaaaatttttcataagctaaattttgcagtgctcatgtacgactgtcattgttgtatcttcgcaccggaaaggccaaaacagaattatctcgttaggcaagtaggatgagacgatgccacaagtagcatgagatgagactacatagtggcatgtgacacctttacatactacagctcacatagattagagatccatgcgtacgcagtcctaaaatataaaaataaaggaatgaaagcaacatattctattactgtgaatctaagccgattcatagtacaaatatacatctcattttgttatataggtttttataatttaggatgaagataataatggctgccacttcactcaaaacaacacaagattggaaaagatgaggtctttcgagatagaaggagtgggaaaaggagagctcaaagctcatgactcgaatcagctcggattggtttaaaggtaaagtcgtagcgatatagtaagttcgagccaaattaggcttttaagttttaactagtaagcttaacgagttagatcgcgagctaccttgttagtataagataccaacgtatctttatatactttgtgcttacttagcattttaattacatctaaactacttacatttagtgagttctttattactttgtgtttattattatgttaatataagataaatttaaaattatgaaagtaatataaatgagatataagaagtgaagataggtactccctccattctaaggtcttcatcggttggctttttccctaacaagccaaaacggcttattagggaataaaaataaatttgtaggtaaaacttttatatatgtgttcttggtgacttaaaagccaatataaaaaagaaactacgctgaaaatatctcaaaatcaatctccaaattaagtttgaaaatttaaaatttggctttttctttggctgattaggccatccgatgagagcctaaaatatactacaacttctactcctccgtcctaaaatataataacttatgggctttaatttttttccaaaaacatagattctctttccaaccaaccataacccctctaccattcaattttttcaactacctccatttctcaaccaatcacaatctcattccatttaattctatatattttcttaataatcgtgtccaaaaaataatattccgggacaaaattagcagcatttaaaattcgtttcaaaatataacgatttcttcacttttattgagttctcaaccaatcataatcttcgaccatcaaattctccacatatcttgctttttcaaccaatcacagtcatttctcatttaatttcacctactaccactctaaaacctgttatattttagaatagaagtagtaactcattaaacatgtcctctatatttggtttggggatgaggtgggatgggttagactcatttccatttcttggattcgtccgtcaattttttagggaccagaccatctgaagggaaatatttcctctcaggatcatcctattccagttattctcgaatcaaacgctattaaaaataaatcttgctatacgtacgactgagccatacgatttgtgtccgaccgagtcatacaaccaatcactgaacttgtttactaccatgtgggcccaaacaaatagcatatatgcttatacatacactagtcggatggatgggtcggacttataggtcggacgtatagcaatttcgataaaaaatagattcagcctgatccatcccaacattcaaccaaactaagggtgtgtttagttcacgccaaaattagatgtttgtttgaaattaaaacgatatgtgtgtagaaaagttttaatatgataaaaaaagttgaaagtttaaagaaaaagttagtaactaaacaagggctaatgcataagataactgcggggtcgtcatccacccgaattgcccatccggccacggccactttggccgcagcgaacctctgaagcctgaactcggcgatgtgagatgagagaggagagactggcaaaagaagaggactgccattctgccaacaaggcagagagagtactcgtcaccctcaccggccagtcggccacactcgagtgtctggacgaccgtcgtccgtcgtgtcgccaccacacactcacactgtagctagctatcatctcatcactgaaactttccaccaatcctttcctctaaaaaaaggctccgcttttcaggcgacacacagcgccgcgccgcatccgtccacgatccatcggcatcggcatcggcatcggcatcggcggccatgtgaagcgcggcccccgccaccgccaccggcgcgcgatcgagctgagctgcgaggagaggagaggcagcgaggcaggctgccacatgggcgggagacacgcaccggcgttgccaacctcaccgggggacagccgtctcgtcgatctggtgagtgactgttgtctgctggtgtgcgcaggcgcaggcgccatggatctggatgatggatggatggccggtgtcgaaactagatttcggcaataataaaagtgtatgggtttggcagtcaaaattagatgtttgtttaaagaaaaagttagtgttgacagtcaaacttgatgttgacagtcaagatagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatctatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagtagcccccgagacctttgcagtcaaccatcgtagccttcccaaagataataatccgagtgcttcaaacttttcatgccaaggcctaccgagtagcgaagacgaagactgtaaagggcgaaaagataaagaatatggtgcatcgaatagatgcacctaattaggtgtagcccccaactatgtgattagttaacaaactaatcatatagttgagaacaaaataatagcataatcatgcatcatatgacaatagcatacgcggcgcctaaagaggcattcttgccgactgctttttagccataataaaagaaatccgagtggttaacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcacctcttaatttgcattgcaataattccaaagaattatatgaccgcataaaaagcatttcatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgctggcgaactagggttcaccactccactcaaatccaccttcgaaaaagtgcatcaaaatccttcccgtgatccaccgcctcaattcctcacctctcccaagccatccctcgaatcaaatcagcgcattcggggaaaatcgatggcggaagagaaagaaagctttgaaggccagtgggcgccgtctgacgtaacggaagagaacctgaaggagatggtggcgcacggcgttctccctgccaaggagatcatcgggtggcggccagcgtgcggtgagatttttccgacccccgatacacacgagattgtggtcttctctcatttcttctatggcggcttcgcccttccgacctcgaaatttttccgtgggatattaagcttctatggaatgagcttgcatcacctaaacccaaattccatagtccacattgccaatttcatccatgtctgtgaagccttcttaggaattaaaccccacttcgctctgttccgccgaatcttctttctcaaacctcaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagatacttggaactctcttccaatcggagatgaagctgcccaagccttggaattgttggatcgcatgttaaaactcaaagaacgaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgctattgtcgtcagctactcacatcagctgccagttgtaccatataatgcattcaatccgcctccgcaggtatgtatctgaaatcttcaacttatgaccaaaatagtatcttgtcttcatgttgagttaactaaccatggaggcatcttattcaggaatatgtattgatgaaatctgatcccccaattgctcagcgccgatctcctcgccagcacaccattcagggaagtggagggccgacaatcaggtcagacccacaacctcagacctccaaaccggctgggcagacaggtcctcgcaagagaaagctggtgcttaatgacgacgagggcgatgacagcaacaaatctggggacaagggcacgcccaacaaactcccaaagcataccatgcccaggaaaaaactggctggccgtcaaatgccaaagattagaacatcttccaggtataaacttctcggtaccatctccctttgatatgcttctctcatagaaattacgctgaatatcgaaaggacactttgcaggaaaccatccgacatagatccaactggaaaagatcctgatccggctgtgacagagccaaatttatccaaagacgctgagccgtctgccgaaaaccagccgactgccgaaagccagccgactgccgaaagtcagccgactggcgcccatgcttcggatgacaaagccgatccgagtgaccagccgccaactggagaccagtcggcaacagctgaaaccgcaacaacacaagagcccccgactggaaaccagtcggatgtaggtcccgatgaagaaatccctcatgttcagccaggaacatcctcaggtaacacatcttctcaagtgatgccgatttaaataacttcagcttactcgtctaatgtcttggaaatacatcaggaacactaggcgacgacgaagaaacaattcctcgcataaaggcggctgatgattcccgtcctcctatcttactcaaatggtgggacgagaattcgcaagttgccggcatcgtcataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaagctggttcctcatttgggaactcttgaagcagttagggaccagctgcatgaggccaaggagtacgccaaaaagacagagaaggagttaagggaccgaattgcccagctccaggattcaaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccttgaaaagagacaaagtagaactagctgcgcaaagggactcagccttgaaggaggttgaaggtactgccaactgacaatttgaactttcctctctttaatgcagcagactcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaataacagtggtccgagtgcacttgacgcaaccgaaatctttgacaagctgagagttgcaccggatgtatacttcaaaaatatcaagaaagctggaagtatgggagctagta

SEQ ID NO: 42862 - DNA, 763 bp, Oryza sativa
ttctgagataaagaacctccagatgttggatataaactccccatcatgttcagcatttgaggtgatcctgatatcagaaatttaaaaaaaagaagaagaagctgaatgaaaagactcacgggctttcacctcaatagatataagctaatacatgatatacctcttgttaaacagtaaaatattatagatacatgacatcacaaacatataaaatataatgtttctaagtatttactcagcatcatattacttacataaatcatattgtgatgccaaaaaaaataacagttataaaaataagcaatagatattctagcatccgatgcatgcatgccaggaggaggaataccaatatttcctctaactctgacacctatcaaatgatagtactgttggaattttcatttctaatcttaatcctatcaaatgcaaccgactggtgttcttttaggacgcagcgcgacagcagatgctaagattgaccaggttataactttggacgttacaattacattacaaatgtggtaaggaaacatgaaagagattgtaaaacataagctggactgtgttggataaacagtgaaggcaccaattactttcagcagataggttgtggttggagcttttcttcaggtatgactgatttaggtgggaagcttgttaaggtcctaggatttttcttgtttctgatcatgatcccacttaccaaaacttttttgtttgctcactaacagcacaaggatcctacttttagaggataaca

SEQ ID NO: 42863 - DNA, 3823 bp, Oryza sativa
  unsure (1)..(3823): unsure at all n locations
ctatttatacagtctgttccataatttaccttgctgaagaatgccattcatcatcctgctggatccttggacattcagaccgccactgccaacattgccactcaaattcatgcgtgatgctatgcttggcacagataatccaccagagcttatattccttccaatgttacttccacccacaatatttcctacagaaccagtgatcctaggacccaaatttcccaaagatggagatactgacatcccaggaacagaattacgactaccaccagcacccaggtttgaggataagccttgaatggtaccaccaatattcaggctactactaaatgctggacctccaccaacattcaatcctctactaccgactcctgaatgaccatgagggatctgcaacaaaacagtaacatggtgaggttacacgatcatttcaaccagcaacaatgtaccttagtttccacaagccgtcagcataaacaataaaattgcaatatggatgaaggaagtcattacaacctgggacatgccaactggaaggttgtttgaagcaaatctcccaggcatgctccctccaggctgttgaaccccagaggatggaaggccactcatggcagcattcctctgagaaaacgatccaggcatatttggcatatttaaacttccatgcatgttgtgcaaaccttgaaaaatggcaagaagatttactacatgaatgtagcattgtgcgaacaaactaaccaagctattttactatatgctcaccagagtgatggaaaccccctggaactgatccagattgaccagaaaaggaccctgtaaacggtcttccagttgagtcttgaagatttgatgcagaattgttcaggtttgactgctaggaaaaaatggcaagttgtcaaaacaaagaacaaagcaggtcatatggaattgccattatcttcaaaagcaaataccatgttgggttaagcagcagcataaaagaataaatagtgcccaaccaaacagattatccaccacagatatattagctctgtcccataatataagggattgtggctacgcatttgcatagacaaaagccccttatattatgggacggagggagtagctgataatgcagtgcctgtacatgcatagcttatttaggcaatcaatgctaatattccctgccatcacagttctcatatggaagtgtcaggcttcaaatttcatatgaagcatctcaacacagaaaactcacgtaaggatggcaaagaatggaagaggacagtgccgcagttgtaagaaataaatgtgtgtataaaatataaataaatcaacactatgttataacagaggacaattatcactttatcaggtgataaaagacaaatctattgctcgttatccacgcgaagctgcagcataagcaaactatttgatgaacaaactagtcagagagaaatcaagtaaaaagtttgaaatggaaaatagggatatcaagcgaaagcacaataatcagttgtaaggataagcacgcacattcagcaggcccgacattgtgacagcaacaaaagcaagtcaatattcaacagtaagcagctattccttccaatctgaaacagaaaatgatatgtgtaagtagtttgaacaaaatggatgaatccacagaaggtgctagatcactaaaactatgtagtatgtatgactccaagggtgaccaaacatttatatgtcttttataataataaaccaacgagtaagcacagagagcaagaggggtaaataatcggtataagattgattacaccagtcttccaataacaaacctagaagtaaatcatcacaccataaaacatactagcaaattttaacggtaaaaagtccaattaaggataattaagtcggtgccataacatatgcagattttaacagtaaaacaaggaagttaaacgttatcatccaactctttaacaatttagaaacatgattagcgccatcaaccacgtagtatgaagagtaaactctgaatgcaggaaacgccaatccacaatccttgatatcaaacgagaaagttacaaaatccccactatccacccgattctccctatcagatctgcccccgcaagtagtagcacaccgatctcaaccctccggcctccactccactctcccacaccgaaatgagcaacaaaccaaaatccaatccctacgaacgtccaggaaccctacggcagcaaccgatccgtttccggcctaatccaaggccccaagcgcgcctgggacggatcggatggggtggaattccacggaacgaccagaattgggggcaaatcaagagggttagggttgcctaccgagagagaaagagggagtccgcccgcgcctgcggcacgagcagaggaggaggaggatgagggatcgggcgcccgccggtggattcggcggaggcgggagggaattcggcggcgcgcgagaagatgatccggtgggttcgccgcggcgcgcgtcggcgatggcgcaggggagggtgggaggagaatggagcggaggaagaagaggggtggagttgggctctctgggccgtaagagcgtgatggattgatgggccagatactttttcatgggccttatcaagagggagggagcagtgagcacggagcacggttgttcgtgtttttttttatcatgtttcacaccttatactctcatgtttttcacactcacatttcctaagctattaaataatatttttataaactattctgtaaaaatattgttttaaaaattatattaatttattaatttagtttttatctactatttaattaatcatgagctaatatatcactttacataactgaaagtgtttctaaacccttcgaaagaacacggccttaactcccaaggagattgtgagaaagtttgttttgttttccgcgtgcacgcttctcgaaatattaaacggtatattttttaaaaaaattatatacgaaagttgttttaaaaaatcatattaatctatttttaaagtttaaaatactttatacttaattaatcatgcgctaatggctcacctcattttgcgtatcttctcaatcttctccaaccattttcgtttgagcttagacttcttggctacatgtgccttttaagctttaagtttattggtggaatatatcttaactttacattttaaaaaaagctactcaaacttagtttttagctttaacagtgtaagggtgacctgtggttttaaaaaagtcaaacaaaaagagtgatggtttatttggacttaagcttttttaaatatggcttaaaaagcctaaataaaaaggaccttagctcattgaagactctgtttagaccattatttgtgctattgtatagatagggcagcatactatttgtgctattgtatagattgtttaaagaattgtattaattcagtatgcatatctaaatatactgttatacgtccaatgttctaatgtgtaaatataaaatggaaaacttctatagattggcagttatgtataccattgcatcccttttcaactcttagaaccgtgatcaccccacccctattgttctgtttatcatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42864 - DNA, 926 bp, Oryza sativa
attcctgcagccctttggatagctagattagacagattctgaaagtatgtgtatggtacataaatgccagctgcgagatgaacaatcatgacttgatgtgtcttcacaggctaacaagaagacaagaaacagagcttatgatctacttattgaaattggacgtgcttgtgaagatgcagaaaatgacgggaggaaggagaatttgcaccagttctttggcatggtactttatgtcattactgtttttaaatgtcttgacaggaccaaactaatgaaatatgaggctctgagccataccaacctcgaactgcattacatttgatttatcagtgctacttttatgtttaggttgctggtggtcttgctggtcaaactccatatgcgattagtgcttctgtaactgggttagctcggttaacttatgagttctctgagcttattggagtagcatacaagctcctcccatcaacttttcttctcatgcagaggaacaaccgagagattgtcaaagtacagcacacaacacatttctggtttattagcttatctatcattctcttcacctccttacagtagccctatatttcctattcaggccaacttaggttttatcaaagctttggtggctaaatctaaagccgatgtattgcacgagcatttgaaaggagttgtcgagggtttgctgagctggcaaactgatacaaagaattccttcaaagcgaaggtactggctatttgcttttgatactataaagcaatggcatttctggtggtatttatataaacgctcacaaacaatgatatggttgtttttgtcctgtggaacttttactattctaataactagatatattcatatcaactcatatagacaatatatgacatgggagaaactaaaagagtgaaatatgcatgatatatcacat

SEQ ID NO: 42865 - DNA, 4300 bp, Oryza sativa
cagataagagcttgctagagaagttcattgatcagtcaactggcgagcccctagatttacttgaccagaaaacagtgcggttggctctcaaatcgacgaaaaagagggctatgcctgatgaagatgatgatgaggtggagatggaccctgaagggcgtatcattgtgcgggaagagcgggagaggcgcaaaaagaagcagcctatctcccgagacgacgaggccgacgacaggagcatggtccgaagccagtccgtcaagaggaggaagacgaccagctccggctgggcctacactggccatgactacaccagcaagaaggccagtggcgatctcaagaagaaagacaagatggatccgtatgcctactggccattagacaggaagcttctgaaccgcaggtcggaccgcaaagcggcggcacgcaagggcatgagcagtgtcatgaaggtgaccaagaagctcgaagggaagagcgccgccagcgcgctcgctgctaagagaacgcaaacaaaaaaccggaagcagaagaagagcaagtaaggagacgaagggacagagagagatagggcaaggaagctttgtatagctgaaccgatggcccttggcagttgggagggaaagttttggacgtgtacagtgcttggtgaggattcggccgtagtagttgtttttgctcgtttcatctcctatctgtcgaagagaaacactaggttccattcttgccaaaaagggagattttttgaggggaaaaagggggaaattttgacacccgtcggtatgacggtaccagattcagattagatttaattttcttgtaagtttttgattgatgactattgaatttgaaatttgttgcttcctgcccgctgacacttcgctgtaatggaagatgagctgtagcgaaatttccgaattccttattcgggcatacgcgctaaaacaatcgcgcgatcgtggagctgtacggggatgaaacgcaaggctacggcgtacttgattttttttcatagaaagtgattttttttcttagaaagtgattttaaaaaaaagacactgtcaattcaactttttttttttaacaagggcaaacttcaactgtaatatttaaaactttaaacttaaaaatggaaacaaaattaacttgaaaacttttaactcaaattttgaaactttcaactcaaattttaaaaactttcaattaaaattctgaaaacttttaactcagagtttaaaaattttcaactacaaattagaacttcaaactgtttttaactaaattatttgtgtttttttaataaaaagctaatgctaagcttcatcattagcactattagtgatgttttgcgcgagggactaggtagggtgcatgcggccacacactaatcatatggagcagtttgaaacaagggttaatttgatccgtgacattacaaatgtgcctattcagataattagtctatttatagccatgtcattcaaatttttacaaaattggaaccatgccattgttgtctcgttttctatcttccctatccgtgcgtagggcccgccccttagattcattttcttcctctttcctcctctcttctatttttttttctttttttcccatctctctccaacactttcccgcctcctccccaccaatccatcccgacccactcctcgccgcccgcagcaacaagccaccgacatcgtactcgaactccgcactgatcaagcgagagagaaggctgccaactttgtcagtggtggcgacaccagcatccaacaccaacattgtcgttagctctagcgcttggagtctgccaacgccactgcctccatgccgactatgtgcctctactggccccgccacgttggaccggccttcctagagctcgccggccagcctccgcatggtcagcggggagaaccagcatcaggaaggcaggaacgggcaaagcaccatggggaggggtagcggcgaaggctacttgttgcatcgttggctagaggacgacggctgagctagagcgctggttactcgagctccatcgcagctgcttgaatcaagtagttatttcacgagaagaaggctctagtggcaacaactcgggtttggggatgaccggtctcatcatggagccggcagcaacaagatccagctccggacggctgtaggcgacgacaatgtgtgaaggggtcgagatggattggtggggaggaggctgagaagtagtggagagagacgggaaaaaagaggaggggaggatggagggataagatgaatttgacgggtggggtccatgtgcatatggggaagaagatagaaaacgtaacggcgatgacgtggttctaattttgtaaaatttgagtagcatgattatgaatagacgaattgtaatgacatttatctgaatatgttaacagtgaaatttggtaagcccaaagttaccattggtttagagtcagtatcggcttcaaagttctagaatcagccgatgggagtcaagtcgccacgatgtcgtgttcttggtggagtcggatcaatcaaaggaagcttatctagaagagttcgagttcaagaaggatgcgacatgacagttatctattaattaggcatagtttgttagtttccttttatctttagaaaagtgtgtttagtgtccgataaggactttatcttttccttttatctttaggttagtttctttcttgtccgacaaggacttgtatcaacccatgggtataaatatgtgcacccggggtctatgtaatctatcttcacgatcaatacaattcggcgcatcgccaccttttaccttttctactttattttatcgcccagtgggacttggcacccgacgtgcggctgcatcgtcttcgatctccggcgaaggggtaagtccaatgttccgtcggcccaggcaattgtatcgtctacatcggcgtcgttcaaggctgcatcagtacattcgacctcttggattgctctggtttggatgatatatttgcctagctatttatcatatgtctctattaatctagtcttagcatatcaatttagctctatcggctgcttctcgctttagggtttctgccggtatcggctaaattgcgttgctagattagattggcctaggcatctaccaccctgaaaatcagtcaacggcttgattgtctagatattgtgtttcttttcatacttagtgctgcatcagttaagtttgatctactaaatcgtgcttagaactataatctctaacctgctttctgactgccaataagggtttcatcggggtttcagccggtgaattatctggacgttgcatcggctcataaggattgcatatacatataagttggatttcgccgatgacaacaaaggtttcactgtttaatctaatcttgtggatttcatgacatcggacctccagccgatttgttatattttattatcagtagccgattgcctttatatcattatatacattggacatatagccgattgcttaaaccctatcgctatcggctggtatcgacatcggctattatcgactatcggctggaactactacatcggcttgtcagccgatcggctgttttgatctactatttacatatcttgtcagttgcatgatcaaactgactggcacgcccgcatctcatcgtatttggacctgcactggagctaagcagatctcccaggccggtgtgttcgatttttttcgtcaacagaataggcatagttgcaatggtacagatcaaattaacccttgaaacaagggattgaagcctactaattcctttgaatcctatggaatgagtacctattggtctctcaacagacgatatgacctatcagtgtgttataaggaacaataccttaggactgattttttttttacaattttcgataaaaaatattgttacttatttaaaaattcacaaatctaggtgatatgtcacatttagaattttgagttttaatctttcttggtaagttccaagttggctagatgcaaaagtttatatatgaaagaacattgataatggtggggtggttttgaataggcatttttgaaaattactacttagcagcggtgtaaatctatccagaggatcatgccagaaacatcgaaacttccggttggtcttctcgatctggacaagagagctgaatggagtttccagtccttaggttcaaaactttcgatcccctagtttcttccaataaagagggtgatagggacaatcttcatggaacaagcaatccaaacacgtagagaatgcaagaacaacaagcaataacagtt

SEQ ID NO: 42866 - DNA, 1065 bp, Oryza sativa
tgtttttttcaaaaacatcacatcgaatcttcaaacacatgcatgaagcattaaatatagataaaaacaaaaactaattgcatagttagggggaaaattgcgagacgaatcttttgagcctaattagtccttgattagccataagtgctatagtaacccacatgtactaatgatggattaattaggctcaaaacattcgtctcgcggtttccatgcgatttatgaaattagtttttttattcgtgtccaaaaacccctttcgatatccggtcaaacgtctaatatgacacctaaaaattttcatttcacgaactaaacgggcctaactgaactctgcacaagtactaccaaaagttgctgtgattattgcgttgcggcagcaagtgcatgcacggatttgaaatcttaatttggacgcttgaagagaagtattagcgctatttggttagcaactaattttgtcacacgtcgctttaggtaaaccacacttctttcagaagatagtgttggtttatatcataactctattttatctaaattttaatcacctggcccacatgtcatacacaatatttcttgtctattttttttctaagcttagtttattatttgagtgaaatacatggccggtccctaaatttgtgttgtggtgtcagttagatccgtgaacttgaaacttgtacatttagatccgtgaacttggtttaatgtaccaactcggtccaaacgtcctttgagtgcgtttgaccgccaacgtagcatgccacgtaggcaacacttttgctcttagccccctccacatcacaattcacaacacgtcgcatatatctccttgtagctatatagtgacaccagaatccaaaaaaaaaaatcctcaaatctccatattattcttctccttgcatgtgtagaaaatgcggtcctgattagcaattgccattgctctgcgctccaaaatgaccttatcattgcataacgggctcttgatcaacaacaccttcttccggcgacttcaagaagaggacaagcttggagaatcaggatacctagcgtgcaagccgcatt

SEQ ID NO: 42867 - DNA, 1717 bp, Oryza sativa
agactttcccttaagtaggcaagagacaatccccatgagagaaaggcatgaaacaatcatcaatgagatcgcagagacaagtaaatagaatggtttctgcaaatataacagtaaaaggaaaacaaatcaatttgatcttaaggtgaaaggaaaaatgtaacagaatgctacttcacactagggttgcaaagatagtaaaattacattggtcgctctgtgagacaaccactcactcgcatatcttaagaattcatagtaggcgttgacagcagtcctgttgcacccagcttcaatggacctgaaaaaggatgtatttttaagaagtgaaggttgatcatattcacaacagtttagaggattttaacagcagacgcttacttgacattagatgtctgatgaaggtgtgaaggatggtgggaatcaaaagctttagaaagcaaatgacacaacttcttctcaacagattgaggaattttatcaattcctagaccatactttgaattaatgcaatcctcaaagcagaaagcaggtaactgtgcttgcaacaatcttaagaattgcaatgagttcagctctaaggtccgcagtttttgctgatctgaaataagatgcactcatcatattttgagctgaagagttttgagtactgaatcatgcaatttgtaaaattccaatattccagaccaccagtttaactgagaactagcataatgcctgtgttgcaacggattttttttaaaatagctcattacatatattttaaagcctataaaaatatagtctaatatattatcatcatactaattctgctgttactttctaggtgactgttcagttagctataggggtcagacatcacaaagtcttgtctcactgttcgtgggtcttacatggtagttgggtggtggtggtggcagacccacaactaccactaacatcttttgagatagtatagatatagacatagcaatcaactaaaggcatcgggacacatgattataaatccatcaaaatcctattacctattgaaatcgttataaagtcgacatgcatcaaatatcttaaatttttttatgaagtatcctgcatcctgatgaagcgcaagaaactgaaaacagaaggtaaggatagattcacctgtcaaagaattaaaaacctctggaagcacaacacctatattgttcttcggaattggtgtcccaaagaggagagataatgttggcgcaaggtccacctgacaaagaaaaaagagtagtcaatggaacactactttaggattgttcgcaagtatagcttagatgatgacaaaatgagtggtttataaataaaatattcaacaacaacaatgatttatatatgaaaacatactcgatgagtggatttgccataggtatccagagataaagaaaggatgaaactacattcagtgatagagtaagagttatacctgaagtgcttcattctggtcataaggtgaacaatatgaactctgaacactgtgtcctataaaaagggcaagggagtcagtttcttcataagaggatcctccatgattaccaccttcggtcatgccatgatcactaaccacaacctgaaatgtcgggcggcagaaatatgcctatgagatttaatgtagacctttatctttccagaaaaggcacagacttgatcaacggttgtaaacactactgaacttaacaagctattatagtttgct

SEQ ID NO: 42868 - DNA, 14890 bp, Oryza sativa
caaggataacccatcagataatcagaaaccacaatcaataaacatcactactatttagaaaggcgccagaataaaagttattaagcatacatgtatcaaatcatcactacaaacttcaccattcactagtggactttgtagtaatctcttacagatgtaggatcaaacttgtttgtcacaaacatacatgctaccaggaatcttacaaaatttataggactcagataggatcacaaaccaaaagtgttctgtccaaattatcttcaaggcctgatacggcattgtgcactcttctaatcacatcatccatctccttcagcttttggggcatcaaaacactgtaaattttaaaattttaactttacttagacaccattcaaatagaaaaaggcatggaagatgtatggtatttacctctgacggccaccaatgtggccaacatgatctaagcccaaatagtggagaatctgaaattaacaaacaaaacaaacctgattagtacataagaatagaacacttgcaggataaccttaggaaacagcacaaacaagggaagacagtgtaaagattgttagaacacttatcacaagaaacattaattggatacttggaataaattgttgtaatccaaagacctatattttactataagttcacaaaggaatagaacaagtgaacatgaactaagccaagaacataccaacatgttccagtctttggcagcaaactcagattccagatgacgagaaacattaaaatcaacctcaaccgtatctttcacctgacatccagtcacaatcattaaattaagttatacaggtagaaagactgaatgcaaaacaaagaggactgctattagcctattagcaaaacccaagcaccaaatcacaagcttaaaatacctaatacacaaatatctatagttggcaacctactgttagattagagtttcacacgatagtaagtttattttatcagtattccaagttcaagtacactctcatctttcaatcacattatcttgtgaaaaaaaaagcatgtgatgcatgagaggaactcacataaaaactgctcactccatcttgtctccagaataattttgggaacaatttgatccatgtctcatctcccagcatcactaacttataaccaatcatgtggagctgatctgcattggtgtgaacatattataaatatagctcataaggcattttcttgtttggtcaggccagaactgatggatgacgcagaacacagaggatgatgaatttgaccaacatgttgaactcaccatgttggcaattaggtatgcaaagaagatgattaatacaagagaaggataaggtcaggtatggagaggttctaaccaagaagattgtcatccaagaaggcttgagtattgaagttaaatgctacatctagaaaacctccaattgccccagataccattgcctgaaagtataacatatttaggattaccaaatacttacacaaataggaacctctatatagaatcagtcttacttttagccgtggcatcgtgacggttggaggtgcagctttcgcatgataacctgttgctttgcaaccagctaacagagattgggtgtagggcatggattccaccatttctttgcttggaggttttccaactctccccaatacgaattcagcaggaagcccatctataacctaaattgacacgcataaactcaaaatgccaaacattaaaagggtaagaataaagttgccactgaagcgcctaggattatgctgtgagaagaacaggcacatcaattttgtgcataccatcaacaccaaacgatcatacacaggagggacctcggagagttcctggaattaatcatagcacaagcatgagcatcgcaacactaaaaaaacactgcacagtatgaattaacttaacatttcaaatcttccatctctctatcacaagtaatgcgcagcagcatgagatgaacctaagccggaggaaccgagatgtctcaccctgtacagagatctgagctgatccggcggaagcgccggttgctccccgccaccggcgagaccacacgacggcatccggtagctctccgctccactgcggccaccaaccaagggtcaatcgaagcaagcgccatcgacagccgctgatagagcagagcagaggtagaggcgcgaacctgaacccgggcagcgtgggcttgacggggaagaagccgtagaggaacatggagaggccaaccacctgcagaagcactgcggtcacggtccaaccggcgaccgccgcgcaggaaggggaggcgccaccgccgccggccatggctgattcctcgccggtggccacgagacagttcgaacgggctgaagtgacgaacacttctgggcctaatggcttcaaaatgggccgtgggaagtacactagcgttggcccaaaatcaaaatgggcgttaaattgtatcgattcaattttgcttcgacaaaaatttgtcaaatgtgcaattccatcctaacttacatgtaactacaatgtattaccttcatatattttaaaaccattaggttaactttaaaatttatgtaagttgggaagaaaagaatcatagcacgcacacaggtgagaagattcagtctcacgatctttgtttcacgaaaatagcatattgtaaagaaattattaaaattacatatatattatattgtagttacatgtaaattataataatgtaatcacattataattatatatattatatttatatttgataaattttgagaagaatttttatatagtagcccccattggtttgggcccaaacaagcccacaaaaatattttgtcaccttcgtgcgcgttcgccgtttgggataaagcgtctcctccccctccgcttcgcgtcggctgctgctgctgctgctgctctctccgcgctgcgcttccgctgctctagggtttatctcctgctgccgctcggatttcgcggcgagcaatccaccggagatggcgcccgtgcagttctccgccgctggagttggcgcggtggccttcgctacgaaggggatggcctcccgcgacgcgctccgcctcccgccgccggcggccgtccgggtgctccgccaggcgccgcggccgtcacgcggcctcgtcgtcagggccgccgccgccagcgtcgccccgaaggtgcgttttcagtgcaatgtaccatggtgggcacactggtaatgctattctcggttcagagtttttcacttagagggttagttggtgaatcgctggattgggtattgcgggcaatgctattacgatagcgatgaaatcgacgatgattccgctgggttaactgatttatttctgttgaatttaatgatgaatggtgatagatggatatccgagcccgtctggtgtacggtgtgccctgtacacacctgtattgctgtggtggttagctcatggtgattgctgattaggaagttttaagattgtgatgcagtgagctgtgatgtgtctatcgctgctttcccacgttgactaccgaacttactgtcagactgatgaatgatgaagtgcaaatcagttttggaaaaaaaatgaattatgtatccttgtaataaaagagtaatgaagtgaattatagctactctatactttatattttaattattatgagcaataaaataatgacttacaagtacactatggattcagtgaagatatcgaaagggggggggggggttgaaagcaattctatgcttaatattttagtttattttccagaaaatatatttgttatgcttttcagtgatgaagttatgttctgttattcacttgcagtatacaacgctcaagcccttggctgatagagtgcttgtaaagattaagtctgctgagcagaagacaactggtgggattttgcttccttcggctgctcagtctaaaccccaagggggtgaggtagttgccattggggagggacgaactgttggggataacaaagtggaagttagcattcaggtatatttttctttgcaatatagtgaaaaaatatgtatgatgctttctaacagaatcaatgagccttactggtacagctattcgactagtcattcatggatcataaagcattgtttcttccagttgtctggagcatttgtttccatgtatcatttggttggtaggttccaaccaacctgtccaaagaactattatagaataataataaggtgcgaggctcgcctgttccagcctccaggtacatgaatacagaaatcagacctgaaacaaaaagagtaaaactggcggatttagcattggacccgtggctaataatccaataatgagcatgctgaaaagtcgggtatgataaagttgttaaaggatttatgttgcctgttttgacttaagatgtttcatattttattgaggtgaatcttacttgattgtttttttaaatttctcgaagtgtgatcattttgagtgtaaacaagctattactgttggcaaacaaaagaatatatactaaaatgcacatatgtgacttgcataggttggatcccaagtcgtatattcaaaatatgctggaacagaggtggagttgaatgattccaaccatctgattcttaaagaggatgacatcattggtattctggagactgatgatgcaaaggacatgaagcctcttagcgatcgtgttcttatcaaggtggacatttcttatacatttgtctggatagcagtgtaatgttgttgattaagtaggcatggccaactaaagctgaggccgccctccttttgattgtaataatttcttcctgttttcctacccttttctcatactataggtcgctgaagctgaagataaaactcctggtggcctattgcttactgaaacaacaaaggagaagccgtctattggaacggtcagtcactcaatttgttagttctgctggatattttgtggttttgatcaaagttaaggaggtaatgatgtgttggttgattggtgacaggtcgtggctgttggccctggtcctctggatgaggaaggcaagaggattccattgtcggtctctgcaggcagcactgttctatattccaaatatgctggcagcgagttcaagggctctgatggcacgagctacatagtgttgcgggtgtcagatctaatggctgtcctctcctgaattaccaggtgcgctcagctgagccatccatcgtactatgccctttcagcaaccatcttttttggaaaatattgctcctggagataacattaaagccactcgaatccccttttgttacaccaaaattggggtggtggtatatcatactgataaattataatgaatgccaactttttttggttgttttcagctttgtaatgatttatagaaaaatgggagaataactcctaacctttgcaccaatcaggatgcacatatccatttattaatcgtagacgctagaatttgaacccttacggcaccaatcaatggtggggtttggttgggagcttattgggcataggggaaccggggggttatcgttgaactcactactttttaagtaccaggtaggaggtgcgaattggtagggaatttcctctcttctgagattgagggaatgagagtacagggtttggactttggactgtggatgtgggagttttaggtgggattggggtggagagtttgtcctctaactccctcgcttttaataccggggtgggggtgggaagagccatccatcatcacttaaaaagtcgaactaaactttgtctcggaactagattaagaacaaaaaccaaactcttatgactatcctgccatcaactccctctaaactccccttcatctcctaagttactaccaaataggcccgtgatactagcgcttggtatgcgtgcttaaggtcccattcgacatggatattttgttgggttacttcctcgattttcattagttcctcgattttcattagcacgtttcctatactcctaaatgatgtgtactttacaaaaacttttcatattgaagtttttttttaaaaaaatcaaattaatctatcttcaagtactacctccgtttttaatagatgacgccggggactttttcttacatgtttgaccattcgtcttattcaaaaaatttacgtaattataatttattttgttatgagttgttttatcactcatagtactttaagtgtaatttatatcttatacatttacataaaatttttgaataagacgaatggtcaaacatgtgagaaaaaatcaacgacgtcatctattaaaaaacggaggaaatatataatagttagttaattatgtgctaattattcacctggtttcacgtgtcacaaatagctcagctcaaatagctgattcacgtgtcactatttggtggtggcctaagtagcccataagtgttagcaatgtgttttaagtataatattagaaagtttagctgggtaagggttagcttataagtcttgatgagttaaaccttttacacgtagaaacgatgaacgtgtaagtggggtacgatgtgaacaaagaacaaaaatctaacgtgtagaatggattaatgcagattttagaagctaagttgagacttgagaatgaaattgtaagggcatgtacaacggtgtgtaataacggattctcttcgttcccatgcaagtaaaattgatgatgtggaagagagagaatggaggaaagggaaacatagttgctacgcataacaacgggtcagagtcgactcttaacgtttattaaaggaaattttgttacatggaggtggagaaaaggaaagaagggtataaaaaaaatttttggtgcactaatgatcaagagttcttgttgtcttaactattgtagtagaatagtctctaagtgatatgcgttaactaaaagaccatccatcttagactttacctttgttcatgccctactacaacacaactgaaaaatatcgacaaatttgtacatatcctatctaagccatcaccattacattgtgaatcttcgctaaaattcccagagcacctttcatattccacctctattcttgtcccctcattgtctcacccacaatcccatgtatcctcatgcaccctccttttttttttgtccgcctcacgaactccgaccgcgagctctacacgtctcgaccgaccgagatacgtgccgcgacaactattcgacaaagaaccacaaaaacaccagcgccgcggcgctaccgcgcttagctctagcatatgcttgtagcaccacataaaccatcagttgcttgccgcacgtatctcggtcagggccctgacaagtgacaagtcaatcattcaacattttatttttcatttgaataacaaccattcaacattttgttctgaagtacaacgactcaacatttcgagcttgttcaaaccttaacattttttagtaatatcaaattttgtattaccaaattttattgtggtaaagaaaggtttgcggtctttgacgtgaggccttttcaaatttcggtagaagtttacgagaattgaagattccaaaattaccaaaatatggtagagttgtgttgaaaacagtattctttagtgaacaaccccttcagtttgtttgtgcttgttccaactcattctcctctttttccacgcagtgtgttttttttagcaaaaaagaaaattataggaaagttgctttgaaaaaatcgtattaacttattttttaatgtttttagctaatacttaataattgtatgctaatctattgctcccgtatcaggaggtgagtctcacataacatagccttagagcaaatttaatagtatagccaactactccaattatctatagtcaattcatataatagttacctataaacatatactatatccgtcttaaaatataacaacctagtattggatgggacatatcgacgactaggatgtgatgtgttccatcatgtcccaaattgttatattttgggacagagggagtactacccaattaatacatgatcatacctatcatatacacatatattttggaatcatggagttcgtcttgcagcagctgcaataaatctgtagcccgctatttttctctctcctatcttattatctttttgaaatatatttatagctggttataggttatagtatgctattgttgttgctcttgactcgcaactatgcggagacacccgcgcgctcgtactacgtggccgcaaccgatggcacgcgctggcagggtctcgcggccggagcgacacgatctccttggcaggtagcagcagcaagcgagcgagccggccaaggccaaagccgttcgtcaagccggaatcgcacgatccgttccatggtcgccatggcgagccgtctccacgtactcctttctcactacagctcctcgcctcgcctcgccccgccgcttgggaggctgggagcccgaccgaccgaccgcgcgcgagccgcgaggtcaaaccgcttccatgctttgactctctgaccgttctgtgtcgtctctgctgtgctagctagctccagcctccaattcattcatgatacagtactcctccaggagtactctagtatgtgtgattccaggcagcagctatatagctcttgaattcaaagttcaaagtccatctatatccaactttattttacggcggccaaatctcggatctccctgtatgattatgatccaaaactggtactactgcatagtgacagatcactgtagtatcgaataaaggagagagcgatgcatgcggtgtagtcaaacagtattgattttgacaaaaaagaaaaaatggatgcgtgcgtagcctggtaactgtaaaattatacgactaaatttactgtgaatactttataagccgagtcgtcctccgccttctccccatcatcttaggctgtcttcaggaggatgggttgggaactcctccccgacatgcacaacaaaaaaaacatattattgcacgattaattatgtattaactaatttttttaaaaaaaatggatgaatatgattttttttaaaataactttcgtataatttttttttacaaaaaaacacaatgtttagtaatttgaaaagtgtgtgcgcgaaaaacaagagatgtgagttgggaaaactgggataagaactcaaccttagttccccacgtaaaaggttgttagtaaaaagaccaccgcacctaaagatttgtgtttccagacaaaaatcaactagtataatttcaatcttgcagtaacttttttattattttttagagaaaaatattgtttacccggcctttacatctaatcggatatatgcagccatttaagttgagaacttagtcccacaaacaatccaatataaaattcgctcatatatagatttaaacttaggacttttggatgctactcaggttattacgaccgctaggttacatgctttttttatggtctcgtggtaactcataatgcatgaacatgacactaataacttcaaaggaataataaagtatcgtggctcaaattaaccacgtataattaactctgaaaggaaaaaaaattgtcactttctagggagtatcttgaggtaataaaaaatatacatgtccgttaattcccaatatactatggagtaatagaatatcataaataaataaatatgaatgtgccttaattttacattagacttcctttatttctaaataattttacattagacttgatccatgttactccctctatttctaaatatattttttctagattatttaataagtattaaggttaagcaaaaaaatattatcttttagttatcttattgattaatttttgaaattttaattgcttggattcccctcacacccaattgtattggaatctgtgtcaccaagatgtttatatcgtgtactttgtccattcaaaattctaaggcagacataaaaaaaaaatctaaagtatgttttattttttgttttttaaatgagatggacatatttgtaatctatatgtagtaaattaaattagtcatcttaatactaattggttagatgtatgcatataatttattggttttatcagacgagttaattttatttttatcttgatgaaaagaaattcaaccagtcaatcgagtagattgcattaaggatcatattagtcacatgagctaactattccactttacctatttgacccattcttactgctgacggatccagtttacttagcccaatcatcatgcggtgcagtgccagaaaggtgctagtagggaatccacttttgttctttaggtttcattccgacctgtcggaactcagggttgttgccacaccacacgttatcaaagaaaaactggtatcggaggggccatggatatccggtgcaccccaattctcttatttcttttaactccactttcatataatttaaaaaataaaccaatcaaaacttactattaaatctaaaacctcttgttcatgtcatcctcgttagtgacaacacaatcttacctaaaagaaagactttggcgtgacaacaatgaaaaatatttgactagcataggtggtgcggctaaaaaggttgttttcaaaatacatattgtagtgtttattttttatatttaaatgagacaggttaaaaaataaaataaactgcagccacgatcatgagcaatgctttaattttgctcgcgcaacttaagaacaaaggacagcggtcaagattcatggatgaatggcgatgaattgtttgacggaaatcattttgtgctggagtagtagtacgtgaagcatatctggtagtagtaatttggtagcatggatgttcattaatccagtgatattttcaacacggaggtgatttgcagttgtagagacatgttcttctttaacaatgcacttgtgcctttgtatcaagagagtaagagacacattttgtgcagttcattttgcattaatacacattttctcttcaggatttgctatttcacttgcgatatatttaggttcgtatctttcactttttcattcacaaaatcttgcatcaagaattatattcttatatatcaacttatagtacaatcagttacgcagcacttacacgcaattacggtgtatcaaaattagattttacaatgggtttttctgtagatttacgatttttgacatgtttattttttattgtatttaaaatgggttatatccattggtcagaaaaatttataggtaatcccttctccttaatttgcccggtacatgttccatccactattcagaaaataatctcattatactaaaacagagtgcctcaacagttgatgataacaacatactttctccgtttcatattataagactttttaacattgctcacattcatatatatgctaatgaatctagatatatatgtatgtctagattcattaacatctatatgaatgtgagcaatattagaaagccttctaatctgaaacggaggtagtaactaataattatgctatcataacataatttttgtctttaaaaaagagtatatcgaataaagacaaaaggcccaccggccgatatatctagtagaatccaagttaggatcgaaatcaacctcaacctagtcgtagtagcatcgcctcgctaagctttggttgctggctgacaccttgcacgtcgccgtccgacgcgccatggcgagtcaacgcgtcgcacccgacgacgcatggcgacggtataagtagccgaggcgaccccgccaggatgatccagcagcaagcaaacccaaagccaccatcaacacagcacgtacacgtacgtgcaacgtcactgcatgatgtcatcgtcgtcgccggtggtggcgtcaccgccggagatggagaagaagtacaagggtgtgcggcggcggaagtgggggaagtgggtgtcggagatccggctgcccaatagccgcgaccgcatctggctgggctcctacgactcgccggagaaggcggcgcgggcgttcgacgccgccttcgtcacgctccgcggccacggcgccgccggcgccgacctcaacttcccggactcgccgccgtcgtgcgacgcccgcagcagcgacccgcggcaggtgcaggccgccgcgctctcccacgccaaccgcgcccacgtcacgccgcagcaggcggccgcggcgctcatgtcgccgccctcgctgtcgccgccgccggggttcgccaccggcagcgaggtggtggcgcccgccgtgcgcgccgacggcagcatcgactggcgcccggtcatggcgcacccgccgccgctgtactcgccgcccggctggggcggcggccatgcctacgacttcttgcagccgccgccgccgtcgccgccgttgccgtcgtgcgacgacgacatggtcgacgtcgtagatgagagcagcgcttcgctttggagctttgacacgcgagactcctacttccgatactaattacatgcatcgattaatgcattatgcatgggatcagctggcattgatggtagcttagctgccccacacacacacaaattcattaactagaatagacggccattaatttagtttctacacgttcgaaacgttttttcaaagaattaacgatattttgcgatggtcgtgtgcatatgtcttgcatgctaaatggtatcttattcaaagcattatgggtaaatagtactcaccaatatgaaaagtagtgaggcaagttttgtcagtaaggttatatatgcagaaatgttcattgtattttaactccccttttagggaaaaaaatgttttagggggggtagttgaggttgtgcttaattacttaatttgatgtatgtgatctgatctgcacgcacatcacacactgcaaaatgagctcaggcttattaacatgtctatttcatgagctaaagctttgataaaaagccttcatgttcttctagcagcaacttgtcacataggcaaattttaaagacgtcattttcaagcatgtgacattttgcaaggtagaactggaatatacaatgatccaactgggcgatgtgatatatacaacacagtatatcagttcggtgtcgcaatcggggtttacacttttgtttttcaccgaaattccagaaatttcgaggtcaccgaaattgaccccaaaatttctgtagtttcggaacattttacacaaaattatttagaaatttaataaattttgaagaaaaaagagaatttcgggtgagatatttgcatgctggagggtagcgaaaaattgcaatcactagtcggtgacggatagtcccaatggataatttacggatagtgccgaatacggaaacggatacggatagtttttttttaaaacggaaatgaatatggtaggactagcatccgatggatatcggaaaatgttgggaactatccgcagttttatccggatatccgtacgtagggatcaattttttttaaaaaagtatatatacataaattaaggatctctcaaggaagtgaaaaatcatttttacatgtgggttaagaatcaactataaaaattaattttcacaaatgtttatggaaccgtgtaggtaattgaccatatagaatttagaaatgttgacttattattttaaaaaaataacaagcaatatctttttcattgattcagaaaacccaattagaggggttttttatattccgataagtaatcattgctatattcgttttgtttcgtagtcgctccatatctttattcgataatattcgattttatttttatatcgatgtttttatcctaattccaattaaaaaatgaaaacgaatacaaatagctagtttccgtgtgtttccgatcttttttgttcctactagtcgcaatagttcaactcttcaatccattgatcaagaggtgaaaaagacacagtaatcttttgtctcaatgcgtgacaatcggaaaaagctatagaaagatgctgcggtccatatatcagtgacacaaggaattaaggatctatgccagacagtgagatatgagcacaaatggaattaaggagtatttaattaaattaactcggaaaaatgagatgtagcatcttttatgacatgatggtgacttgcaaatttaaacgttcacccacttctacttcttcacggcagtggccacagcacgagacacgttgataaaaccgtatgtagggccctttaaaacacgggatacaataaaactgaacagaaaaaactccctctattttttaataaataattccattgacttttaaatatacatttgttttatttaaaaaatgtataatgtataggatataaatcatgcctaaaatactttgagtgatttaacaactcacaacaataaattattattacatatattttatgaataagacgaatgattaaacgtgtgaaaaaaatcagcgtcacatgtttatctaattttagagaaatatctaattttagagaaatgtaaaatacatgtacgtcaaatagtatccctttggtacatcaccggaaacaaataaagcaaatgatagtttctatgaggttggacctctcacttattttcctataaaactaagtcgtaagaatttagttttgtaaaagaatttctattctttcctatgaatgaaatgattatgtaggaatttttcttttgaaaaattaaatcctccaaaattcatattacaatcctcaatgcaaaggagcccagggtagcttcttcatcagcttcatcactgtcaaaacgtaaaacaaacacacgctattacacatgatgaaaaaacatagcattaggtaaactaaggcgactatggtaactaccgttgcctcacattttgtattaagatgactaagttttgtcttatcacatcttttggcaaacaaaataataagagtga

SEQ ID NO: 42869 - DNA, 18655 bp, Oryza sativa
  unsure (1)..(18655): unsure at all n locations
ataggatgtttgtctttctgactgtcaacgaactaacaaagtaacaatgacactttcctctgcacttgatactgccatttctcgaccatgtgaatggcgtgtgcaaattaccatctgagcacaacacgtgtataataagtgtcagcaaatgggcaaattaccatgtcagcaagtttacttttagagtaattaaaacatttatacttctattctttatggcccaaaagcgaagcctaaaaatagaaaacaataaaataaaaaaaacccaaaattaagtttcaagtttaaattatagtcgtggcttataagccctacccaattccctattttttgtcagaaaccaaaagagatgtgaaaaaacccaattaacatgaaaacaagagatatcttattttattttatgcataggatctaaggctgagttattatctcagtttttctaactcacatatctcgttttccgcacgcacgcttttcaaattgtcaaaaggtgtgtttttttgtaaaaaaattctatacaaaagttgatttaaaaaatcatattaatctatttttttaaaaaaaaatagttaatacttaattaatcgaatacttaaaaaaaatccgttttacgtgccggggaacacaccctaaatctatactacttttgaaatagtagtggtggcagtaccaccccacggtccactatcaactccctacttttgttaaagggttaattggatccatgccactgcaaatgtggcaaatcaaaaaaatgccacacatattcgcgttatcggctggatgccactgcaaatttttaaaataagaaccatgccactccatcatgatttccgtccaatctgtcacattttccgccgtctccgtcttcatcttctcgtcgtcctcgtctcaacggcagcaccagcacggcagtacgaaggcaggcgcggatggcagcacggcagcacggtggcggatggcagcacggcaccggcgacggtcgtgccagcgtccgctccccgcgcccctccgtgacctcctcgccgacttcctctctctccaccaccgttgcagccgtcgtcgttgaccatctccgcggtggacccaccgccctcgccgtcgtcgaccttatctgcgcgggagagctcgggagtcgccgccgccattgttgtcctcgtcgtggtcatcgacgagccgcaccgcctctgcccagatctggcgaggagggccgctcgtcgttgctaccgatggaggaggcgtcgaccctcgagctccgccgccgttggccccaagctttgtcactggtgctgccgacgcccatctcctctctccacacgaccatcctcggcagcagctgcgcaccctccgcgacctccccgcgagcgtcctcggtggcggcggcggcctcgctcacgaccgtcctcggcggtagcagctacgcccgcgcccgccttcacggccatcctcggcagtagctatgcccccttcccgacctccccgcgagcgtcctcgccggcggcggctacgcccgcgcccgtctccgtgaccgtcctcggcagcggccatgcccctccgcgaccgtgctcgtcggcggcggctgcagctgcgccctctccctgcgcttgcgactgtcctcgccagcggcagcctcgttcttgctaatcgccttctccccgtgcagacgtgagagagagagaggaggatgacgtcgtgagagaggaggatgaaaatagtgacaggagtggcatggttctcattttaaaaatttgcagtggtatctagccgataacgtgaatatgtgtggcatttttttgatttgccatatttgcagtggcatggatccaattaaccctttgttaaaagataaaaggattgtagtcctaaagggaacacatgtcaatcacctctaccatccaactctttttttaagaaaaaaaatgatgtaaggctagatggtccatatatcagtactttctctgtttcacgatgtaagattttctagcattggctacattcatttagatgttaatgaatctagacatatgcatgtgtttaaattcattcacatctatatgtatgtgtgcaatggtagaaagtcttacattataaaacagatggaataacaaatatatgtataaattaatacgtgatatataaaaaaaatatggtaatagcgggttaatgatctgttgcaacgcatatgcaatatgctagtgactaccaaaatttaaacaaaagattattgtatcacatattagctcacaacaaacactacatatgtaaggtcaaattcggtccatggatgaacaaagaaatccaatgtcaaatgctctcactttttcagtttgtttatttttctcgagttataaatcaaattcaatcttacatgataatctatgttgactagctttttaagagtattttttttcttagctactagaaagtatgaaaggaagtgctatcaaggttctggggagctgtttatcatgcaatataaatgcatggtcactacctggttggtcacataactgtaacacggagtcacgtactgttattaagagtagtcctcgtcccttgtgaatttggaggtacagcttggagaattcttctgacttttgacgggtcaatcctcatgtaagagttgtcaacttgtcaccgtcaccgtctgatcatgagatctcacgaacgtccacttgcaaagttacttgccttgaatgggaaaaggccgtgttaagttgttttcgcaaaaaaaattaacctacacggacacgcatttaaagtattaaacgtagactaataacaaaataaattacagattccgcatgtaaacagcgagatgaatctatttagcctaattaatccgtccttaacaaatgtttactgtagcaccacattgtcaaatcatggcgtaattaggcttaaaagattcgtctcgtaatttacatgcaaactgtgcaattgatttttttttctacatttaatactccatacatgtgtacaaatatttgatgtgacagaaaagttgtaaggttgaaaggaactaaacacagccaaaaataatgtgccattctctctctttgcaggatatgatgcactgcgagcatatggaacattttttgcaaacacaaggaaacatggtagaagggatatgtttaaggcattttataaggaatttatgaaaactgaactaaattctgtgaaaaccgtagaaatccatatgttttatggagagctcgctccaagtttggcgtcctggcatggcaataaaacgtgtgcgtgtaacgaacggaaaggcgaaatttttcatgaataattatggcacacaagaaatgtatagtcttgggtttactatcttgagcctccttagctttatatatagttaattattagacaagtgccataaatttcctgagagtgacacttagctaacacacctgacagtcttgagacaaagaaccgaaggatctcattaagaaaaacaggaaaaaaaaagaaagggatttgcacggcacgcgtttggatagactataaaattgtacctttttctatggaccacgagcacacatgcaatgcacaagcagcacaatgcgtacaaacctacctcacagaagcttctcttctacctcttggcttcgctgatcgatcaagcttgtgttaattgctaacaatgtgatggtcctgcttataaatcatggtacaaccgattaatatgaagatccacctgggagcatgatcaccttttgtcttgtggaagaaatcaatttgcttcattgttccttcggaagctcagaaaagtcagctgacacattcagagatcagacaactcgtttcttaaagtgaatagtcctgttacaggtctttccaatgagtttgatacgggaaagcaaaagaaattacgtgtggtctgacctcacaggtgaacgtgattcacaactgcttgatcatggtgcagtgtttgatccaaatggttttgaaccatggaaattttttttcccagaagctgcaaaaacagcgcaaatagggtaagtgaaagtgatgtttacagaacagtggtgacatctctctaagatttaagaaacctttatgttgacattgcaagtacgtaaaccattattattgtaactaatggactaagtgttgtttgttaaacaatatatagcaatgaactcactttttagttttcaagcattggttctgaacttctagttgattccgttgacaagtctacaggctgcagaaaccagcagtggcagtacaatgatcagcacggcaacagtgataagagaataagaataagagcacatgtttgtaaatttatgtggttgttgatgtgtgggatctaataacagcgatagccatgaaggaccttatctgtttgtactacaaagattggcatatccccagctatctgaatccctgactctgacagttacttgctacacaatacctatcaatctctcagaaccacaaaaacatctagtaatatctatccatggtgctcctctttcacaaattgataaagatgtgtagtacttgttaagaacagaacgaattgggaacaagagtggccataagtagatagaatgatggtatgggtgacttacacttggctcaggctgagagcaggaaagatttggttccctgtcctcagaaaagaaagttcaccacttcctcaagctctgtccaaccttgcttcatgattgatctcttgttcacagctttcactcctgaactccttgtcatgtaaccatgcagcttccactgtaaaaaggaaacttgaaagataaatttataaagtatggtagtaaataaaaataaaataaaaatgtaacttaaacacactttactttccagccgtctagctccaccaagagtccaggtctgagggaggtgaaagtgaaaaaagaaaaagagagcaaaggtacaaaaacttttgccaaaattcataccactctgacaattgacatcatcaagcaccgataaaacaataattaacatcttttactttcagttgggcagggatggtgaatggccaagtgtatttctaagattgcaaggttgtattacatgtttggcagcaagaacaaaatgctggtggacaaatgaaatgagagatacaattagccactgcattcaaacctatgaagaggtgaatctcctatgtatatacagttctaatctcaaaaaacacagaaagactaaaagaacaaaaatgaggatgggaatgccacccatgttctgctgttagccttagccacctatatcatcatatgtcataatcaacttccgtgctgtttaccattgctgcacgcttaacaagctgcccttgctcattgtagagatccaaattctcgcatggttttggaaacactgacccgatgacacgcccctcaatgaaggaacactggaaaatatgtttcttcttgtagctgatgccgatagacatgtcctgaaagctgatgtccttgatgggaatgtcactgctgccatgagcacggactggcacccggacacctcgcccatgtatttccttgaatgatatgtttgtgatgtctggaaaggcatcccggtcatacccatcatcagcgtgctcattgtagtcaacctttatcacaataccagcacggacattgtcgaaggttatgttgcgataggagatatcgcggatgtagccccctcttcctatggcagtctttattctcaaacctcgccgtgactcccaaatgcggacatcctccactgtaacatttgcaatcccaccagacatctcactgccaattgaaattccagcactgcacacaccaagacaactgttgtaaaccttacctgtaatactctatattcaattcaaaagaacttaaaagttaatcctaatttaatagtttctttctcataccattttatcttgagcaggatttgaaaaagatatgcaaagaaatattttagatgaagcaatgcagccaaaaatgactcaactgttacctgaccaatgaacgagccattacattgcgtatcacaatgttacgagatgggcgcccatatgcaatcccatattgatcccacccactctttaccgctatggcatcatcaccaactgaaatgtagcaattctcaataagcacatcctgacaagaatctgcatacagctatatgtcagcatcaccaaataaaaaaaatgactgtcattgataacagaaacaaacctagatggtataacaagaagctgaaattatgcaggatgattggaaattactgaagaaaggttcgtatgattacctggatctatgccatctgtgtttggagcactagaaataggagctaagatagtaacattagaaacagttatattcgtgcaatcatatgggtggaagtgccagaaaggtgaattcttcaatgttatatttgcaacaataatgtccttggaccacatcagctgcaaaagaggaggtcttgtattattcagtatccttctgcgatgcttcatccaccaaacttcaccctgtccatttatgctaccgttgtgtcctattcaacagagaaaaaatagggagcatgtgaaagttaaataactatcatccagtgaagaagtgatacagaaacaccaaatgctctattagtgcaaggatgagaaccaaatgcatactggaatctctatagtacaagtgtttccattacagtggacttgcatattatacttagcaaagtatcagtaaggaacacaacaacaagagaataagagtgttttaactttttatttattttttacatgagcaggtagtgcgattatgcatactgaaagaaagttcattcagaccaggggataaaaatgggttaaacagttgttttatgtcaccataacatactgccaagtaggagaagtttccatcattaaattgcttaaaattcacaccatgcacttctgtcactgatgttgcttaattcacaattctacgactacatcattaggtggtgtagtttattcagaaaacacttcaaacctgtaatgactacatctttcaaattttgtccatgaatgagacttccaaagcgaggtcctttcctctccctgccatacccataagacggcaatgcaggcatgagcggccaatacctctcgtcctgccatggaaacataaggaatcggtacacctgtcaatcaatatatgcagctctgcgcatgcatctgagatatcacagcatgttttcaaagaccttaattagataaattatacaaccaggacagaattagcagataggtgaaaactagatcatccaatttccacccttttccaaatttcaataacattgatatcacttgagacttcagtctcagcaacacataagacagaaacaaattatccattcataccattgatttctttagccatgaagccaataagcaaactcacttttattcagctatatgcttacccgatcaaaaccactcaaaagaactaatttttgaacttcacgaaaagactatgaatgcattgcaaaattaacagcatcactccagttctattctacggcgtgaggtacgaggtatctttctttttcctttttttttttttttttgcggggaaggtatgaggtatctcaccggaatgccaaggatttctgagccctcggcaagaaatagcgtcatgtggctggtcaggttgaacggcgcggtgagccatcggccgggaggcacattgagctgccctccgccacgctccgcgagcgccgcgatggccttgacggcgcgctcgaacgcctcggtgttcaccgcccgcccgtccccgacgccgccaaaatccgtcagttcgtacgccttggggcgcagcagcggcgccgggcgcgacggcggcggcggcggcgccgaccgcagcctgaggaacccgccgcccccgccgccgccgccgaccgataccttggcgctctgccacaggaacaccagcgtgaacccgatgacccacgcggcggcgagcagcgtcttgttggccgcgaggaacgcggccacgctccgccgctggccgtgggggtggagcctcccgccgccgccggacgtctccaccattgcgctgtccccgatgccggaggcgagatctcccgatctagggcacggcgcgcggcgaggctcagatcgatcggtagggcaggacgcggcgagctcggattccgcggattggggcggaggcaaggggcgcagggtcggggatttccgccattggaggagttggtggtggggtttataagtggagggagcctttcgagtgaagtggaagcgagaaagatgtgggctttttgcggtgcggttgaggggaagaagatgatgagaattaccacactgccatcacgtcacgtgggctgcttcgtgccgtaggatttagatcggacggtgcgtattttatctcctcggaggatgtttaactacttacccacaggagtccagaatccacataatttagaattttacagagggagtttttctgcaatttccttatgaaatcatgcgataatagtgagccattttaggttatgttttttttccaaatataaattaaccaagatgttcagccggcctcctttttctccataaaaatattgtagtgtggaagagaaaatcgaaaggcaggaactttagtcgggccttttctttctctttgccttgtcaatgggcaacccagtcatcctgttcttgttatactccacttttccacaaagctgatgcaaaagacatatatattcttctttttctccccttatgctagctactacttccgtccacgaatacaagtatgtgcgagttgtttagcaaatattaagatttagaataaaatactttggtattcctcgttaaagaaaatatggtcaatagtaggagggtggtaagataaaaaaagagagagaaatgattaataaaacaagtcgtttatgaaatatttatattatagaccgatatattttaagattgacgaagtacacttttcacttaaagattattagcgatcaatgtgagcaactgtgtcaagtctaggatttgaatccagatgaattggttttacaaaaaaatcatttatatttatgaataaatttcacacgcttcgtatacttatatttacaaagagggagtaataatcagctagattggccgctggctgttagctaggactaacacacactatctatacccatactcttctccagtagtacatatcatgaggcgatggttaggtgcggtagctggtgatgagcagcgtcaccaattcttcctggacgccgatcgatcggttttggcgtagcagtcactactcgttgctctgatctctcgccggatcggagttagctagcgtttggtgagacgtgtctctcgttaggcgaataaaggtgggatatagctcatccatcagttgcagctgtgttccagtattgcaaagatcagatgcctgtgctttggatcatatatatgttctgaagatctgatctgatctgatcacttagagcacctaattgcatcaattcagatgtaattgctgcatcaatgcgcccgtgtcggtgggttatggagatgattatagttaatgcaacaagaactgcttaattactcatcatcaacagtagcttagctaactaagtaccgatttgatgtaataagtttcacttcgaaattaaatcaggggtaaagaattccatagttttctacttaagttaacgccaacttacaagcgatgttggaaagttgatcgaattggtaaatcaaatgtctctaaattctctccattgagggatctaaagtgaacttattcccatcgatgcagcagagacggcaagtttcggcccatttataaagcccatatggggatccaacccaactcccgttgctttttgttggacccacttggtgggaacggcctggcactacgtgggccgtggcccataggaaagggaagtgtgtgcctcgcaagcctcgtcgtctctctccggctcgccgacttcgctcgccttcctgccgtcgcctccggtgccctctgctgctgctgccggcgcgtgcgccaccgcagcggcgccatcgccgtcgccgtcgccgctgacctaacgtaggtacgcctcgatctcgatgtctccaccgccactccccgaaccctacggactccctcccaatcacgccgccggggtggcccgcctcgatgcctcccaccgtagtggcgcgccgctgggttccgatttgactggctgcgagcaaagctaagagggtgatggggttgatacgcatctcggttggtttggctgtgcttgcgcgatttctctgtctaacgggtcctgactcctgcgttggtacatatatcgggagatgtgggtgtgatcacccgttgcgattttttcatgatttatttgtttaccgaccactcgaatcagagtatcacttgtgttggaccaaatctatagtatcgattagctgcggatttagcatattgtttgtatcgtgatcgttgtgacactataatggctatgacatgctcttcttcttctgatgatttcaatggttcagctgaaaaatgaagagacaacttcccataaaaggtgcatcgggggcctcgggatctgggcatggaaagaaagctcctcaggagctggagaacgtcttgaagcaacatttcggatattcaggctttcgaggaaagcaactagaggctatagaagctgttctttcaggtgctcttcccgtctgtgtttgtgcttgtagtctttatttctttttagttttgctgaatatttctggtcaaaagaacttttgttgctgatcactgaagtatgctgtctgaaacttttgtgcaccatggattctattaatgtaacaagcaatttatttctaggaagggattgcttttgtttgatgccaactggaggtggaaaatcaatgtgctatcagattcctgctctagtgaagtcaggcattgttcttgttatctcacccttgataggtgaattgatccaccaaacttcagttatttccagaaaaaaatagtacttgacaaatgtgcatatactaatagcttcttgatatggttgaaaaatctgctgcttagcactaatggtaagctgtgttatctgttggtatctttttattgttgttcctgaatactatggatcatcatggtttatgaaaattacaggagaatcaggttgccagcttgaaaagcaaaggtattccagctgagtttctctcgtcaacacaaacatcgcacaataaacaaaaggtaaggtttccacattgtgcagattaaggtttacctaggatattatcaattatttatgaaaattttcgactctttagtttcaactgaaattttgactctataaattcatagctggctgagtttacctggtcacatggttagttcggtatgataacactcttcctcttgactttgtaatttgtcatacatgcctttctcccagatacatgaagaccttgattctggtaatccttctctaaaattgctatatgttactcctgagttggttgcaacatctgggttcaaggcaaagctaacaaagctctacaatagaggtctccttggtcttgttgctattgatgaggtataaattaagtagtgtctttactcctctagtaacaccctgttcttcttttatctgtgatgaagagcatctgtggcttattttgcattttttgtctctacaggctcattgcatttcaacttggggccatgatttcaggtatgcatttatttttagtgtttggtggtggctacttgctttcgtctgttgcccgtttgcagattcattggttaaaaaatgggttgaagcattcctccttgttacagaatttgtaaattgttctactcattttaatgaaatacagacctagttaccgcaagctttcatcactgaggaaccagttcccagacatacctatattagctttaactgcaaccgcagttccaaagtaagacactatccccttaatagtcactacctgccaccatcacttctcttgatattttaatctagtgttttctattcacacttcattctctttttctttacaccagagtccagaaagatgtgatatcgtcactgtgcttgagaaatccattaattcttagggcatcatttaatcggcctaatatattctatgaaggtaagttttccaacttatgggttcttgaacacttagcttgagtgcaccgaccttttatctttagactggggcatttgttttcttggtatgttgactattcttctgtttttacatttccatgctttccatcatctattgtggacgcgggacagtattactgatgttcccttccctcatgattatttagtacttttcagttatgtatctcccagaacatatggttcctgtcaattgtttactgctatgcctatattttgtctctatgttcaattctctcttaattacatattataatataaactactttttgcagttcgctacaaggatctccttgatgacgtttattctgacatatcaaatttactgaagtccagtggaaatgtttgctcaattgtgtactgtcttgaacgtgcggtttgtgatgatctaactatgcatttgtcacagcagggtatctcctctgctggtacgttaatttaaagtcacaatttctaagtcttaagacctattaggactgttgaattgagaattttcatggcagtcctgtgttctccttatcagcttatcatgctggcctaaatagcaaggtgcggagttctgttcttgatgattggctttcctcgagaactcaagttgttgttgccactgttgcatttgggtatagtttccctccacatcatttgaaatatcatttctgttatgtgacatgctgattccatgtctacaagttccagcacacatgtagtatctgagtactgttaccttattaccttccaacctgtagtacttgtttatgattgattttggcttctgtacttatattatatattttttccaaatgaggctcttactctgtttccctctacatcgcctctttcaatacgggacttcgtgtgcattgatatgttgattctccttccacagaatggtatgttatactaattgttttttttttgtcagtctttctgaagaagtgctttgctaatacattgggttttatttttttttcagggtattgatagacaagatgtccgtattgtgtgtcactataacttgcctaagtccatggaagccttctaccaggagtcaggacgagctggccgtgaccaacagccttccaaaagtgttctatattatggattagatgaccgaaagaaaatggtaattaggtgccagattgtacattgtcattgaacatgaaaactgaggcttctatggtcttactcttacaggaatttattttgagaaacaccaagaacaaaaagtcagagttatcgtcctcttcaactgaactttcagagaaggccttagccgactttagtcaggttggtgcactcttgctacctaacatggaattggtctactatatcatgcagtagatttcatgtttttttttacttgcatctcttgatgcagataattgattactgcgaaaattctacctgccgacgaaaaatgatcattgagagctttggggagaaggtatgacattaatcctgaatatattactaatactccctccgttttttaatagatgacgccgttgactttttctcacatgtttgaccattcgtcttattcnnnnnttttatgccnntgtctcncatatanctcacacttaaaagtactatgactaataaaacaactcatatcaaaataaattataattacctacattttttgaataagacgaatggtcaaacatgtgagaaaaagtcaacggcgtcatctattaaaaaacggaggtagtattttctagttttttacttccactattgcatgctaacctgtaaaatgagtaggtacaaccaactttatgccaacgctcatgtgatgcttgcaaacacccaaatctagtgtcctcacgtttggaggaacttcgtcgtgtgcccacctgtcgctataacaagatatccccagtcttcaaaaggtatgttagttgtgaactggaattttccttcatgtactcatgatgttgccttttagagagaacgcacattgcataaacatttttttgacctctcttttcatgcaaaataatataatgggtatatccatcaagatagaactgataacaaatcttatgtgaagtagttgaattttgggcaacaaaatctacctttttcgatcggcgttggtacccctacttgttcatctataactttttctcatcggacagtggcacatagcatttagtagactcaagacagactaagtggagtaatttacttctggattatgctgtactaataattcatttgcttggcagctcgttggctaatccaaaacacatggagacagaattttggaatcgtgaagatgatgcaagcatatcagttgaagatatatctgattccgatggtagagctcaccttttcccctctttgtgcgtatatggtcactgtgcactaatgtctgtggggtaatggcagatgggaaggaggtggtgagcaatactgccatttcaaagctcccatcaaaagcagggctagatgcaaaatttgaagcattggagcgtgctgaaaatgcttattatcaagctaaaggtcagaccaagcagcaggtgatagtttgcctttttgtgattcttgtttctttcgcaacaacaatgagttaataactgcttataaatttgacaagacatatttttgaaagaatctatcacgttgctcagctagtcataaacttcaactagtgatataaatagggtgggaagcttgttgacaagaagagcatatctcagacactaagagatgcaagccaaaagcgattgttgaatggccttggacaagcaaagttgcgacttgggaatctaccgtgagtttgttttattctacaatgatttattgtcaatacatgatttgtactgtcagtttctttcaagtttcttcactcattttttggccgataatttcataagtattaggcccctttggtttataggaaatacacaggaatttcataggattccaatcctatagagaaaaaaaaaaccatgaagaggcctttggtacaaaggatttaatcatttctttccctttgaaatacctatggaatgacaatcctatacaatcctgtgttcttttaaaaaaaattcttaaaaagcagggcactcacgttgttcatctaaaataacaatcttgtattttttcctatcttgtatgcaaacacatgttttgaagttttccctatgtttttcttcccataggattggagaagccaagcaactccattcttatgtttttcctattaccgtgttttgactttattgtgttcctaagggagccttaaccttgggtatagcattcggtctaaaatttcatgagtattaccctttggttcaaaatttcatgagtattaatatttggccttacatattataggtcgttttgactttttttctaagccaaacttctttagatttgaccaagtttataaaaaaatatagcaatatttttaacacaacaaaaaaaaatcaaaatatgttcaatgttagaaatatttttttgttgtgttaaaaatattgctaatttttttggtgctttaagtgttgctctatttttctataaacttagtcatgacttaaaaaagtcaaagcaacttataatatgaaacaaagggagtcctttagtctaaaaatacatgagtattagccttcggcctaggggctnangtcaanataagagggcnntcgaaggggctcgnccgaaaggctttggccttccgggagggccttttcgggnaaacgcgtctaggctcattcgagcacggtcgagctcagacgagccgagcccgagcctctcccaaagctcgcgagctctgtcgagccgagctcgagcttccaacgagcttaataatatataatttttgttgttatttaataaattaggaggttatatatgttatttgtatgtcaagtattggcatcatatatttattttattatttttcctcttccatttacatggtgaactagaaattattttttaaaagattatccttgaaatatatattgttttactgaaaaatcgagctcagtagtcgagctcgagccgagcctgtttgaaagctcgaacattttataggctatgttcgagctcagctcaagcttgtatcgagctcgactagttgacagccctacttcggcccaaaaatacatgaatgttagtttttggcccaaaatctcctaagcttcaccccataatttcatgagttagcttttggcccaaaattccatgaatgctaaccttgggcccaaaagcgttttagtattagcctttgaccaaataacacatctagtgttagcctttggccaaataacacatgaattagcctttcgccctagaacacatgaacattagcctttgaccaaaatttgtgggtattagccttctgttggcccaaaaatgtgattgttttccatcggcccaaaaacacgcacatattagccttcggtcccatgagtattaaccttgggcacaaaaatgcttgctagccttcacctataaacatgcaagtattagccttcggcccaaaaattaatgacccaaaaatgcatgattattagcctgtcttgaaaatacatgaatgtttgcctttggccgaagatttgttaagtattaacatttcgcccaaaaacgcacgacttaatgccttataaagacatgaatgttagctttggcccaagatttcagtagtattaacctttggccaaaatttttagtaatattaatcttgggcccaagaacatgtttagcctgttgccaaaattccatgagtgttaaccttgggcgcaaaaatgtataattattggccttcggcctaattacggatgaataagctttagcccatttacacgtatattagccgatactccctctggtccaaattaagttcacttttgtacatgaatttggacataggttatatccagattcatgtacaaaagtgaatttattttggcacgaaggtagtaatgttcatgtgttatttggtcaatggctaaaactaatgcgtttttatgcccaaggttagcactcatggaattttaggccagtgactaacattcatgcgtttctggcacactattaatactcacaaaattttgggccaaaggatattactcagaaaatttgtactaaaagctaacaatcatatgtttttggaccgaatttcaatgcttgtatgtttctgtagcttttttcaaaccgaaggcaacattcatgtgtttcatttgcgtaaaggttaatatcatgaaattttggaccaaaggctttatacttgtgtgttttggggatgaaagacaaataatcacgtgtttttgttcccaaaggtattaactcataaattttggttgaaggctaatggtgatgtgttttgggagcaaaaggctaactaatgtgtttttagctagaggttattagcgttttgtgcctaggttagcactattggaattttgggctaacatttttatgtttttgggcccaaggttaatactcatgaaattttggaccaaagggcgatactcatgaaattttgagccaaaggtcaattctcatgaaatttttggtgaaaggcaactcacgtatttttacgtcgatggttaataaacactcatgaaagtctgggccaaagtttaatagtaatgtaattaggaccgaaggcaaacaatcatgggtccaagcttaatacttgtgaaatttcaggcaaagactaatggtcatgtgttattcggccaaaggctaatattaatgtgttctctaaatatgagtattaccctcctgtgcaaaacttcagggtattaaactttgacccaaaattttccccttcgacctaaaaaaataagtgtgttagctttcagcataaaaaaaagattagttttagctttcaatctaaaaaatatgcctccaactcaaaaattcacgagtattacttaagagccaaaaagtcttgagtactatcctttgttccaatatgtatgagtattagcctaaggccaaatagctcatgtatgcctttgggccatttatgtatctataaatcttcaacccaaaaattcatgagtattatgccttcggcatgtgtacgcatttatgtatgatgaattcggcctgataactcatgagtattcacctttggcctatttactcatctgtataagccttcagcccaataaatcatgagtaaaagcctttgacccaataaatttatgagtattaaccgttggcccatttacacatgtatttgcctttgacccaaaaacacgtcagtattagcttttgttcctgaattcatctgttatacttgggcctcaaaacacgagtattacacctttgatccaatagtgcatttgtattagcatttagcctaataatccatgatattagcatttggcttatttaagcatgtatgtaagcctttgttccactgacttgtgtatataagccttgctcaataactaatgagtaaattatgccttcagcccagaaatgcacggaattacatcaaagctataacaggatggatcca

SEQ ID NO: 42870 - DNA, 953 bp, Oryza sativa
cacagggagggaggtgtcctccaaccattagatcaggtgcaagatactatagaccaggcccacatgttcataacaaatgtggtctgagctgaaatctttcctgacacatgaactaactgtcaatcaacctgtgaacctgtggtggaggatctcgatagaattacatcatcatataattgagtgtactacaatgttttggcaaaagtattttccccttgacagatggcacggggaagcaacatcgttgccgtagtcacacaatgtacacagcaccacaacgaccagccatggactattcacagaaacttggatgctacacggcaggaagtccagaaggcagcagttgctgcttttagaattgctggattctggtagatgctgcatggaagcaagacggtaacacaatcggtcagttagctctagttacacagacaccaaaaagagcaaatatatgcaccctcatcaggtactcatcagctgtgggcttatagctacatgattaaatcaaagatgccactctctatccaaggatgcaataaatctaattatttaaatgcttgaaaagtgtaagttgtaaaaatacttttagaggaaatggcactgctcaacaggtggaagaaactaacctaactaatcagaggtaaactaccaattcaaaagctcacagaattctaacggcttatgcagcccctgtagtagaaactaatatggggagtttctagagaaaccaatgcttggcaattgtccagatcaatacaccattctttgatatgatgttagcgaaccactttagatcatcctaaaccaccttagatcatcctaaacattggttacaagtagactagtaacaatagcttacccaatagcagttgcactccatgatgctatattataaataacttttgttccatcccatgctttctgaagcttgcttttcctcttcttagctgaaa

SEQ ID NO: 42871 - DNA, 4071 bp, Oryza sativa
cgtcccatatgtctgccgcacttatgatatcccatgatatagtttcatctactgttacaagagcaattgtggaacacttcagttgtcaggtttagtgcaaggaaaattattagcaaaaattttagcatgttgtgccaaggaagtgtatctattgatttataggtacaatcccaaacataaaaaggaaatatgcacctgcaccattttgatataccgacttctgaatattatcgagtttttcaagaaattcaggcgatgcaaccctcgatttgagaagatcgcacaactgcaaagtaaagagtgaactaaaaactttagtatacttatagaacaaaagaaataggtataataaaacctagcacctatttttatatgataggccagaccgccagaaaacagtttaggacagttcatcaagaaactgaattcaaaaggatatgacaacacaaacacctacgtccagtcaaccatggtaaacaagatacctgtcattcaagacactatgaagactaagagccactaatcaaactattcgaagatccatagttcattatatttgcaaactgtcaagttcccccctgtgacacaattgatttgacgatccatagctttctcacctttttttttttttttgctaaacaacatagctgcacgttttgattggccaatacaaaacacacttttcttcttccacaatcacattttaccgcaattatatacagcaagcagccataattagcttagctaaatagtggactcaacacacgacacgttacgacaccagagaaacatcatagcaacaagggagagccaaattatggcgccatcatgtcattcatacaaggctaattccgtgtaaatttcagctaattccagtaggctaccaattctaatccagctaatccgcgaacatttggagcatatgacattcacaaacgcctaaatgtcatgaattaccgatcatcaatcaatcgagccatcgacgttacctggattaccgaatcacctacaaaccccccggatcacaaaattgagaggcacagctctctcccccctcctcacctcgtccgtctcgtagtcggcctccgacggcggagacggcggcggcgcaccctcctcatcacacccgtcgctgccccccacctccggattcgccgccacggcgtcggcgccctcctcctcctcctcctcctcagacacggcgatgcccagatcagcctcccgcatcatctcgagcgcgcgctggcactgctccagcaccgtctccagcgtcctccgccgcagcttcagctctgccgcctccggcaccctcctccccgcagccgcggcttccggcgccggcgccggcgacgaggaggaggcgggctccatcgaaaccctagatatgggcgtgcacggcggcggcggcggcggctcgatccgtcgtggcttcgcttggcggtttggtctaactcgacgacggtggaggggatggagagggaggcgggctcgcgtggatgcgtcgccgtgctcgaccaaatcaccaaattttgcttctcttcgcgataagggagaggtcagaagccacggtggagtagccgccgcgctaacgttgcttgcaagccagccagcgagcgagccccactgacaggtggggccagtcatatggaggccccacacatgtcagtgtgagtgtaggttcacccgatagatccaccatgtggttgttagccgtaaataatactacaacgaagaggggggtaaaagggcgagggaatctccggagagacctcgtcacttgcggacctgcggtatgttataaattgaccgtgattaattagcaattaattatataaattgaccgcgaccaattagctagtggtactaatgagtactccgtccgtcccaaaatatagcaatcttgtactaggatgtatctcatccagtacaagattgctatattttgggacggagggattactaggactaggctagtagcaaaccggtcgcaactcgcaatgaccactggctgtgttttccctctccttttctaattcacctctcttttttttcacgcgcacacttttcaaactgctaaagatacgtttttaaaaaataaatatacaaaagttacttttaaaaattatattaattcatttttcaaaaaatagctaatacttaattaattatgtgctaatgagccacgccgttttattgtgctaaacggagtagctcattagcacatgattaattaaatattagctaaaactgtgttcatttgaatatattagttctcaaccatcctaaacgaacagcctaagactgttcatttgtgttggttgggaaccttcccttccagcacgaacaacggagaaacacattagcacatgattaattaaaatattatctaaaactaacttgaaaaatagattaatatgatttttttaaacaactttcctatagattttttttttcaaaaaatgcgctaaaccttcctactaggatccgtttaacaatttaaaaagcatgcgcgcgaaaaacgaaaggataaagttgggaacccctacaaacgagcgcagcctaaataggttctataagagcaagtttaacagtatagtcaactatgggtttcagatcatgtatagtcaatttaatagccaatacatacaatagttacctataaacatatattacactattgatgtatggacccacatatcatacacacattgcgtattgtagttcgtgttacagctggctacaaatctgtagcccgttactcttctctctcctcttttatctcctcgaaatgtgtttatagatggcttatagtctgctattatacctgctttaagagcaagtttaatagtagagctaaccaatagcttacgcatattcacatacttcaaaatgaatacattaaatgcataggagaagaaaaatacatgttaactctaatactccctccttactcgtaaaggaggccattttggacagcgaaacggtctctaaaatacaactttgacttcttgtttatataacaatatttattgaaatgtgatatatgtatatttttatgaaagtatttttcaagacaaatctattcatctaatttttacattttcaaactcaacaacttgagagttattcatgatttatattcctaaggtttgacttaaatattatcttaaacgacctcctttactagtacggagggagtataagctataagcttatagttggctctactcttaaccttctttatttttcaaattttctcttcttcacatggcttatagcctactaataaactttctcaatgagttcagatttcagattcctgcaccattaataaccgtgagctgatggtgtcaattgctgtcttgctgagcactctcctggcagtatgcttgcatagacaagatcagtaatcaaaagcagcagtagctaactgcttcgaagtaccgcttgggtaaaccataaacaacaggccatttatacttgacattgcacaggccgatgagaaaaaaacttccaccacggaccacggttgatatacatcaagaaaatctacactcagattattctaacgaatcgtataatgtcagggagcacacagttccactatatcagaccggatgatcgttacatttgttatggagcagtaaaaagaaacacaggtacagaaggtatctacaaggttgatgatgaggggaggtgaaactaatttgaccagacatgcaccaggcctttgctgtttccagtgtagatttcgttgcggtcctcgtcgtagaatagtgcggtgatgtcctcaagagcatcagaaacagtgctccgaatggtagatctgctgctgtcacctctttttcgaggagcaattgtgagagtagggtcgaggggggagatcttggcgacgcactttcccgtgaagatgttgctcatgttgattgatcccgtggggggagctgagtaggcaacttgccaatttattcatatgaattcaaaaacaaaaaaaaaacagaataatgaaatttgaaattacctatgccctcgcagccgccactatctctgacctcctttgaagctttgcag

SEQ ID NO: 42872 - DNA, 20505 bp, Oryza sativa
ttttcagtggggttccatcctcaattgagagtatctttaatggaacatgattagctgacttctgataaattacgagcatgattccaggactggagagagaggtttcatgaatgtaagaaaatgtcaaatcaaagatgaaaacttatttttttatgtaatcagtcatcagtgataaccgaaccttattttgatttcctggatgttcttatcacatatagaatacagaaagttgtagttcttcagatcaaaaactttgtaagtgctgcaaaggagaaacaattacactatgcacataccactgctgtcaaactgtaaagtaaaatgttacatacctatcctgggctgaaaaagtcagtactttgccattaacatcatcaaactcaacaaatccagggtatttcagtgattccgtttcaaataaaggaaacccatcattcaattggcctcttctaatgtacctaaaaagaagttatgataagagaaaatatgttgatgctttaaaatgagctagcaaacagatcgaggcatgaacttgtgagttgtgacaagcccaattatcactttctaaataaacataatgagagcaaagaaccagcatcttgctctgcagacaccaggaagctcaactgtttagcaccaaagatactcttttcatacacagaataattcaagaagaaataaataaggcttcttactctattggagttgttctgcacttgagcgagctgaaacgatctgattcataaactgaaacggtgataagggattcattgtttttattataaaacaaactcctaatcacttcatcaggacttatattcaagtagcatatgcgcttgtttgttgctgccaacatgagaagaagttttgttaggaacataaatctgacaaaagcaaaaccagttagcattgaagaatgagatttaccccgattaaatgcaccgcatagtccagattgggcaagtgcaaatatgacatcctttgctgcaacaatctcaataattttggttctgctccacaaaaatggcagctgaacaagaaaatggacttcatcatcataggtgtcatactcttcctgcacaatcaaattaaattcataaattagtaaacaataatttaaatattaaaatatctgaattgcaaagtagtcagttaagggaaattctgtgcatgaaagttagttgatcagatttagcaggtacgattatagaaatgtgagatcaggcgtgtccattgatcaatcctggagttttcttgccctccccttccttgtccaaatctacttattagccacttcctgatacctcagtggcgtttacatcaatgtcttctctgtttatccaacatatttggcacaatatggaacattttcacacatatatgcacacaagacaacaaaaaaggcattaaagactaaaaataaattataggaaggtcattatccagctcatgtccagactgtacatggagccgatcatgcaaatttaattggattgcacagaaagttttactactaaccttttttggaatgtagccgagttacttagatcctattatgtcaggtggacccactggtttgtcagggccaatatggtaggcattatcttcaaagaataaattggcttccataaacatttcaatgatccatgtttgttcagtacttttaatgtacagacaacagagtcagagtgatttaatgtttttaagattttactatggctgcggaggcaaaacccccataatacaatcatacatggtgccacaatagcagctacatatgtcttcttccatgtcattagcatatagcattggtcttgcacatgtcctcttcccacttgaaaatttccatattagaggcttccagtggcaaacatacaagcaaccaaaatccacaaatatcttttctttttcagctaccttcaccatattaccaaacaacactaattttaaagataccgcaaaaccgtcactactctgatatcactcggtttcttttccatgagcttcaactcaaccgattaggtatgtatgaaaggaattgtatgatatgttactgttactactcacttatatgtggattctggtaagcactcgcccataaatgtgatacagtggttgttttagttaaaacaatttctttaagccatcagaaaacagtggcattactaaagcaaaataactggcaacacccaaagaaaaggtcagttaaatgcgacggaggacgaaggtacctagaaaatgtggaatcatgaaagccttccgcctacaaattcctatcttacccatccagcttatggtttgccatatttaattaacattttattagcctagctggctagattcgcaaaagataaacaacacgtggccacgtgggaaatttttgcacgaaaagtctaatttgattcgcattgggtacgtaatgttttactgttgagagaacagaaagagtgaagagaagtataaaataataagcatgtattttaaaatctgtatagtatatgcatctcatgatgcctgaaatacaaatggtgtcatgctaattacagtttattcagctcatgcatcaactaatttcaaccccattcagatttcaaattttcaatagcattgaaccactgattcacaagttatgcaaatatgctatgaataatcaatagccttattttttttcagttatgcaaatatgctataaataatcaacaaccttattttttttaaaaaaaaaaaactaagtctgttggttatgcacactccatatatcaaactagaacatgcaaaactacgtgcaggacatcataagcatttgcagttgatattcctagcactgaattactagatctagccatggcaacacaccggtgcaatgttataacattgccagttcactaaccagattaccactattgtagcaatatacttgtgtctccacaggcaacactttctggttaaatttgatcgcatcgaatggattgccacctaaagttttaaaaaaaagatccctaactatatcaagtgtcacggatcagaatgaattaccaagcggcactaggttaatcacgactactggaaacctaggagcgaggagacgggcaagctgcacatacctgcagctggaaattccggaatttctcggggcaggagaaggcggaggaggagggcgccgcgggccgcggcggccggcggtgccccccgccgatctcgcggcgcgcgaccttgtggacggagtcggacgggtcgcggcgcggcggcttgcggcaggcgggctgcaggcccgcggacagccacgcgcgtcgccgcgcggcggtgatgcggaggcgcacccgcagcccgggcttgtggtggtggtgctccatggcctgcctccgccggcgaggcgggagcgaggggcgcgggcacggggacagccgggggaccgaggaggtgtaggggaggggggcggggactacgcggggttagggtttagaggaggcgccatggatggggaggggaggggaggggacgcgggaatctggaggctagcgactagcgaggaagaatgggggggagctggcagtggcactaggggcgtacggaattgcgaaggggaaaccgacagcggctacacgctactcgtacagatgaacccggttcacaattccaatggaatccgattcggacctcgtgaaatccgaacttttttgaatcgggccatcgaagacacgaccgattcctgaatttcaacaaaatttatttgtattttattggtttttatcggtttatcaatggattccgtgaagtccgatgataccgtttatgagcggattttgatacagtatcaagatggactatgggcccctcatagcaattttaatggtacccagcagatatcacgaataatagtgacattttctcaaatcggtaattttgcaatggtatgatccaattaacctttgaatcatagggccaaatagaaaaggtttgaataaaaattggatcttatgaaattccttataaatcattaaatttacccgctttcttaatactcgtatccaagcctaaaactctctaagatatcttaggatggagacaatatcatataagattgtgattacgaaaactcttagcaatagcatgaaaaacatatactccatctttttttaagtagataacgttattgccttttgaacacatgtttaaccgttcgttttatttaaaaattttatgtaaacgtatgagatataaattatacttaaaatactttgagtaataaaataactcacataaaaatatataattacataattttttaataagatgaattatcaaacatgtgtttaaaagtcaacggagtcatctattaaaaaatatgatagtagtagatttttatgaaaagagcgcccataatctcttctttctataaagctgctaatgctcactgaacacctaaagctcaacatgcaagcatagtatttactagcattcctaaaacctacatgtaagtataccatatcaacccattaagcccacaaatctcaacatgcagacatataataattatagctacaaatttacttcactctaaaactaaacatatacatgctaaatcatcattcttaaattattttcataatatttcaatccaaatcatttctcatttatctattgtttaacatatatcccgcagcaaagtgtagggcatcatcttattaataacacgtgtaagcacattgcgtggcaaggcattgtgatcaatgtcaagtcattatcgtgtgtgccccgtaaaccggttgataagtaagaaacgagaaatttgtcactcaaaaagttttttttttgttttatgctactatagtaatgttatgcatttgcttttgttgtccccgtgccgacattgctgtccttttgcatatgagtatacctacgtaatcagttgatcgatatcacatagttattataatataagctttggattcgaaggtaatcaactgtttattatattttgtactcttgtcgattttcagtatatccacttagaatccacgtgcttaatttgcatatatagaaaagaaaaaggctatacgtactaattttttcttactaaattcttactaacactgatgtgtcatgctatgagtacatctagattttttataacttccatctatttaatcaaacggttgagatgattgttagtaaatgtttagtaagaaaaatttagtacgtgtagcattgctctatagaaaatatgctagcaaagtgtaaaatagtgggaaaactcaaatcatcccttaaggggatatccccttatttttatatgtcacttaaaaagtaattaaaaaatttagtaggatagatcaatatgtgatatgtcgcttcacaaacatgcaaattcaaattcaacttatacaagtagaaataaaaataacaaatttaattatgaatagaacacgtaattcacagtcatatttgttatttttgtttcgaattgtataagttaaattttaactcgcatgtttgtgaaaagatatatcacatattaatctatcttgtgaaaatatatatcatatattgatctatcttgatattatttaaaaaaagtataacttttgaactacatgtacaaaacgaggggatatctccacgagggacaaaaatctacttccaaaatagtgtgcatctgttgaatgtgtgtatgcatgttaggttagtagtacaggttcctgctccaacacattactatacccagaacatgtcgagatagatagagcttttgaaccccacaatgcagaatgcagaagcaggtggggcgaagaggaatccgagagatcgggagcacaccggtgcaacaaggtatattggcatattgttttcctatagaacaaagcatttctgactctgaagataacttgacccccaataaggtctcttctcttgtcatacatgttcggagtactatactagactctgaagataacttgaccctcataaggtctcttctcttgtcatacatgttcggagtactatactacgggtgagtgtgtttagttcacgctaaaattagaagtttgattgaaattgaaacgatgtgacggaaaagttggaagtttgtgtgtgtagaaaagttttgatgtgatagaaaagttagaagtttgaagaaaaattatggaactaaacacggcctactataggtgatttgcttccaaccatgcgtccatggcactccattctcgtgacaaacacagcagcttaattggaggagccagaggctatacagactcagtgcagatcgagcagaggcgagaagcagagggtgtattcctacccggggccggcctgttggagatcagagcacaggagcaaaaattcctcatctgaatattcagacagacttacagttacctctgcatcggatgctcctatacctatccaactcaggtcagggatattaaatgctcatcagagagagatcaggcacagcgagagaagatgctatacgctgaactgaatttcttccctgttcttggtgatcgtttcgtcacctgtgattttcattctcttggacaaagcgcacccggggcgagagcagaagaaacggatctctgtctttctgacgacgggtgtgtcgatcctggattggcagcggcaaatgacagggtacagtacatgcctaggtttcgcacgttaccatgtccatgttactctcgcgaaacaggagtaccaagcaatgcaggtgtgcatagatgcgtggtgtttgtgacctctcgttgtataactacattctctaacactgactaatcacaatgcatacgtcagatgaagcgtgcgtagctcaactgattaagttccttattgctcgtatttatagctaactattcttttaatggtaggctacgttccaaattattctttcagtggtagcgagactccaatggtaacttcgtcaattttaagatatgccgacccaatctttcgaatgtgctcacagaggtaaggtatgcgtgtgtgcgtttataaagatgagtgtgtgtgtgcgttgtgggtgcttgtgtctgttctgtatttataaaaaaacaatgcatagatcggtttagccttaagacatgaaaaaaaagaacacgtttaaatccttgcgaaaaaaaaaaaccgtgccaaactgcacgaagctggcggcggcccgaatacgccgtgcggagaaggcgtcatgcgcgcggacggacgatggctacaaggtggattacctaagcataagcagcgttggacctaacccgctcgccggcctgacccagacccgcccaaccgtccccaccgcccgcccgcggcctccccaaatatccactcccaccgcgcgcgccacctgtacaagagaaaaaaaaaaaacgaaccaaacccacccgtcgtcgccgctccgcccgcgcgtgtgcgtgcgcccacgaccgcgcgcgacgcgacgcgccggcctcgtcaatcccatcgatcgatctcgccgtcgccggcatcgtcgcgatcatgccgctagatggtggggaggtggacctgtgggcgatggcggcggagctggagcggcagttcgccgggtacaagcagcggcgggcggagaggagcggcgcgccccgcggcgacgacgatggcgccgatgcccgcggtggcggcggggaggaggaggaggaggaggagggggacggagacggcggcgacgtgagggggaggaggtacgaggcgtacacgaggcggagggacgagcggctgcgggaacgggaagggtggcgcgcgcgcatggagcgcaaggaggccgaggtcagggcgctctgggcgcagctcgagcgtcgcgccgccggctgtgccaccgccaccgccacggcgacggacgacgacggcggcggcgcggccggagtccgagaggtaggtaattccgttgccaaaaaggtcgttttctgcttgcggtcgccggcacgacacgttccgtctctttgttgcaacttaacaagcgcgggtcgtttttaacgggtctcaagttgctaagttgcttctagccttctaggatatgattgattgacccaaatagtttggacgttgcgtttctgcaatctgcatgccattccatgattgatgaatccttctatctttcgctgaaaaaaaaaatccctagatcgatgcttcctgtgcatgcaagtatgcaactgcattctctttgatcaatccccctctcacgttttcgttctgaaattttttcttgagagagtcaaaactaattcgttctagttttaaattacgtgttatagcctataccctccctcctaaaaaaattattgtactacgaaaccggatatgccaagatttgattcatggcacatacttcatccgtcctaaaaggctaaaataagctaactatgtgttgtttagtaaatctaataactaatggtcatctttagactgcagaattctttatagtatttcgtagcgctttcgcgaaaaagaatagtgtttcgtagaggtcagttcaattttcagaagattaattatttcaccattcgaaacgggacctaaagtggtaaaatttttagtacggcacaagggttcacgtgaaacgataaatggtgggttcacgaccaaatccttgttcagcactttctgctgcagcacatatctctgccaaggagttaactcccggtcccgggaagaaactgcatgcgcaggcagcaagcaaggcagcatcaacactccgtgtgtcaataaatcgtacgtgtattcctgatgatatctctcatctcaagtctgcgagtccttccctgtgaatgcgtgcgctcccgtgcaaacgcatgcttcgtcaactgctcgactcatcgtccgtaaaagagaaaaaaaattggaaccgtgcttgactgcgtgagcatggacttgtttctctttttttttataaaaaaatatatatattcatgtcgaacttgtcgaaagagattgtttttacaccgtccaaaatgagagttacttgttggactattgggtttataaaatatatatattgctgtcgcatcggtcaactattaggtttcgctgtcaattgtatctgccctagcttacacgttgccacgtgaaacattccctacgtggtggtgctctgtgtgcatatgagttttctgtataattgtaaaaaataaattatgtgtgtatgtgtttttcgtgtaatcgtaatttttttatatatttgatacttatgttttttaatatatgatgtctttaactttttaaaatctgtttgatcattcatcatattcaaaacaatttatgtaactattatttatttattgtcaaatgttttttaaaatacgatttaaattttttatatttaaaaaaatgaataagataaactgtaatacggttatgaaaaagttacagcgtcgtatattaaaaaaacatttaaataatacattcggttgttgtttaatcgggtgtggtggcgtgtactacagaaagctgggaaagacggcgagaagaggagaagatccgacgtggctgctccggcgagtaggatctccggcaagaagcacgcacgcaccaggagcttctcgtccaccgccacgaagagcagcctccccgacgccggggcgcggcgagcgctgtcgcaggagccgccgccgccgccgacgtcagagcgacccaccacggcgggcgccggcagccatcgagtagcgcgggtcaccggcggcggagcgacgacgaccgcgccgaaacccagggtgttctcagggcacaggagctcgacggcgaaagagcatggctcatcatctgccaagggtgggacgacgaagccgaagccgccgcgctccctgccccggcggtcgagttccggcgggttggagaatctcaaggaggcggttctgtcgaacacctgtgccgcggttgcaccggcgcagagctgttcgaccgagcaggctactgtccatggcgaaaccgggaatgcttctcccccgtcaccgttcgctggcgcggcggcagcgaatgcccgcgccgcctcgccggattcagactgcggcgaggcagtggacggtggatcatacgaccgtgaagccgaggcgaagcgtgtcggcgagcacgacgccgaggaggtcacggtgtctccccagaagctggcgaatggagagatcaccagtgactcggacaccgagccgagctatgtctacgtcaagaaggacgacgtcgagggggaggaggatgccatggcgaggcgttctgaagctttggctgtctcagatgccaaacctgcagagctggaggtggagaagaataacagcgacgccgccgcgcgcggcgaggagaccacggctccaccgtcggacgccgtcgcggcagagagcgcgacgacgatcgtcgcggaagaggcaccggcgagggagagctccgacgagtcctcctcctcctctcctcctccttctccggcatcaggtcagggcgcggctcccctcccagcagcgcgccagcttcctacatctcgcgagctccgtccatcgagaggctgctcgaggaggacgccgcgctgctgcgcaagaagcggcagcagagcgccgacaagctcgccctgatggcgatgacgacgacgacgatgtccaccccgccggccagggtctccggcgcggcgcggtcgcgaggattcaagagcttcttgagcttcgggaagaagaacagacgaggcaaggatgtcaccgtcatcgactgcacctcgccgtcggtgccctcggtggccgacgacgacagcggcagcggagggtggccgtccggtgagacgatcaagccaaggatggcctcctcggacgctgcctccgacgacatggaccatggctatgccattgccgcctctccacagggtaatcaaatttcatgttcttccatagagtacatgacaattagtaattactagtacatgatatgttgtggtagatttctgatgcttgttaatgtgaattttcaaacgcattttgcatgttttaactctgcaggttgctctttgcaaagccttgtggttgcatctcctgcaaagtctgaactgcatgagatagacccacaggagaaatcaccaaaaggtgaaaaaaaatgttttgattttgttgtgtgttttgcagatcattcttgtttctttctgcctctgtactaatgttgtctgtttttttttggtcacagctcatcggtcgttcttctcgtttcgatcattcaactgtggcaggagctgatctgaagaactgggaatagacagttattactactgtaaatatagaccagtgtggaaattaggtcgctgcctgaaatattcagaaatcagaaacccttgcatcatcttgattcaaatttcaaagaggtgaaatgttgttatctgaatactattccttgatacagtaaggatattccatagaccaatcaggatgcaagaagagcagatttggagatacttctgtacgtatgatggcgtgtttatgttttcttctgatgttcttatcttaacagtctatgttttggcaactacctgtttgcatactgtaccatgaaaatgagaactgtccatccacaatatatatgtcgtgaactggttagttggaaattagcactcgtgcatgtttcagaacattcactttgttagcgaaatttcagaatatatatttgtgatttttagctttggttaattaaatgtgatgaaggtcattccaaacatgagtaaaaagctgaacatgctttcccctagtgatgtatgctctctacttataatttgtatatgtagctcttttctctacaaattgacattcagatcaaaacattgtaacaaacatgcatgctaggaacagtactcatttgtgcacttccgctgggagagacggctaggattatcagtttatcaccaaatatagtgcatctaataagacactatatgaagtagtaaattaaacatacttcttatcattcgttgccttctgatcgtacatgtgtgttttgttggaggtaaatctgcttgtacatgtgtagaagcatctcatggtttctgccgtataggaaccgtctatatactcactggaacggaatattagttaataccatgctatcatccatgaccaatattctcaagaacactattgtgtgatttaactaagacagttagctacctcttactggaacagcatattagcactgagaagaacatacctgagctttccatgcgtgtaggaccaaccaacatcaaacactgttggcttccctcacctgcatctttgctttctctctctgaaagtctttgtcactttgtcatgcttaacgaggacagtatgaaaatcagtagctagctctctgcaagttccttttttcttgttcaggaacatgcatctaagttctaggtcttgctttgctcacagtgatacccaccttgtctgtccataagcatactttgcttacatataactacatgctattaatagatgctactgtacaaactttgaggaaaagtataactttcgatggaactaactcgatctatccattggtggagaaaggaattaactttgacaggagaaattaaaaagtccatatatataccatttggtcaaaatcaggtgatccatttcagatgtgtctctgaaccttcctatgggctcagctagctaattaacacaccatattaatgaccaaattaactcgtcagtatcctgtttacctcaaaagttttcaggcaaatttccacgagtttccatgactttctagcgacaaattggctcaaaggtcaagaattcgatcaccttgtaggacctcgtttctgactaactcgtcagctagaccagctagctagcttaggtatcagctgcattcataagatccaatcaagaaaacataaacaacacttagaacacttctacttacaatgcatcggcgaatttcgatggccgatccatccatccatccatggacgtgctacttagctcgatcgatcacgagctcaagcccccactctaatggcggcgccgccgcggcgatcgacggggcgagaagccatgctggagaaggagcgcacatgctgcaagccggccggccagccagccccgccgtcgagcacgtgccctgcttctccagcacggtttgctcacccctccttcttcagttcttctcctagggctagagctagctaggccctagcctctctctcgccattggaggaggagaggagagctgggagaggtagaggaattgcatggtgatggctgcaacttgcaagcgatgtggcgtatatataggcgggcaaaagcatagtacatgtggtaggaagacatggttgtctaaaaagacctaactttctctgtgaaagggagcccaaacctgcctctcgaaattaaagttttcttctttttcatcgatcaaaggcagaccaccaaacctcggatccccatccatccatccaatccaattaatccgagttcatcagttaatcaacctaaaaacccagagttcagttcatcagttaataattaatccgagatgaaatctctgtctgtgtgacttgtgttagtcgctgtcagaggtgaatttaattagagggatcattcgagtttaacttttgacaaaaagccgctttgattacctggagatgatggcagcgtcaaggctagtttaaccgcccgtcggcccggcccttggacggcgaccgtaaacgattgtatgactctgatcaagcgatcgagatgaaagcctgcagcaactgggggttttgttaatggttagccacatgttttaacctaatcttggccgactaaactagtctttcctcacttatgtgtagttcttatctttatggtgataattaaccatttgaacactgctgatcaagtagaaactaaattaactatttgaacagctgatcaagtaggctatacaatctcagaaggagagacgacgacgagttgcggacaaaaagttgagagcccagtgcctggctatcatatcaccactaaacaaatgcacgcgcggcaactgatgtgatgtcagtgctcaaacgcagaactttttaatttgtaaataccatttttgtatgccaatttagggcgtatagaactatataaatatgcaatttacgcgacaatttggcgtgtatgtggttggggattggcatctaatcggcaacgcggggtgtcgtcagatgcagacagtgcagtcgcggacagagttgagagccggtggcatcagcgagagtgatgtgtttttgtggctaaacaaatgcacgcgcgctcgctgttgtcgggtggacatgggcgctgatgctgataagtaaatcgataatccgtgtgtgcccagttgcgaatttgatagaattttgattggattggtttaggcagagggtcaatgcatgcgtgcgtacctagctccatgggtggtttactcctgtctgccatgctgagattgctgatgcagcagctttaatttgcgttttggtgcagatgcagagctgcagatagcctactcctgttggaaagaagcttggagagagaatgtttggcaggaagaggaatgttgtgtggctactgtccccaacaaccatgaggttcttcagtgtaataactgtttctttgtgcttcgttgggaggaccattttgcttttacttgggagaagatggcattttttttctgtaacagtgtgtgaatatattaccattagggtttcaagttggttaggacattctggtttgggatggtagacctcagcatttcattttccttgacctacctcgtactatcagtctctttgaccggataagcataacttaagtcttaagacatgcgctgtagctagtttaagactcactgttgtaatttctagtcatttttcttcctctcggtcctcatccattgattctattcgtatcttaagaagtctttaaaatcactttgacccttaaatgatctcaatttaaaacgagctttcgactttctctttcagtttttcttagaaccttctcattctagaagtattttttttcacgaacgcgtaaaaggattgcacgtcaatatattagaagaaaatagttatagttacacgacgcaatcagccagactggcttatgcaaatagaagggaaaaaaacaaaataagaagctgaagcttttaaaaaaactacattctagaagcattttttgatttgttctaagcatgtaaccttttttttttcacccttcttagaaacttctttttatttatttgtttatttttcttgtttgtactaaacacaccactttatattggacactccaggctaccaaagttgaaagttgttaccaccagagccaatgagtcccatcttcctcaccgaagactcttgtttgggaagacatgcaatcctttttcaattttttgtggaacaaacaccaatcttctgctctgcatttcttttttgagatacagggaataagacaatagacatggaactattttagcacgtccattcgaagtgttaattcatttcaacttacaaggctataacctccgtcccaaaaaaagtttatttgtgggtttctgtgtacaacgtttgaccctccgtattatttaaaaaatataaaaaactttaaaaaaagtcacacataaggtactattcatgttttatcatttaataacaacaaaaattactaatcataaaaagcatttaattaagacggacggtcaaacgttggacccagaaacccacaaatgaacttattttaggacggaataagttcatctgaggtcccttaacctatcaacgaatctgattttcgtccttcaaccgaaaaacccagatacaacgggtcccttaactgtcaaaactggtgcaatataaatttcatggtggtttgtacgacggttttcgctgacgtggcgcttacgtggctaatttgactcagttttcatatgacgtggcagttacgtggcgcttacgcgacaatttgatttggaaaataataaaatttgtgaccccacatgtcagttacacaaaaaaataatttaaaaatgatgggcccacgtgagccccacgtatcattatcacccctcctcttctacctcctctctcagatgaacttattcctacagagggtgtaagcgattgtagagcccaatctaggcctcgtaaggcccattacgttatacagatccgtatctaggcccatccaagacattttgaacaaggaatacacagcccattaatgatacagaaatggcccgttagtgggtcgggcccaccaacacattgcaaaaagtgcaaaaccactcaacccgtgtgcgactcccacgcctcgccaaaaaccctaacgcattcgcctccccgcctccccgccaccggccacctcccgccgcccgccatggccgacgtcgacacgggcgagctcccccagacgccgcgctcggcgaccggagacgacgagctctccctcatggacggggagcccgacctggccgcggccgtcctggcgcggctcggcgggtcgccgcgggaggacgaccagcacctctgcgccaccgccgccgccatggcgcaggccgtgagggaccagggcgtcgccgccacccccgtcgcgtacttcgccgcggcggccgcggcgctcgcgcccctggcccgcgcgggggccggggccgcggaccggcacgtctccggcgcgctcctcgcgttcctctcggccgcggtgcccgcgctgcctccagccgtggcgcgcgcccgggggcgtgaggtcgcggacgacgtggtgcgggtgctcgagttcccttcgacgcctgactccggtgtgagggctggggtaaggtgcctcgcgcacttgatctcggctggggagaaggcgaactgggaggcagtggagccgctctatggggtggtgctacgtctagcagttgatccccggcctaaggtactagcaaaataccaattctctcaactatgttgctgtcaaaattattacttatgcgggtaaatatgcactgctgtgtaacttgttgtgatatactgataaggtttactgggcatccaatgctgtttcagttaatctgatttaggatgcagaataccgtttagtttaatgggaaattctagacttcataattttagagtcatactccctcatagtaaaataatataactaaactcatttctcccgatgtcaaataaatttgactggagagagtaataatcgaagaaggatactgcacacattgtattcttggctcagcagattttgttcatgttgttagctttactcgtatcaaaattcaattgctctgtatcatgctgaaaaatcattcatagtttgctttgatggggctgtaggtgaggaagcagtctcattcatgcttgcgagatattctgctcagtttccagaggcaagctgttttggtccctgcgagtgaaggaataacgagatgttttgagcgttttctactgcttgctggtggatccaatgctgtaaacacagatgtagcagaaggcggacctaagggggctaaggaagtcttgtatattctgaatgctttaaaatgctgcctccctcttatgtcatcaaaaccttccaataccatcataaaatattttaaagctctgttggatctgcaccaaccaatcttgacacggagcatattggagattctgcatgctgttggcgacagtccaactgtacagcttaaatctgacgtgctactggatatagtatgctctttggggctatctgtctctgttgaaagaaaatcaggggatgaaatggcttcaattgcaaggcttctaaatgttgctactagaaaaatttataatcagaataagaacatatgtgttgtaaagcttccactagtatttacttcacttggaggttggttcttctcacaaaacttggcacctttaagttgatcaattatacctagtaagtcatattatgtcttttgtgtaaaagtcttgttgtaaattgttcgccagatatattggcaagtgaatttgaagaagcaagattttctgctgtggaggctttcaaaagtttaatagaagactgcatcgatgaaagcatgatcttacagggaattacccagattaagtctagacatccagggataagatctgatcccacaaccatagagaagatatgtgctatcctagagggcttgctaaatgtccggtacggtgatgtctgggacaaatcatttcatgtgatttcaatggcatttgacaaattgggtaagtataccactacgttagcatatcctcatcattcaatagcttaggaataatatgagagtctctattttagtaatctggctcctctggtcagagcattaagattcaatgtagcttcttgttcacatcttttgtgttggactctctttcttgagccattaacaacctttatccaaaggtgtttttgttaaattgaattatgctattggtaattagttgcttgattatttgtgataattgttcctgtactgatctctaatgcaaaactacaggagaatcgtcagctgaccttttgcctgaagcacttaagaacttggcagacatgcaaaacttgtcagacgatgacttctctttccggaagcaggtaacttttcccatagaaaaagcaccattgtccttcagcataatataaacaaatttatacctttcatgcaactaactttgtttactccatgtatgtttggttatctcctggcttaccttcatatgcatttatttgcagcttgattcatgtcttggttcagctgttgctgctatgggaccaaagaacgttcttaaaatcctgcagattcattcaatatctgatgaaaatgaatggatcttccccattttagaaaagcacattgttggtgccagtttacaatttttcttaacagatattcgggacattattagagctgtagagaagaacattccaaaggtatcgtccattttttttgaaaatcctaatagttttaaagcaaaaacagattaagcactttcattttaaactgcactgactgtttccaacatcttcaattgaacagcttttaaaggaagataagcttttctccgccaagagagcagaaggttatgtgtattcactatggtctttgttaccatcgtgctgcaattatgcacgtgatacctcaatccactttagagctctgcagaatgttttgtgcgacacgcttaaaaaccagcttgacttgcgtggtatcatttgttctagtattcaggtatttcacactgcatctggttagttctatattgcaagtacttctgtttaagttatgcttttgagcttatttttctttttttttggcttgtatattttaggttttgattaaacaaaacaaggaagcattgtcagttcctgttgaagaggccatacttgctgaggatgaaataagcaaatctgaaagaagagcaaaagaacgctatacgaaagagtttgcagaggaaaacttaaaagcaatacgggctttctcttcaaagtttttggaagttctatgttctatattcttagcttcttcaaatgatgctattggacttctacaggtatattgttgatgccttctatattgtgccatctgcttgctgggctctaaggatctgtactttcgggaattgtttgatttggctctggaagttgatttcttctatgatcagccgacaggtcaaaatttgaaatgtttgataataatctaatgacttcatccgaatagatcacagtggggaactttgaacctttgggtgttaattgttgttgaggattaataattggattgttttgttgattgtttttatatcatgtacaagcataaatgtgacttgttccttctttattgaacagcctgcaataagtgatatagcttccatatcagagaaagacactgttggcaggttctttcttgatgcaataaggaagttgttggatgccacaaaagctgttaatgcagaacaaaagaatgatagttcaatgcaaatcgaagctaattccaacacaaataacatggcaaggtctgcgcaaaatttatattcttgttacttcttattcatgtctagattccagttgaagccgattgttaatttcaatccttgatggatcgtagggctctcctgttggactttgcagcttcattaatgcctggtttagctgcaaaatcgatcaatgtgctattcagttatgtaaaacctgcaattaaggtacatatatgatatattgcaagtatccaagctgttctttttttttaaaaaaaattgtaagttgtgttgtacctgatattttttctcacgctcgtaggatactgactcattgattcaaaagagagcatacaaggtcctttcaatgctgctcaaggtatgtctccgttttcagtttgcactttatgtgaatcatcatggcagatcacagagagataacttgaaatctttatgaatgtttatcatttcaggatactgagtttattgagcggaatttggataccttgttgggcttgatgatttcttctttgccatgccaatttccatcaaagcgctacaggcttgaatgcctgcatcacctt

SEQ ID NO: 42873 - DNA, 14796 bp, Oryza sativa
  unsure (1)..(14796): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcacctcagcaaatttctccaacggctgggtttgtatcaacgaacgacgagcaatgtcactctgatttctgtaagctgccggtcctgagtccctacgataaattccttgcgggctctggctgctaagatgaatgttacttggggaatcgaagaacacagcccggcaaaaagaatcgaagaacacattgttggcccaatgtctatcgactaacaaagaaaggatacctcaaaaccttggatattcggtggtttcttgattcatgccttcatgtatccttgttatgcaagataagataattgtttgtatctgggctccccgttttgtgtcacgtgttgattcgtacatggcagtaagttcatctgctcaatcgggcaacccttcttactcatgagaaggaatatcaattttggtgattctgtggaaggaatgaaatactgtcagctccaacaatggccttcttcgtctgcagggtacagcctatgcattcgctgttgttgacacaagacactgtacaggctacaacgcgcagccagccatggggaatgcagcagaacgagcccaaatattgattttgttgttgttattgttgatagggtttttttagaaacaaatcataataattgaggttttatattacggattcttcaatacttaaggttttgtgaaacttactagatttaagaagttacggcaatttcaaacaaagcctaagtggttgtacacttttatgtctaaattgactttactaaatttcagtagtgccaaattttggcattgtccaatactgtttacgtcacaaaatatgactatccagtactggatgtgacacattctaatactacgaatcgagacagaagtcatagtattaacatgtgtttcatctagtactctctatttcatattataagtcgtttgattttttttcttagtcaaagttctttacgtatgactactaagtttatagaaaaaattagcaacatttataacaccaaattagttttattaaatttaatattaaatatatgttgataatatgtttgttttgtattgaaaatattagtatatttttctataaatgtgatcaaacctaaagaaaatttttttctttaatgaagaaaaaatcaaacgacttgtaatatgaaacggataaaatactagataacaacattttcggatagaggaagaatttgataaggctatgatgtgcaagctattacctttataagtttttatgagaagaagattctaaaattaccaaatcttaagagtcaacttttgacaatatttagatggttacatttgctaaattttagctttaaaatgaacagccccctaaaatcaggcgttggacaggataacatcgtgagaaagtttgtttcgttttccgcgcacatgtttcccgaactattaaacaacgtgtgttttgcaaaaaaaaattctatataaaatttgctttaaaaatttataaataatttatagtcaattaatcatgcgctgatgactcacctcgttttgcgtattttcctctcttctcaaactcacccctaggccgtgtttagttcacccccaactacctctaactttcaactttccatcacatcacatcatcacatccaaaacttttatacacacgtaaactttcaacttttcccaaacttataactttttcaggaactaaacacagccctattactagagggcgcgtgtcagccagatcagcactgcgaccggaaaccaatcctgacgcgccaccccggcgagcaggtagaggtacacagggcgctcccgcgagtccgccaccgcaaccacctcgcctcgcccagacgctgacgacttcactccactccacgccctccttcccccgatactgctctcttccattccttccaaggaatcctccccaccatcttcatctccactccctctcctctctactcctctacgcggtcgagcaatcaacccgccgccgccgccggaggggccgctctccgtcgagggctcgccatcttatatatgggccggccgcctccggctgcgctccagctgatcggccgccggaaaggtgcggcggggtttcgtttcgctcccatttggatcatgccacgcgggctcaggggctcctcctcgtgttcctcctagatctggcttggaatccatggcggtgccccgttcggctgggctgggtgcggtgggtgggtggttgtgcgtcgttcccgtgcggaaggcctcctttctgtttccgctttagagctgtgggcatgaataactgtgcactctttgcctttgtgcacacctaccttgacaaaattcctttatgttttccatccacttgcgaatttgcgaagaattatatgcttctgttaaaaacaatactactagactgaattggagtacattcttgggcgaagttttctaggggtggtgtgagagtggatgctttggttgtttcacttgctaccgtggtggtaacgctaactaaattcgtggcttttgggagagacgttgtttggtttatgagctgtgagaatggggaagcaggctgcttgctacatttatggttgcaactttttttagtagtagcatttttagaatgggaaaatctctgaccgtttaaggttagttatattagcgaaagtggattgcttgtagctttgtaatttctggacattgtctacctgtattcttgttatctagttgtgatgacctatttttgtcttctttcctttttattcttcccatgctgccaaatagtctatatcactgtgtagtgcatattcttggttcgctgttggaatgttttttcttcagttaaattttagtattcctagaataggaaatggctgttgccaattgccactatgttccagcatttacttactgctggaactgttttccatggcttggataaattatcatctggatatattaccttgtactggtgacattgcacagaatctgcaagaagatgagttcacatggattttctacaaaaggcggagatgcagggtcaaaattaccaagtacagttaccaccctaaatccaaatgcagcagaatttgtcccttcaacttttaggtcgccttttggaagtagaacagttgcggatgtaagtaaaccagattttagggggctctctggtaaaacgaaccttggtaggtcggaatcatcaaaatctaataactcggatgatgaaacacaccagttttggcatagacagcttcctgatgatattattccagacttcagtgatatggaaaaagttgaacagcaacatggagaattgtcattttctggattgtcattgaatgcaccccctttctttggcacagcagccagcaacttgtcgagagagcatcatgggttattgtctcaagcaggcaagaatcttgacctggggcacaatgatttgtattatgatgagaattcaggttcaaacagtgggaagcaaaatcatgcagataacctatgttatactaatgggaagcttgacctcctttatgatcatgacccacttgagtatttagcatcccagtttcctggtttttctgtggagagccttgctgagttgtactgtgctaatggttgcgacttcgaccttactgttgaaattctcactcagttagaggtgatctcctaatctagtccttataattaaatattaatataaggaaaataaatctgtaaaatattcttgtcttgatagccagttgtgcacccatcattcgcaacattgtggtgtcccgtattaattgctttgctgggatgcagagttgggtattataatgtagtgttctattactttgctttgactggtgctaacaacttggacatcttcactaagtgagaataatgaccaaaactagtataatgttcactcaacttccgtttgctcatctattagctgctgcattaggctgtcagtacaaagcacaaactgtatgtatgaataattcgtgctatactgctatgcattagtattagagctttgtgttgctatcttattgttttagcctcttttgacctgtaggcagatcgttttgttttaaagttattcttttttcaagtaaaaattttaaaacttctgcttggtacttatagatgggacattacattttctgtgtaacagtacaaagttgacccttaaagctagagcatatctatatttaactgtacatattttttgtcttacattttttaaaaccttttagtgcatgttgtgttctggagattttgtggcatatatatgtaggctgggattttcccattctcttaaaaaaaatgcagtacttgcacgcaaatccgaccttttcttttgattgcagatgcaagttgatgctagctcctgtcagaatctgaatctggccccaaatacaccaaacattggcacaggaaacttccctgtactacctggaacagaagaccttaattgtttgtttgaaggcaatgtaggtgcccatggaattacaaacagacacaactcttcaacaatgtctaggactggagattttgtttcagctattcaaagacttgcattgcaggatgctggccacatgaagtttaaaaatgaaagtcccaagtatgctaatggtcttttgagtattgttgcgcggaaacagtatggctgtgatacaaggtcttccttaggaaacaagttccttaaggccagtagtaatgttcactcagccccagtcagtctaaagactggtgatgccatgggtaatattctcatccagacattttgatttccgaccatgctccagttatggattgatagcctgcatttatgctactgtccagcaagcatgtgctcagaatcaaggggggaagctggtgattttgcccgcatacgcaatacatgttttgaacaagtaagcactcttaaattgcatgttcatcttgcacaatgtattcatggcatcattttgtttacttgctttgagttttcttgtgttgactacctccatttattgatcactgtcctttgatctagtggaatgtttattttggatgattggaatattttctggcaggccacgcaagcttatatgatgggaaacaaagcgttagcaaaggaactgagcatgaagggacagttgtacaacctgcaaatgaaggcagctcatgagacagctagggaagctatttatcagcaaaggtggattaactccctgataaccaattgacatgaccttaacctttcataaataaaagtatttttcaacctgccaacttactgaccactaacaaaataccaggacctggactgcacattgtattcatcttttctcctcttgcatacaagtatcttttcgcactctaaaggcgcatctagttttttttagcttcccctgcttcgttgcaggaacccattttcatctgaacaaggccaggaccgtctgatcgacttgcatgggcttcaggtgagcgaagccatccaggttgtgaaggctgagcttgccctcctgatgggtgctacaaggtcagctggagaaggcacagatcatgatctgcattggaacaggacaccacaccaagggctctcgcgaggcaaggttgccggacgcccttgaacatttcctcctggatgaaggcctccatcacacgcagccatagcctggtctgctccatgttaacctgtgctaacatcgtcttctaggtaaacaatctgggagaagaaaaggaggttagggggaaaaaagaaggtgagccctaacctgacaatgtaaaatatatctatctatacctgtatgcacaatgcacgtatactaattagctactccaagggccagagaagaacggcacgaaacatcatgtatgttgtattgtttctcgttgtacatgtcgtatgtacatatcaggtataacttgtttttagttaattaacgtggagacttacggtagtcctctcaaccaatgtttatgttcttattggaattgccacatgtgttgcgcatgaatttggggtggaggtaaactcatgattttccctttttctctggttaaggtgattattttttgatgttgaaatggaggtattatatatagggattgagactaaactgaaattatctagctaagaagtttcttactgaggtttgtggtcatgtcaggaatctggaggggacggaagtttcccattagaatctctcatcatttttactgtcaaaatgtgcgtattagagcatgctcaatgtataatgtctacttaagcaataaggtgggacccggtattagttatggtgtttgctacaatatatatggcaagagaaggcattagcctgggtcctactagtttcactcaattatatggcatgtgagagagaagaggagagagagaagagaaagtattgttattttattcttatgacattatgggtagcttatcttaaagactactatatggattactttcacaatgtataatgaccactttagagatttaagaccctctcctattgctacattgtggctgcccggtagatgtcagacctaaaaaagaaagggacaatttacagaagttagttaaaccgagtgcagtctgcagtgagctgggccttacaaagtgaaagctggtcccaacgagaacgagtgggtttgcgatctcgattgaccagtgaaatttgagcccaacgagacgtcgactaattttgccacgcttcatcctctcatcttttcgcttatgcttatcagctaaaatttaaattttcaaccttaaatatttgattttaagatttctttttcatcatagtttgtttttcggcctttgcttttaaatcgttaagaacacgtatataaaagttttattcacaaattattttttatttgcaaatgtaacgttacgcttttgcttattatcaaccaaatgatgggtctgtcaatgaattttgacaaatcctaaacgaaatccacactcgagacgatgagaaatccgatcgaaatttatcgacattctgaaccctactactcacaagccgtatggccacacacagaggtattcctatttccgcatgctacgtttgcccagggttataattcaatgaaatccaaaaatgtggacttttcggatttggttaaaaacaaaaacctcttcattttttggatcaagttttatcggtttatcaatggatttcacgaaatccgatgttaccgttcttgagtggatttagatccgctatctgaggctgataagctaattggtgaaaatattttgacttttagtttattttttagttttacaattacagtttcttgtgaagatctacagagcttgtgagagctgaagggtgaaggctccagctccccaaacagccctctctctctctctctctctctctctctctctgactcttgactctctttcgctgtgcctgtgagcaacgctgttctcctccctccggcctccggcctccgctctccgcctcgcctcgccgcccgatccgcgcgtgccttctcctcctcccccttcgttgcgtgctcggcctccgcacccaccctccgcttcgatcagccgcagcccgactcccccctgcttccccgcctactccgcgccgcccgcctttggcgctcgccgccgcggtcgcccccttccgcggctcgtcgctgggttctcgtccagcacgcgggtgccggttgcttcttcttcttcctcctcatccggtcgccgcgtcaccaggttggtgtccccgcattgcctgctgcgccgcgcgcggtagatagattgggcactgtcgaatgggttgatttttttttcgaggatgagctgctgctattgcagtttctagatcgggaagctcttagaactcgattgctttttgctaattatgtcactagagcaggaattactttgacctaattcacccccctaaaccctaaacctttggtgtactttctaagttctaaggaactagggaagcgtagtgttagcggttgcatgtgctattattatctgagttagtaaagccagatttgtttgattttgcgatttattttttagtatgtgctcaacaccaccattgcagtatctgtagaaatattttttcatcattggctcatgtcctactatctgtaattgcagggttagtgcatggcagtgacaccgcatcatcggctatatgaatttgctaagactgcccttatcaagattttcgcattcccttatgccacggtctgttatctgctcccctctttcctgatcttcgattttgttccagatcagcatgttccagatcagcgtgaatcttagaatcagaaaactgatgcttctctttgttgattgtgaaatacaataggtctgtgacctgtattgtgatggtggggttgatacagacaagtggggcgatgcacaaattggtcactacatagggattggtaggataattcacactagcctaagcctctccatggttacattgtctagtctgtcttgttaatttgacgaacatactactttctacaatagatgcctctgcatcaggtgtcaatgatgctcgtgagctgtgggagagcagaaagaaacttttcacgtctgagttcatcgagttagatccttctgctgtacaacctccatccctcctttcatacttgcaactaaatacactaacattctagcatgagtagtttatagctgacacttttagtggtttatacaacaggatgactttgaagctcaaatgcaagaaaagggcatccaagcagatatagtttgttgtatgcagcatttgcaggcaagttgtctgttctctgttgctgtaatatggtgtttacttatgagctttgctaatcttcactgttaatctatattgaaagacagttatgtttcgagagtgaggaacatgctcaaaagcttctgaataatgtatcatctttactcaaacctggaggctattttgttggcataattcctgattcatctacaatatggtatgggcaactcatgagaattctgtttttttctgtctagcgttatagaccaaggtcttcaaggctgcatacaggcaatgggtgcctaatcttgtagcacataaatagcataagtagtcctttatgctgcataagtattacaaggggcataacacttaagttttttagaaccttgtttatgtcttaatttctttcttcttgcgattttttaaaaaaaataatatgattttaatggaaaatcgcaaaaatataggtcggttaggcgaaatcgcaagtttagcaccctgtcgaacaaccgtggtttgacaggggaacaaccgtggttcgacaggggaacctatcgaacaactgtagtagtttgacaggatagttggtccaagaaaaaaaaaataagtacttgctacagtatccggtaggaacatatcgaacatgcaaagttcgataggggacatatcgagcaggcaatgttcgataggggcgcggctacagtgctacagtgtttttttcttttttttaaaaaaatattttatcacatgtcgaactgtcccagttcgataggtaccctgtcgaactacggttgtttgataggtactctatcgaaccacagatgttcgacaggttgctaaacttgcgatttcgtctaattggcatatatttttgcgattttccattaaaattgtattatttccaaaaaaaaaatctcttcttgcattatagattatataagaaatagccaatggcataaattttgcagttgctaagatagaaggctagaattattaccaagaagaataagatcgatacctcaattgagttagccgtaactgttggatgtttctaacttatatgatatttctaaattgtaggacaaaatatcaaaagaatgtcgaggcttcacataataagggtctgaagactgttccaaatagcattcgctcagagaactatgtcatcacctttgaagttgaggaagaaaagtatgactcgagcttgtgtattttaaatatatataaaaattcaggtttgttatggtgagggatcatatgcaatatggtgcaggtttcctttctttggaaaaaagtaccaactcaaatttgcaaatgaatcaatgttcgagaatcactgcctggtccactttcccagctttatgaggtaatattttccttattagtcttccaacaattgttgtacagccttatttcgtaaggtatcacattgttagattatgttgaaacagattagcaagggaggcaggacttgaatatgtagagatccagaatttaaccgagttttacgatgataacaggtgccaatatcctattgcaagttctatattattgtctttgcatcattttgttgtttatttagagtaaccattcttcggtttttttatttgcgatgcttaggttaccctgtttaaagctgatagttacttttttgtgtgtgtgttctcaccgactccagaactcagtttgctccattgcttggtggttatggttccagtttggtggatccgcgtggaaagcttgtcgctcgttcgtttgatattttaggtgatgtagccttttcccttcaggattcactgaaggtcccagtttactcattgcctgatataatttctgcaggcttgtattcaacttttgttttccagaagcctgacccagatgcaatgccaccaattgtaacacccgaattgcatgatcctgagaatgatcaagaagaggtctgctctgcatttagcaggtgttgatatttactatcacattttactgatatttttttgttaactgtgagtgaaatatcaggaatggctctggacgcagcaggcatcaatggacgatggaagggtctcacgtactgatatacttcctcctgcggataatgagaaaggcatccttggtcctggacctgcagatatgaggctttaagttcactgaacaactggatataggctcactgctggagttggagcaacgatgctcctgcaaagctgcaattggtggtttatggatgcatacatatgcatgatgctcacgtagtttctaaatttatttaggctctacctgtaaaaagaaaacctttcagttattcttgagaagatagaattagcaccaatgtcatatgtcacggtagaagatattgatagagtagttcactaattttgtagtggatcctttaaatattactccctttgtcctataatatagcaacctaatactagatgagacattgaaatgttacaatgaatctagataacctcctgtccagattcggtgtatcatgaaatgtccaatccggtattagattattatattatgggatggagggagtacatcattacccgtttacgactgactcagtaccgactgtcttttcttttgcatgatgtggtaacaaaccatcgcgaatcacttccgtctcacacgtctacgctgcatttctttccccctcatgaactctcgtatccattccatatgcatgtgccgagagaaagggagaaaagaaaagataaaaagagcggtgtctagaacgcgacgacgaactcgatgcaaagcaaaagtttttttgttgggcatcactcgtgcctgccgcgatgcgcttccggacaggcgacatctgcctgcggttttgtgccgtgccgcgcgctttcgcgaccgggtgtggaccaggagggcacgcagacgcaggcaggatggaccgaatcgcgcgtgcaaagcgggggacgcggttgatcgagttggtgttggaaggttggtggtggtgttgccgctggccactgcagcactgctggatgattgttgatcgcccacggcggccggggacggaggcacacggaccgggaccggtggcccgctctcacctgcacggcaccacgactgccttccttccccgctcaggagagcaccaaacctcaaaaaataaaattttcacctgcttcaagagtagtaccaatatttgtttttatatactccctctgttccataaaaaccaacctagaactagatatgacatatcttattgcaacaaatctagacatactagaatatgtcatatccagttctagatttacttttttaaatgaaaaacagcacaggtgtaccttttcattgaatagagtaggagaaaatacaacccctaaaggtaaaccgcttgaaacactggccaagctagaaaaggtaaaactgaaattcatatttttatagagtttgtttgaattgttgataactggataacagtcctgatttggagtttggacgggcacaaacacaaatcgctactcaccgtctcaccgagttcacagttccgggaaactgttactccgagacccacttcgccgcgaagtaaccggacccttatcctatggatatagttggggcccccttccccggcccaccaccgcacgcaacgcatcggaccacttgacttcgcgcagcggcagcggcaaaccgcttcccggaaaagaaaaaataaaaaagaaaaaaaagagaagagccgcgtctccctcccaccgaaatccctcctcctcctcctcctcgtcccccattcgccgcagggctcggctccacacgaacgcgacgcggcggccgccaccgattccatccggaggaaggagccgcgccgcctccttcctatatccctcctcctctcccgtcctaaaccctagccgcgaccgcgagttcggggtcctaatccggatcgactccgcctccccgagtcgctcggacgcgttcttcttccgggtaatcttaatctcctactattccgcgtttgagcctttacgctctctttctttttcttgtgtgtgcgtgatttggcggtgattctcgaggtaattcgttgcttccgcacgttggttttctcggtcgatttattatcttgtggttttttttggggggttgatttggtgtaggggttcaatgatccattattactacttgtgctgtatgtagggctgggaaaattagggtttgttttcccgtttgtaacggctaattattatctcggtgaaaaatcgacggcctcgctgtaatattaaggctcgaaatctatctgtgtggtaccaggtttgactttgtgctgcccaagattgcatctccagcggaagaatcagagggattaaattaacgctgtctggctgcgccattaataaccttgggtggtggtggtggtggtggtggtggtggtgctccactggagtggaggctgtgagcaagctagtggagtgggggcgtttcttaggcaggtgctatggcgacagcaacaatggcaaccgcagctggcgcggctgcgcttctgtactacacgctgaaccgccggcttcaggtggagaagctgaatcaggaaggcgattgcggcaatgaaagagatgccgcgacgaggggggccctcagtaccaccagcaggagcagggtgtcaaggagggatgttcgtgcccctgccacatggctggagacaatttccactctgtcggagacactgcggttcacatactcagagacccttgggaagtggcccatcggtgacctcgcttttgggattagcttcctcctcaagaggcaggttggtaaccattcctttgttgctaataaacatgcatctttgtaatttgtactacttaataattgtaagctaatagggtctgcttccatgatttatcttgcaaatattgtagtgattataatatggtgcagtgtgcatttatattagctttgttagcataatggggctcttcaattttgttaaactaaaagtaaaataattttggaaacactttatcctagcctataaattgatttgacgatctgaacagctcgcagatcatttacctcatattattcaatctgtattattggctttttgtcttgaacatctgatataagtaaagggagaaggtgctccatacaaccctgcaaaattttacccctctccggaacaacaatttctggtagaagtacatgaaggatttttgtagtatggataaaaaaaaattatggtatcattgaaagaagccctttatgtatatatcatttcatgggaacatatcctgtacacaagccttctcgtgtaaacactgtgcccaccaactaacaaattttataaaaaaatctagaaaaaaatgtacaagtacttccaatagtattacacttatatgcaaagtcttaacctcaaatcaatatattttagccgtgacagaaaagataaaaactcttgacagttttgagagtataaatctgttagaaatttgtctctttttttttgctcactatatataatgaatttgaaaatgagactttacagatagatgtaatactactaaaagtacatatacatttttttttttgaatttttggtgacatgttttagtatatatgagaagacttgtgtgcataggatatgttccctcatttcactccattaaatttacccccattccttttgtatgttaccatccacaatgctgcccatcctaaatacatacaactgaaagcatattttttacagcataaaactaatctgtagtgcacaccggcacacacacacttcagcagagtttctgatccactggttgtgacatgtgttccaggggaatgtacc

SEQ ID NO: 42874 - DNA, 865 bp, Oryza sativa
gttcccgttgtttttggaggcgactggctactcttcggaggatgttcttatgcaagagcctaaagcaggagtgagtgaattttacctgtgtttctttaggggtatctcttctcttgctgattctgcattcctgtaatatttcacaaggaaaaaagtgcctactttgcattgatctggtgtttttcttgggatccttgcagattttgaagccagctttcaccattatacttgatagagacaagcaatgtatacttctattaattaggggaacccacagcatcagggacacactaacagcagccactggtgctgtggttccattccaccatactattgtacaggaaggtggtgttagcgatttagttttagggtacgcgcactttgggatggttgcagcagctagatggattgcaaagcttgcagccccttgtcttgctcaggcattgcatactcatccagattataaaataaaggtacagcgctttgcactgtttttgtgctctcctacccactgttgtaatagtgctgaacgtcgtatcagcacaaccatttagagacggatgcacttattctgtattgtgttcatggtaaatttgtatagattgttggacattcacttggtggtggtacagcagctctgttgacatatgtcctgagggaacagcaggagtttgcatctactacttgtgtctcctttgctccaggtatgtgtgctatgatgtttttctgagagttatcttgctgcacactgaacaatgaaaattgaaaatactgctttgtcacttttccttattccactggccatctcctttgttaacataaacctgcatctcatgcagtaaacattataggataacggactaga

SEQ ID NO: 42875 - DNA, 2576 bp, Oryza sativa
  unsure (1)..(2576): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggagatgggggaagggaagcttttgctgcggcggcgtctcacggcgtgcgtacgtcagcagtttgatgagagagagagtacggcgtcttttgctaatcacatgcttatgtgctttgggtttgggttagtcaatagataggggaattttgtcttggtaattttttttttcttctgttcttttttttgttgtctttgtcagggcatattggcaacttgtgttcttggaattttgtattttttaaaaaaatatatatatcgcgaatttgatatcgtggatcgtgcagattcgacggtcgagatctaactggatgagcagatatagcaggtcgaatttagatttggttgagatgaagttaagccaccaaaaacaaaagaaaaagtcattaccatgtgattgattagttgagttttaatattctaaatcaacttctatatgttacgtccgtcccataatataagcgattctggaggaatatattttctagtattacgaatctgaaccgtctcttagtctagattcgtagtattatgaagtgtcacatctctttatgattttagtaatgtgacgcggataacatgatgtagattttttaaggagaaacaatgtactatactccattcgaactggtaatacttatcattttgaagcagagtaaagtcaaaccttcaaatctttgactataaataatttataaaatatttatcttagaaatatgaaaactatatgtatatattagttttaaaaatgtacttcaataaaattatatatttgtgatatttctatatatattataatagaaaatagtggtcaaatatgtttcttagactatatttttaaaacgacaaatattatcaactcggagggagtagtaatatcaatattatttatcagtttcataaaagctaactgaaacaatgtagttgggctaatacaatagccagccacatgaatcatgccatccacccacctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaaacaaattaagcaacatgatatatatatatatatatatatatatatatatatatatatatatatatatatatatatatatatatatatatatatatatatatatatatatccaccattcacaaacacatatatataaaatataaacca

SEQ ID NO: 42876 - DNA, 8438 bp, Oryza sativa
cacggcgcaggcgatcttcttcatctccatcccgggcggcggcggcgaagtgctgggctctgcggggtgggggaggagacgggtgatgttgtcgatcgacggcttctcgggctgcaggcgcgcggtggtggcgttgagctgcgaggcgaggcgaggcgcgcgggggattttaatggcggggcgagcggccatgagcgaagctcggggtggagcttcgccaaaaatgggggtggtgattagtgggtttgccaagataggggtggtggtgattagtggaggtgattgctcgatgaagttctaatctaatggcgtttgccaaatttcaatcgaattttgctgtttaaaccctaaaattttcaaataccattcgaacccccccccccccccttctcaaaaatatgatttctagcctatctcgaaatcacagaaaatttcgcaaaaaccaaccagtttttatcaagattgttcatgcgaattttattcgagcttcccaaaccattcagttttatgaatagttccgtttgaaatttcatcagaatttagtgaaaatagtgctgtgcctcacaattcaaccccaaaacgagattgcaaacccgcctctcgtccctgttgatgatgcattcttgtttatatcgtttacaggcgtaaaaactcaagacagctactggattaacttatacagaaactagatcacaagttcacatccaggaaacatttaagattttgattatacacatatgcagtgatgctaaagatcggccccagtttcagcaaaagagcaggaagttcagattccagcctgaacttgcaccacaacagaagcagccaatctcacatagatactagggatcagaatatcagacaatctgatctgtcaaagataggcctggttaacaaactcgatgaaacagaattgcacaagccacaagggaggctgcaaggcgaatcatttgcggttcttggaacgctttttctcgagcctctgacgagcttgctcaaactcctcttccgtgggctccgagctgctgctcccctttgggtcacatttggacatgatggatgagagcaccgagtcgaaccggtccttccgctgcgccctgcgctgtgagatcgcgaggatcagatcgttctcctcgctcttcttcttgttcttcctgtgacgaggtttgaggcaaatgcagtagtgagcaactgatggtagacaacatctcggaaggcggattacttgggagataagagaatgagagcttacttcactcttctctctaatgggtttgtgggaggttcaatctcggagatcttcttggcccatttatcatatgcttttgttgacttcagctcacctacaaaagggaaggaaatggaaaggagtttaaccattagagaagtttcagggaatagattgagttagcatgataagctaaacactttgccagcgcttcattgtagaaaaggaatagaaaaaggtattcaatattatatgataaaattatatggcaacagcatataatcatttaccttcagcaattgcctcatcaattatatctttaaagcgatgggaatcaagctttggatctgagcaaatcattgaacaaaaaagcctgcatacaagggcaccaaattaaaatagaaatggaacccaattattcacttgcaattcattgccttctgtatagaaaattaatcaacactaaattttgtaagccacctgttcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgtctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatccccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatcttcagaatgaagaaaggaaacatcaaatgagttacttgtgttataaagaaagacaaaactgaagcataacaattgtttctgattgcatatgtactttaggttcctttctacagcttcgcttaaaaataaataatttaggccgattccactgagctagctgcacctgcaccacagacaactgctgcaggaagccagcaatgccctttgctaggggtcactgctagggaggtagcagcacaataagtctcattggttgcccatattctctaataagccatataaaaattaatttataggtaaaacttttatatatttgttcatagcaacttaaaatccaacactaaaagaaactacattgaaaatatcttaaaatcaagttcgaaaattcaaattttggcttttgctttggcttattaggccaaccgatggggctcttaagttgcaggcttgcagctagctcagcctataggagccactgtttctggttgcaatcttatgatttgtggcctttttaaagtcaattacatgaatttccatgaactctttcagctcttctttggcacttcattaagcttaggtttcagcaacatttccttcagtctagaatttttttaaaacgcgctaaacagtctagtagtgtgcgccaattaattacaatttttcagcacagatcaagacaaaaaaaaaatactgatgtctgaacagctgggacatatataaggtttattgaattaagttatgcaagtaaggtaatgctattgtacttgcttttaaaactaatagtggtatagcttgagatcaaccgccaatcacaacctcttgtacctcttggctcttgcacactttacccagtcattggtgttttctgattgatcagatgatatgagaaaccctttttatttgacaatataaatttttaacgagacaagctagcaaggattgaactatgtcctcaatgtatgtgcatagtagagagttagaggccctatcacacccagccacgtaactgtttgattgtttgacatttactccagattccagaacatgataaaaattagatttaaacatcagttgaccttcataaattctgtggcagtaatacttaagaggaacaggtatagctcaaaggcaagaatgccataccatcaaagagcaattggcaggaaggccagcaagatttaaagaagattaagtcactataaaatccttggagaggtactactactgcgaagcccaaaactagagctgaaagttaaggccaaaccaataagcactctcccatatcagtcataaggcttcacaagtgaaatgtgagccttcaagcaactgcctccatgtttgggatacaaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctctgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggttcgcgccgggatttggcgttggcggcgtctcgtcgaatgaaccacccgccatggggatggagggttcgatggaaaatgcttgtacaccggaggtgagagatcacttcacggtgcagttgtaaagagcgtgtggtttccattttaaaatctcgtgtttaatttttgacatgtttatcaattcattttacaaaaaaaagtttagaggggtatctctcccttcaaatctcgtttttatacaatggatgtgtagtagagaggagagatcagccacacgagcatacataattttgcaaaattcctttagcatgtgtgctgggtagaatcggtacaatttgggtagatagaatttgtctttaaaactagggctcgaataaatgtctaagtttatttagggcacatacatagttaaaagaaatatatgcgatgtggcataagattggctagagatctccaacaccatcatatatgttacaagaaagcttggtacggttcgaccgggtagtatatcaaatgttacatactaaaccgagttttgtcctaaagaaaatgataattataacggatgagtaatgagttagagctcctccacagtagacgaagatgggaaataacatgaggaatttggttaagacagtactccctccatcccataatataagggattttgatattttgtgtgcactgttcaaccactcgtcttatttaaaaaaaattgtgcaaatataaaaacgaaaagttatacttaaaatactttggataataaagtaagtcacaaataaaataaataataattctaaatttttttaaataagacgaatggtcaaacagtacaggcaaaaagttaaaatccttatattagggacggagggagtacaatgttgtaggaatcttctttttctctacgtattaaagcttgttagttaggttttatcaacaactcaaacaataccttataaatagtttacttatgaaatttagacctaagagatcaatatcatctgctcaattgagatcccctgcagagcatgtgcggtacttcaggctgacatgtgggcccgagggctgtgggcccacatgtcagcctgcagtactgcagacgacttgtgtccatcatctgctctatactctatgctatttaaacaaaatatgtagagctaggtaacaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatcttacaagcgttggttaagaaaaagacaaggagaaagtacatatgctgacatgtgagtctctttccatgtgtcagtggctcaattacacaacagttaagtcagatgatcccttttcattggagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagccttccccacccacgccggcgtcgtccccttccccgtccccgtccccagcttagctggcgtcgtccccgtccacagccacgccatcgagccgtgctgtgtatatgcaacggagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattctggcgaaaccccatcctgacgatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtt

SEQ ID NO: 42877 - DNA, 2823 bp, Oryza sativa
tcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctcacacttcttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataattgcacaacattgcactgaactcagtaaaaattatcctacaatttcagaagaaacaaaacgtttcctctttggctgcatattctaaattacagtatagtaaggacaaccattattctgaattcttgattctttctactaatgagtaacctctttcaaggttcaagccccaaggttgaagtaaaccgtgt

SEQ ID NO: 42878 - DNA, 24926 bp, Oryza sativa
atctagcccaggtacaatgttgaagagggaatctgaactcttttgcgcggattgggtaaggttgttggtgatcaccgttcctgggaggtcaaatggttctatctgcacagaggtccccttcaaggttgcaccctgggtgtcaagctgccctgctgagtcctgagggtgtactctgaatgttgcgtggatggcggtatcagtgccatcgaccgtcggccgttcttgcattgtgagagagccattcgcgctcgagaggacgaaggtcttcccactggattcttgtgtgaaggtcaccagctgtgagttgtaggatgaagggactggagatatccagtctgaaattgcgctggtgttgccggcttctgcattccaatcaccagttgacaggccagctagaacaaatggcccgaataggattgcttgaagagatgcatattctggccgatcatctgatgtcacagcatagcagttaacattgagatgaatattctgactaaaataaatcacaatagttggtgtatgtcacatcgtcacagtttcatattcactattagcttatgattttttatgttaattgataattttcggttgaaatgtcaaacaattgtatgtgaactaagcaaaacacattgatgcatacttgaaaatagaagaaatttcctaaaagttgagttttgaccttttattgcttcagtccttagtgtaatagggaactgtagtgataaatgatcatctgaacacattgatgcatacttgaaaacagaagaaatttcctaaaagttgagttttgaccttttattgcttcagtccttagtgtaatagggaactgtagtgataaatgatcatctgagttccactgtttggagattgaaaggaaagaccctgcccacaaaacaataaagtaagaacttgtctaaaacatgatcaaggacgattgaaatggatatatttttttgttcatgcactcaaaagattgtacctggagacattaatcctaaatcgttgtcatttagagttgcttttgcgccattggcagatgtccatgatggtattctcacattcaatgtggcagactgaccatttgtctgcataagtagaatagaggaagctaactgctgcttctttcatctgattttcatgtaacatacattaaaagaaattacctttgcagaagtggagagtgaaacttgaagaaacatgtccaaagagctgattggctttagttgttgattaacagtaagcccagctgctttccagttataagcacttggtatgtactgaatgatgtttagcaccggtctatctcctttctcctcgaagtaaatggaatcgccaagtttcgaaaaggattctatccctgtaaatgaaatagaagatccataaagaaacaggccacctgataaattgcctttcaattcaaattttcacaacttcgaatgaaaacacaagcaaagtaatactaaaatcacggtattaatttgacaaactgttaccgcaatattttcatgtaaaagcagcagtgttaaataagcagaactcagaagcattttatttacctgtcccataacaacaccagaaggagtcatactttgttccccaaccatgataggaaaccgctttagaccgtccaggggcctgaggtagcatgtaaatcatcaccccgggatcagtccctctttggatgcttaaaacaccatttatcagtgccctttcataatagtctgcatatgataattcctttgtccatctgaataggttgcgagaaacctgcagtagattgcattgaacccattgagagagagagagagagagagattgaatgttcaggagagtggtttgatattgtgaaccttgagcatgttgtaggttgtgcaagattcctcattctcagtactcagagtatcagctaaacgctttggattggtcctgaataattatatagaagtagatagtcatacatcaaagagaaatatactattgactatgaattcagaatctagagtaaaattaccaaaattcaccagcagatgtgcccccagtagcatagctatgagaagaattgatggtatccatgaaaaacgttgcaatttgctgtttcatgagaattatgattacaatcagcttttctctcaaatgatgttagtgaaaagaattagaaagaaaaacagatagtataactccagtaaaaaacagcataaaaaaactccagtaaaaaaccaacacatggctttgacatacagctgacaaaaaaagggactgcatatggataactacagagctaataggtaatgaaaggtataatactgcccaaaaactatagtttacctagagaaagcatgggttagcaagaaatatactattttccccggattatgctatcacacttccaggcccatatctggaaatttaccaatatcagcaggaaatatgcataatctgtaagcagaataaagctatccttttcctttcagccaagcagccaatatgaccactaaaaaaaagtaaccaatatgataatctaaactattagcattgtacattcatatccatatccctggacagataattcatcttcatgtatgcatatggagtaaatatccagaaagaaaggtttgtgttcttttaccttgtaaagaagatcaccagtaacttcatatctcatctgtgcaccaataacaactggaatgtgtgtattggaatggaagcctgaaatactgtcggcctgaattgaagcacactcaagatttatcagtcagagacattactgcaataggaatactactattcttgtatcctctggaatcagacacccaagccaaaagttctaaacttcattttaggtagtgtctttgctatagtgggaaaaatataatgacaaaatgaacagtagaattgaaataatagatccatttggcacgcaaacatgtagttatattgattttcaaactgccaagtgccaactcaaaactggatattaggtaatccataatttttgacagttagtaaaacaggtaaattgctatatgacaaacaaggttgaagttgaatgtaagttggtctgagtcattcaccataaattgacacatgttcatagatgatacagaatataagaacaaaagcaggtaagaaaataaatcagcagacctgaactgcaagcaacccaagaaaacatggcttatcaaaaagatgggccagagtcagatgcttctgatcattctgcacatgcaagaaaactagaaaagttagcaactccactagagaaaattgcattaatcaaggcagtattcctatctcataacaaaccgacaatcaccgttatcgtgtagagctgatagagcacatcattcatcccaccactctcctcattgagtgaagcccaatgcctctcaatactgtatttctgtatgacattcttcacacggtcactgaagtaattggccatcccgaccaccaaatcaagggccttagaattcccggccaccgtatactgatcaagaagaccttgcataatctgcaaaccaagaattgcactcatgtagcaagacaatgatataatatagtgatcaagcaacactaggaactgaaattcccccatataccttgtgaattgtatagtaaggagcccaaacagccttgatggactcaaccctgtcgaagaactccgaggggaaggccgacaagtaccccgatcccatcttcttctggcaatcatggagcgcgtcgacgaccgatgacatcttcgccaggagagtgtcattgtgtgtgctcgcccacatcttggcagtagcactcaggtagtgtcctgcaaagaacaggcagcaaagcaaagccaccgcaaattcagaccaattgcgcgatttcgctgtgcaagtgatgccgagaaatggcggtggcgcaccgacgaagtgtccccggagctcgacgccggggccctcccacccgccgtagggcgccccggacgccggaaggccggcctgcgtgcggaagctccacacgaggcggtcgacgtcgaggaggagcaggtactccaggttggtctgctgggcctgccagtacacggtgcccggctgcagccgcacgtcgtgcagcgacgcctccgccaggagcgcgccgccgctcgcggcgatggcgccggcgccggagccggagccccggaggttgcggtagagcatgagccagtcgaacgcgtcgcgccgcggggaagagacggggctcgcgaggagcctccgcggcatgagagacatccaggtggactcgtcggtgggggtgaggtggcggtcgccgtcgtggtcgtcgccgtggccgtggccgtgggggaggaggagatcgagcacccgcgccgcctcgacctcgccgtccggccgctgctccgccgccgcggccgcgcgctccgtgtgcgacgccgtcagccccgggaacccgttcgtgcagtccttccccgcgacgccatcgacggcggcggccaagaacaccaccaccaccaccacgaccccaaccgccgccgccgccattcccgccaagaaccactccctcctcactaatcaagactcaagaacaccaccacactaccagacgcatcaaatcaatggaatcctccaagaattccacctccatttatgcccccaatgattgggcgatctcaaccaagaattgcacggaaagcaagccgcaacaactgaatttcaagaacacgaagccctccttatcccctcggacagatcactccctccgagtccgatgactagtcaccactaaccactgagccagtgattcttggggagaagaggagtagaaatcggcgcccttttcgtgggcggataagcggaaagggggcaagaaatacgcatcaatcatcgggtaggatgagagcgacggcttgtgggatttcttgcacccaaagagcagcaacgacaaggagcgacatgaaagccaagccaccattgatgcatccatccatccattcgagatccaacaaatccatttccggccatccccgtgacactagcagtgagcgccgcttgcttgcacgccggagctaccgctcgtcgtcggattacgacgccggcattgtccctgtcaaaatcgcagcaacggaagctggccgcggcgaggggcgtgtgcacttcacacaggcatttttctccaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggttgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcacaaataatcccaaatcatgcaaaagccaccgaaaaccttagtttaaggtaatcttttatcatgtatccaagctaatatacataattgctaccagaatgaatattttccatttaatgaaattctcagttttgacttttttaaatccctagtgaaggatcaattatggcttagatatagtgaaattggcgaatttaaaactttaactacttgctaaacaaatgtactctaccatggatataaataaatatataaatatactttttataaaatatgttattcatcatttgctattggaaatattcaacttttgattttatacgtggttgtatgttagaattcaattattttaaatattaaaaagttctaaggatgctttataaaatctactgttagagtaggtggggcagtaaatttactgacactaccattagtttttttaagaaatatatagaaatgaggttcacatccgctactgtaatgacactacaattacatagaaatgtgataagcggaagcaagtctcatgtttggaccaatatagtactttgtaaaaaaacggattcgtcacaagtgagcctacaataacacaagcagcaactagtaataagaagctaaccacaaaattgtagagagaaggggacagggagaaggctagcagccaataagaagcttggcagtggcgagaggcggggagaagggtgcatgtgtcgaggacgatgcgaccacaatgtggtgcaagtggagttgacctcgaagacgatgcggcggaaccgcacgtgcgcctctacggacgagaggcggagctcggggacacctgaacacatcggcttttgagcagctcgacagggggtgactatgagcttgggggataggagcttggacagcgtgatgaggtagaagcctcatcactcacgcgtgcaggtgaagacgacattgcagttgtggttgggacccgcgccgcaccccccctgcgtgcgcaagtccatgatgtgagcgctcccggccgtcgagcttttcctcgccgaccgacacccttctccccacccattggcggatgcccaggaggtttgggttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccggtgagcatccttccctacccacacctcatcagctattctgcgttaagcgttatccctggttcaaccgaaacagggttagatctgcctctgctcagttccacctactttcaacttgttaattttgatttttgtttttagcggatgtaatttggttactgaatatcatccacaaacccttagaatagttgcattagaaagaaaaatgtaagctcatataatttgtacttatccaaactcagtaactcacataaaaatttcttaagaagagtagtcacacacaatatctttttatcaaggtatattcttataagaagttttcaacaagatttgcttgaaaatttgagtctaatttagcaggcagaactaagagagcatggtggcgatggcgcggtggccgtggagggtgctgctgccgctgcttctccttcactcctcccccgtcttcttcgtcttcgctcaaggtactgcgacccccgtcttctctctcttgtggggcggcgcttcctcttcgccccaccacccccaaatggcaaatattggaagtgaatcatccatcatacagataagatgaacgcgagactcgtcatctcattcgaccacctcagtgctctgcatccatctgcgataccattggatcgtttctaacacaagatatttggatctagagccagccttggatcctattaactgctccatcatgggttcatctcatgaaatttaacggaaccactccatcctaaattttctattcagcatattaatttcatggatcagcaatgtcctaagtttcttttcattccaatcagcactacgtctacacaaaatggatgtttcctttatgcttcctggtagactaagtatcctttttcccctcattttttcagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtaaaaaaaagttgtatccgttactttagattataatccattcatgtttgattcacatctgttcctcagttcaaagttactgaccagaaaaataattacttgccaccgccagatagctaaactcccattttctcttgtcctaaaaatgtctaaactttattattaaaaaaacatccatatctgaaagactccattaaagaaccgttaagcatatgtgcctacttataacattgtcagttttacacgtatgtgtcacctttccgtatcccttactcgtttcaatgtgttttttctgaagtctaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggtatatttcagaggatagtaggaaccatggacagataaatatttcatctaattttgtctcagtaagctgcagtactaaaaatggatttttcaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggtaaagcgtgtctggtattttaggtttggacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttgtgaagaagactaagagtgtgagtatgatttctttgtatcaacaaattaggggcttactgcatcatagtaataggatcaaatggtgtgcatgcaggctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacaggtgacattacttgcttggcatgcacagaaatacacatttttctaatttagagtggaaaccaaagttcttattattcaatgttgaaacttccgtgaaaaaaagaagggaatttcagtctgattgccctgcaattaatgttgaatcttggactccttccgcactctgatgccacattattgagcaagctgcgagcatgcagacatgcagtcgcattagcctgtccttctaattctgtattttaaaccacaagacttgggaaatctgcaactgctattcagaaaccacaaaaaatgtaattcagtatgcacaaataatgtgttttgactttatgagtgaataagtgatgcaaaaaaaaatagtaatgtatatttgtttggtaaactaagttatgcaccagacaatgcaattgaattagttgttatagccagatctcgctagtctcttacttcatctgcttgttgtatgttaccttctactggttgcagagaggtgaagctaagcttcttacagaagactgggaaggagcggttcaggatctaaaagaggctgcccagaaatctccccaggcaagttttatgtggacctatctcctttttcccctaccctcctaggcaaatgttagggataagtgtgctcatatatcagcatatcttctttttttgtcctttgaaaacacacatattgctatttgagttcccatcaaataatctgcttatgtggctacgcagtgtgctgatctcatttccttttagatttgggaacacaatatttttagtgtaattgtgctgcaatcaaattatcgtgaaacatagttccaaatggatgaaacatctagttttagtcaattggatagacaatatgcagaaacaattatttgttttttacggtagtcatctgatgatacttttacttccccatgatgtatttctatttggtgcccttctgccagcaatctttgttatccgctttttgcagcgtgggttcgtaggttgcatatgtttctctagcacctatgcatgcagtggatgagttgataaaactagatttgcacattactattgttagtactactaataataaagtgggccaccgaagaggaactttatgccaatgtatttatgaataagcaacaggatctcaggattttaaactagtggaaaaggtgagggcggtcagaatttcgaacatgggtgagccccgcttgacggctgccccttacagcacagttctcaaataatattgatagttacataaattgcttctcagctatattacaaataggaagttaacttgttgcttccctgtttctttaacctcaggaattgaatccaaaggtcatgtgcttttaatggaatgctttattagatttatctatcaaacagacttggtctctgccctttttctgtatttttttggtacaaatgtaacagtggtttgcactgttcatgctcaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggtataaataaacaaaattgaactgtactaagtatttaatgttctatgagatgacattttctattaatatggttaatttaaaatactctcatgcattccaagtttctagccctggtgttgtactatgaataagaactagctgaagtgcatttcatccacaaaatatatcatgctagacactgcatgtgtccgagacaaaaagtgtcccaataacataaattctggtcacccatatttagctataggcatgcttgtttcgaatcagatcgacatgctgcagatgccacgcgtgtcttttaacaatgcgcaatcggcaatttgcaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtggagctagctgtttcactttcactagccaaggatttgcgccgaaaccataaaaaccgaaggtccattccatgtattgtgatcggagtcggcacgtaacagaaaaactaaccaaaaaaaataacttaaatcctctgaagaaacatttgaaccactcgctggatcgtctagccatcagtcaaccatgagcgtgatgtccaacaatctccatgttaactgtaacatctgactatctatatatctacatgttgtactgtaacatgtgactatctatctacaccgatcaatctgatgatcgcttactttctctattttatattgtactagcaaaatacccgtgcttcgctacggtgtattaaaactaaaaatatttgattttaaccgaagttattttcacactgctttggtacttttgctcgctagaaaaagtctcaaatgatagaaagaaatatagttccgaggaaagggagataaaaaaacaaagccggtttgatttccacctttatacggtgcgagtcaacatggactctgaagatatgggtagatctacggggtggctcagcagcacggtcgaccagcgaataagcgagcaaactcagaccaatcgacggccgatcgatgaccgtagcacggtaggtagcagccgcatctggccgtccgcttcccttccgcgacaacaatgaccgtgactctacgctattattatttcaatatttcttatttttaattctagccttcgtcaaatttctacttcacaaaattaaacttcttttcttcggctgagggacctagaacagactttttcccagcctagctggtacttttcttcggccgagggacctagaatagactttttcccggcctgccggtcagcccacggcatattatgcgcacgtgcgggcactccctcctccccaagccgcaacctggacctgggctggggaagctgcccagcacgcgcctctacttgggccggtttcgatccagccagtgccggccgttcgatcttagggtttctatcgaatagccggccgccgacgtcggagggacaaaagcccatccctcccagccgtcggcgaaaacccaagcctctcgccagaactggagcggacggcgaaaagcagcggcgccggtgcatgcctcctcgccggtgcgcacactcgcccaagggtgagggcgccacctttgagcagccctgccccggcgccgtccccgtcgtctctctctcatcttccgcgcggcgtcatcgacggccggaggcggtggacttcccttgcgcgtcggcaacgaccggcggcgggtgggctacccgcgcacgtgggtgacgaccggcggtggcgaaggacttcccgcgtggcgtcggcgacggctggcgttgaggttttccgttcgtcattttttaatttttggagcttttcttcagggatccaagaccccctttttcctacagacaaaaaatcaccggatggatgaaacagattgtgatgaaaggaaaattatgaatattttaattagttaagataagattacagccggtgtttttttttgtttttttccagatttttttttgtgtcgtacgaatcggactttttgagcctgtttttttttccgccgttctcttctttttacggtgcgttttctttttttttttctgcctggtttttttcgctctttataaattacggacgatggaaacattttagattttttaagtagtataagtagaagtagattagcaaatatacccatgcgttgcaacgggttaactaaaatttaaagatttgcattggttttaggagtttgaggggacaaataaagggagctaaagcgaacttattccgtgtggagcgtacacgcggcctatgtggtggcccaatagtgtggtcggcctgggaacaatttggggacaacttgagggatctaaagtgaaattttttcacgcggagcgtacatgcggcccaatagtgtgggcggcctgggagtggcacccgacccgacgtgggagaagcagtagccgtccgatctgatggacggtcctgattgatcccaatctatataaaaactcataagtctaaaccctaatcctaaaatcatttccattctccccctctctctcagccgctactcccctcccctcccgtcccccaccagcgccgccgctccctctccccctcaccggtggcgccgctccatctccccctcttcctcctgtctcgccggcgcggcgacagggaaggcaccctgccggttcccctcggccactccatcccccttcctccacaacgacggggagaggatccaccgctcctgccggttcccctcggtcactctctcccccttcctccacggcgatgggaaggggatccaccgctcctatcggttcctctcggtcaccccctctcccttcctccacgacgacggggatcagcgacggggaggggaaccaccgcctcggccactccctccccccttcctccacctgctccactggcggcgctctccctactggcgtggagccagcggccctccgccccttctcgcctccctctcgcgccagatccagcggtggcggcgtcggtggctccctccgccccctctcgcctccctcccacggcagatctagcggcggtggcaatctgctcgaccacatcgccgtcgtggcactcatcagcacctccgcggtggccatgtccgaggcgcgcctcacgtccacgctcaactcgctggcatcggtggttggcatcgccatcatcgccttcgtgctggccgcggggttttccacttcgacaccagcaacctcgcgtcgcccttcttcccctcggtgctgcgggcgtgttctgtgcggcctaatccgtactcccgtcgccgtcaaggtcgccgaggggaggggaggggaggttgccattgttgtccatgaggtcgaggtcaccgttgtcgccgaggagaaatataggaaaaagtgaagaaagtgctacgaaatagaagaattcgcagtcacgatggtatattgtagaaggcgtgcggattaggtggtaaaacatataaggcatgcgtattggatggtatattatctaaattctccattatatatatatatatatatatatatatatatatatatatatatagtggaatgacaaatggccctacacatatttattttaattctaatgccacataagcgccacatcacagccacgtggaacaaagaccgggtcaatatagccatgtaggcgccacgtcagcggaactgtcttccaaaaccaccgaagaagtcaaattgcactagtttcaacagttgagggtcgagatatccggtattatggtttggggatacgaattagattcagcctccagttaaggaagccaaagtgaacttattccttgggaaaatgaaaaaaaaaagaactcagcccaagttggtttgcagcccggcccaaagcaaaaccaaaccagaccttcctcctttccgtgggccgcaggtgggccccaccttatcccctcgcgcctcgtgcctcgtgccccgctccgctctactcactgaagagcgggccccacctgccccgcctcagagcagcatccggatccggatctggaaacccgcttcccaaatccggcgcccgtacgcccgcccgccactaccgccgcggtgcccaccgcttcgcttctctcccctcctctccaatggcggaacccccaatcacagcccactcctcctcctcctcccgccgcgtccccaccgcaggcgactcccccaccctctgaccccacctcccgcctccccgccgccccgcgaccgccgcggatcgatcgaggggattcttgccacctgggatctctcctcccctcccctcccccgattcttggtctcgcgcgtctgtctgcccccccgtggtggattcttgtctggctcccggcaaaaggaacggcgtctcgccgcgggccgcggattcgaccaggtgcggtgctggaaccggcgccccgtgtgtcccagatgttaattctttttgtttttattgttctatatacagtggttgatttctgaaccgatccgttgttcgcttggttgggggaggacagagagtttgtttgcggagatagttttcgaattgcgtggtgaaatataaaatttagactagtttggcttatcttggcacctccgcacctgcattgcgccgttgagatgtaacgttgttgatgagctcaattggtcgggttgtttttttttccccagatctggatggttaggttcttcacctggctaacaagaaagatgttgcttttagctgccctggaattgttggtactttctgcgggtgcatctatctgatgaaattgagctgcattgttctggggagtgtttgcttctgctcattgcctcatagggcacacaatgacaccaaggagttatagaattaccgtctcctggaaatccttagtttaccatcctgttatgattttgctcaaatttagccatcttatcattggttatgcgtcgtggaattccaagttgtactgtcctattttacttttgtcaaatgtagttatccatcatatgttatgcacaacatatgctcaaagaagcatttttactggctaggttagcttaacacatgctgatcagtatttttcctttacagttcaatgcacctcaaccctcaacttgttgactagcttctgtgctaaactttgtgttgcaggcatctcagtgtccacggctgtaatttataaccaagcctaagaaacttacattattctagcattcattggatatggtatcggtgaatcttgggctagtacattatgtactggaccacatatatggtaccgtccttcatcgcaccaaattaggaacgccatttttctcgaaaggatggggaggcaccaaacttgatttgttagagaagatggtgaaacagttattccctgaagcacgttgccagaactggccaccaactgccgtgcaacccatgtggaaaacggtttgggagacaaagagttcttgtctgcgagagggtgttttcaggactacatgcgatccacggctaattgaagcattgcctcctgagagtcacaatgcaagagttgcttttcttacacctaagtcagtttcacctgagaagatggcctgtgtgattcatctggcaggtacaacagtttaatcctatttatttgttctatactttgatgtaccatgcatctacatgtttttttctatataagagactattttcaagcctttagatattgatgtttgtacactagctgaatgttgtttatttcatcccatcggacagaaataaaagttgactagatttgatgtttcaactttccatattgagtgatctgctttctggttctaaatattatatttcatatcatgccatgttattaactgatgagttgcaaaaatgttctttgtccagctgttgaaatttgatctgggcttctaatacaatgggtcaagttaaacttttatctaatattacaggcactggtgatcactcgtttgagagaagacttcgacttggtggacctcttttgaaggacaacattgcaactatggttcttgagaggtgaggcttgtatagaatgccagaatggttgtcttacgccacctttgataccaaagcttttttcctaacccgcaagatctgatttctcaaatgaattccagcccttattatggacaacggcgaccaagcatgcagcatgggtcaaagcttcagtgtgtgagtgacttgctactattaggaaaagctactattgatgaagctcgcagccttctgtactggttgcagaatgaggctggttatggcaagatgggcatatgcgggctcagcatgggtatgtaattctaaagttttcatctataattgaataatgtgaatgctttaagtcttaagcaacctgcagcatcccatttatcaaactcacccccattttcgtggcaacttcgtttcaagattcctttacaagtattgatgtgatacatttttccctaagactggtaactgagatgatttttctcaaggaaatatcttttatttcacctcaagtactttggccccttctattaatttctctcttgcggaagcgctcctttttctatttatttggattgcttattgacacggaaaaaaatgctatatgatagataatgaggttaactctggcatggctttttttgggaaaaaactttatcttgacagtagttaagtaccatctacatatgaaaattgctgttatttcttacaagcgtctcatgctaattacataggtggtgtacatgctgcaatggttggatccttgcacccaacaccaattgctacgctgccatttcttgctccgcattctgctgtggtgcctttctgtgacgggctctacaggcatgccacagcttgggatgcattgaggaaagatgcagcaacattggcccaagacgtaacttctttgacagaagacatggcccagaaatcaggaatcactattgagcaagtaagagagaggttgcgatcagtgctgtctttgactgacgtcactcgatttccagtgccaaagaacccacaggctgtcatttttgttggtgcaacggttagtgtcaatgttctatcatcatttctcaaacatgatttacccttcctgtgtcttatatatttcagcctagcacgtaaatttcttgataagagtaactcattatcaccttccagtactagtgcattctggtttcctactattactcatatcttatttttgcattcattcaaaatagatttattgcctgcgtcatttgcagcaacacatcatcttagttgctcctttccaataattacccacgcctctctgtagtactgttgtcatctgcttaattctgtactttcagatatcaatatgcttttttcgttatcatataatatttaatggagcttggtctgaagcaaatgttctctttattttcaggatgacggctacatccccaaacattcgataatggagctccaaaaggcatggccaggttcagaggtccggtgggtaaccggagggcacgtatcgtcgtttttcctccacaacgacgcgtttcgcaaggccattgttgatgctcttgatagactataacagcagaggaaactcatctttgtgatggcatttcttggtgtgcttgttgtgaaactcataggcatgccacatgacaagatcacatttttatgagtgggggagcctagaaataccacattctgtctgtaactcaatatatgtgttttcccaaagattgggaagatgcatgagtgtaacattgacattcgttacctgttaactaagccccccattgttaatctgtcccaaatttcacctactactaaccttgcaactgaagtaatttgcagttgagacaagaaaggaagaagatgacagtgcggcatacctaaactctctagtctctattctgtgtctgaagtctgaactctgaagcaaagtcagtcaaaccatatgccacaagacaaaaacattacagtgtcatcatcaatctcagcacttattttcatactgactagtaattatcatcagcagctactagtatacagcttagtttctgtttcttatacattatatgcacaattacagcatgctgctaccctcctaatttaaaaatgaaatcatctgatcttgtcaaagaagcaaattaaggcctgatcgattgatcatctctctatgcactgtagtattctgaaacttttgaaactaatctgttcctgtctgtctgtctgtatgtaaaactgcagtggtgtagcagtgtagatgctgggccattggatctccagggccagtggatggatgtggtctaatttctagggttgatggatggcggaggcggaggaggggcgggttggtcggggtggcgcgggcgcgagagccagagggaggtgagggcgcggaggcggtgggagtggtcggcgatggcgaggaagcaccgcgccgactgcctcgccgtcagtatctgcggcagcttgtacagcgtctgcagcctcagcgcgtccgcctggatcatacgcatgtacgtcatcagttcatcagtcagtagagtactcgtgcattatatttaaagttgtataagagcctcgtcggttggcctaataataaatccaagcaaaagcagaagctaaaatttaaatttttaaacttgattttaagatattttcactgtgatttcattttagtgcttttaaatcgctgcgaacaaatatataaaagtttgggtgaatacccaatatgatccttgaactttcgcttaaggatcaatttagtccctgtcatttcgtattgtccaaacaagtaccttaagttcattgtgtgattcaatatagtcctttaaccctctaaatatgccatgtgtacatgtcacatcatctatgcatgcaaattcaatatttaaatgtcctttacacccttatgttttcataggaaataaaggaaaactattgagaaaacacacaaaaaaaaagcttttgaccattggcaaaaatatgtagcattgatagataaaaaaaattaacatttttctttgttttatgattgcttcttcttgtttttcttttctttatttgatagaaaattgaaggttaaaatggacatttaaatgttatcttacatgcacgaatgacgtggcatgtccacgtggtgttttaagtggctctaaggactatattaagccgcatgataatttttagggtcttggttggacattataaaacatgaaggactaattcgactcatgaacaaaaattgaaggactgaactggctattcaccctaaaagttttaactataaattattttttattccctaataagccgttttggtttattagagagtatgagcaaccaatgaggttctaacaagtattttattttgttaggacaaaagtttgagcaacaatcatcctattagtgtgaatttttataacacaaaatgaatgttattagatccatattaaaagagtcactcgccattatgtttctttatcatacaaatagtatatatatacggagttattcaagtaattactatttccatcctaaaataaaatataaatattggatagaacacatcttaataatacaaatttgaacaaatgtttgactagtttcgtagtgatagaatatgcccttttcagttctagtttgttatattttaagacggtggtcgttgtattagttaaacttgtgtggtaacgaaactaaatgccttttgcaagtttagttaattagagatctagctgttaataagaaaaagattatccaatttcaggttttatttcaatcactgtaattaattaattattaaccaattgcctggctctagctagctaggtgctagctaagtatgggctcttgttgaagggaacagaacaaattaaaatgcccagctagccaataccattgatcattagtggatagggtttcttagttataggattaaaaggagacagtacaacagctatagctagctggctagataatcaattagcctaagcagccacacagttttgtacaatccaccacttaatccagagccaactaaccaacctaatgcagccatcaactgaattaaaaacaaaaatcaactacaattagcaagccgatcgaatcacgtgtggtaactacttagctccctccctttcaaaatatatggcactgttgatttttcgttcaaattcgtcttattaaaaaattagtataaatatataaaagtataagtaaagattatattttatttgaaataaaacaagtcataatattttttttgaatatgactaattgtcaaacgatgtaaaaaagttaacggcgttatacatttttgaatggatggagtaattaacaacgtacctgcctgacgaaggcttcgagggaggagagattggagatggcaagggagaggtgagccatggcgacgtcggagtatgcggtggcaccggtgccgggagggaagagcaggagtgagtccgaggagacggcatcggagagggcgtggtgggtggcgtggaggtcgcggtcaagtgcctcctccctctccctcgccgactgctgcacaccgtacacacccgccgcctgttgctccgtcaatggctccgcgtgccgcgccatcatctagtagcaacataatcattttatttcaattagttttcgacaataataatgaagaatatttatagttatgtaatcatattatatataggttcgcaagataatcaaatataactattcgagttcatgtagtatcacttaataatattatattagtatgatagagtcgtggatgcatgactatgactatgagtattaatactcacaaatattgctatgagtgtattaattagtatagagatcagaagttatacttactttatataaaaataatatcatatcggtaatgggacgacacgtaaaaataatatcttagaaataccatattgatgatggaacacgcaaagaaaattagagtacctaattaacaagggtatatctaattactaactagttagctactttttatgagatatatatgatagtactactataatataatgtagctagctagctttttatgagatttgcaagtattagatagtagctaggactctgtccatctagaagaattagcttgctaaagtatgtatacacatcctctctacatgcattattggtaaattagccatccccatctacatcgttgatcactcttatctaacttgcctccttcaccaactctccgttgtacattactgcacactactttcttccaacacagaaaataacaaccacatattagtagccatcaaagacttccaagagcctaactgttccatcaactgggacctctcacctacttaaatcaatattttaagatagatagctagctaacccatcatacatctttctttctagttggagtacctaatatatgtgtctggactctggtgtactatggaatactgtctaacaagcttctttccaattactttttttattttttgcaattatgcatgaatggaaatctatgtatgtatagggctactacacacactactaaaacttaaatatatactccatatatatatatatatatatatatatatatatatatatatatatatacttatacatttagagcactaacagatccataaatattgcacgtatatatagggtatttcaggtattttattaaatatatgtaaagctattaattgtactccctccggttttaaattaattgaagttttggacaggatctcacatacttagaaatggttagttagggtgcatattcatgttttatccatattaaatacattaggatggcacatctaacaagcacatcctcttaacctagtggctggctgctagtcccaaagcatctttttactgtcttgtgccggagttgatgcatgcatgcagccatacatgggtaaatcagtttaaattaatcacatggaagctaaaacgccaagttttatcatccaaaaggtctaagctccaaacgtcaactaatttgaaaccggagggagtacatgtttagggcgtgtttggttgcctgcatccatgtatagtgagcagcgtgtttggttgtgcactggctgatataagcaaatattatatgtatatgcatgcatgcacgaggacgaacgaagtaaccgaaggcacgcatggaatgatggaagaaacgtgctgcaaacaaacatgcatgtatatgttgctgtgcatctcggaggaagaatgatgacattttttagtcaaaatatactaaaaacgtacgtaacaaaaaagaaaaaaaatatcgggaggagcaggtagctagttagctagctatatactccctccgtttcgaaatgtttggcgccgttgactttttagcatatgtttgaccgttcgtcttattcaaaaaatttaagtaattattaattcttttcatatcatttaattcattgttaaatatatttttatgtaggcatataattttacatattttacaaaagtttttgaataagacgaatgatcaaacatatgctaaaaagtcaacggtgtcaaacattttgaaacggagggagtagtaggttaattggtgaactcaagcttatggaaacctgagctcatgcaatatatgagtaatatacagttatgtcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaat

SEQ ID NO: 42879 - DNA, 5743 bp, Oryza sativa
tttatgtattgatcaaatttggcaacacactaaacgtggatatttttttagcaactttgcgaaaaaaatggtatggttgaaaatgacatcaaaatgaaaggccctatattagtggattatttgttatgaaaactctttcatatagttatactccctctatcacataatacaagggattttgccctttctaattgtctcacaaagatttttgtgtactactgtcagtcacatccatcaacttcaattcaaatttctacctattttgaccctcaactatcccctcacccaaaccaaatctcatttaataggggtattttagtcttctctcgctattcttaatcttataaaaagggaatagtcccttatatatatattattatgggacagagggagtatttataataattttcataaacattaatttgatttgaaaaggtaatgataaatcatatcaacatctaaaacgtcaagtaaaaatatcactgccagttcagatccgtttgggtgggtaaaaccatggtgaactggcattagtactatctctctatatatatcaccattggtttacactaaaccgtcagtgataagtcatcagtgatgatattttgtggtagtgaatccttaatatataatatataaagccggctttaaataattatctataaattgattatataagatattcaattaattatgtgctaaccttgatgagctcggatgggcggaagccaccaatccagaggaagcagcgctcggcggcgggcagccacgtcccggagacgaggtggaagacgtcggcgctggccacggcggccttgagctccaccagcacgccgtggtgcgccaccgccgcgtccaccagctgccgtagctgcgcctccgccgccgccgccgccacgccgccgtgctgcggctgctcctccaccgccgcccgcatgtgagccatcatcctctcgtggctctccacccaccgcgcgtactcgccgtcgaaccacgccgcctctgcatgatgacgatgacgatgacgacgacgatgatgattagtctcccttacacattataatatgttcttttttttctcttaatcctttaagtctagattcactaacattcatatgaatttgaagttttgaacacatatataaaatacatacgtggatctatgtataaatctatttaaaacccaacgtaaataatgtgaaacagaggaagcattcattaaaaattttagttgtttccattatgtattttaaaaattaagagttgtgtgtttttgcacatggacatctgcattcattcctgacatatttgatctaatgatgaattaattaacgagtaaacaaattaattagagaatttgttggtgattatgtggttttgagtattatatggatttaattataataattaattagggttggtttgatcgtatgcatgcatatatgattatatatacctgggctttgtcctccaatgccggcagaaaaagctccaccacccaaaattgcaccctatgttgatacgtgcgttagacatgcatcatgaaacaaatcaatcaattaattagtttactgaaaacatcgtatagttcaggagcatttgcatgtatatatgctgtacctgagttcttgatctttgcaccaactcctgttccagctgggacagtctgatcctgcttgtctccagattttgaatgtaagcctatatacacattgatccatatacgagacacaatttaaaaaaaaaagcatagttaattaagtgtcatgagaaacgtaattttcagatagacgtagccagtaatgttgcacatctatattccattttaggtggtaagtaattctccgtacccccacactcacatgcatgcaaactcatttgtttaattttgactttattttatatccgacatgacacatgttagttattttaattttgacttaaatttggagtaagaacgtcgtaactgcacaagtctatactcctgtgctgtcgtaaagtagggtgaaatggcagtgcggttaattaaacaacaggtaattaattaatctcgatttacagctaccctaccagccaggtagagcaagagtaattaactataattaactgcaacttaattaattaacaaattaccttcttccttagcctgcttttcctggctgcctccctgttctgtgcaagcctccgcagcgtcttggcgtccggcgtcttggggccctcgtgctccgacgccgccgccgacgatgcgccgccgtgatgcttcccgccgccgccgccgccttctttctgatcggccgatcgagacgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcaattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgacacacatctccaggtgtttgttatacgtcactctctcctccccatctagagaaaattttgggaaaatgacatgtcagtgagtaaagctttgaggcgatcaaatagaaggaaaaaagaagatggatcaccatcgctgcctgctcatcgatctctatagatagctaatactccatatctgtcgtcgaaaaattcgataatgaccatatatattcacttgtcaaaatcgaggtagctagatgagatgcttgccggcctgcttgctatatatctgatgaaattaattaattaatatgaccaaagaaagattattctccctctgcatccttgtcgatcacatcttttttcggagaagaatataatgcataatttgtgaaaagtctgaagatttggtgacagtaataagtgcatatatatatgtggcttacgaggttgttcttgaattgctgctgatgcttgatcctggctgttgaggtagaggaagatgtgatccaattctgccatgtcgtatcctcccccaggatcctttctgctgcacttgcacaaattaatacaaatggagaaatcatcacaaaattatattatcatctgatctgacagtagctatagctgtagtagttgctaaattattctgcatattttaaggttttggtaagagaagctaagcttcctgctccaagaaaggggataaaataaaaaaaggaatttttggaatatacgttgtttgctaaacaaatccagtattagaaaatgtaaaaatccttagaagatatcaaaattaaggaaatgaatgaaaagcctcggcaccagctagtagaattagttgcacccatcgctttattaaatttggagcaaacaataagtacacccacttcgaataccactcttcaaattaattaagagatgcttaaatatacaccaaataaaacccttaataaccaggataaagttacttatcttgcgcaaacatgcaccattagtaatcaacccattcatgcatcatacaaattaaaacatgaaaaacaattctgtaatcttgaaagttcaaaaaagcactccataatctcgaaagaaaagtaaaagagacaacaaattaaactgccaagaaagacagcatcaagagagagagagagagagagagagagagagagagagagagagagagaattgtggagttaattaaagctccagttctgatgataagacaaaaaaggggatcaagaagctaaacattgagcaaggtgcttcaaatttgttctgataaaacaagatcgaattagggaggaaaaaaaaaggcacaagtcgtataggagttagggtttttacatgatgttgttgccatggatggaggaggaggtcgcagaagcttgcatcatcatcccggccgtgactgagcaagaagccgcctgctgatcatgtggctgcagctgctgctgccatggcctatcccccatgcaaacacactgatccccagtagcaaataaactatctctttcttctccttgatgatgatcacctcagctagcaattaaatcgatcctatcaccaaatcagctcctcaagtacttcacatctgatctcatcacctctagactcgatcgatatgatatcgattgattttgcgaggaatttatcggtagacgacgcgtgtcgatcgatcgcgccgcaatccctcctcctcttcttcttcttcctccaagctaggtagacatagcttctaattctccttagcttcttctgaccggaagctagctagctataggtagcaaaagtattaggacttgtagtagctagcttagttgaggtggagtgcttgtacaagaaatataaggggagtggttacaaggccatggaaaaagctaggcaataattagactttttttataaaggtcgaatacgatatgtgattggatcggggttgatcggtctctgcgactggttttggagcgcggttttatattgatttttgttaattaattggtgtttgatctttacgtgtttcatcattggtccaagtcaatttgaagaaaaaaaaagaaggttatctagtgcttgtattgttgttgggtattttgggttcagaagaaattaagtattatcactgtttcttcttgttaattaattttgctcaacttgttgtgttttggcaggatttaggttgggaattaattgggtcttgcaagaaaacaaagtatggtttggtctagcggctaatatatattagtatatattttttaagcaaattaattaaggcatatgctttgcctttgtgtatattgatagagcaggggagatgcaaatatatatatatagttgattatcaattggattgtgtaaacatatatttatgttgctgtatatatagcacatactattacaaattaaaagtacacggtatgaacatatataatttcaaattccctaccgtgtacttttgtaatggttcgatggcaataatagttaagaaacatcagtgtcttaatccaaccacaatgtccacccttttcaggagccaatagccactcaaaagagaaaacaattaaaggatgtgttattacaagataaacataattaatagggtttcctcccttggatacaaaagaagggggccctggagacaccacagttggttgatccttccaaaatgtcaatta

SEQ ID NO: 42880 - DNA, 4783 bp, Oryza sativa
  unsure (1)..(4783): unsure at all n locations
ggaaaaagtcagagaagaagaaagtggtggtggtttcagattacagttgaatgagatgctgtcggccaggtcggctacaacaaacaggcaaagccaaataaccttgtaacacaaaatgaaaacaagaagatacaaaaggtcagggagaacatatcttgaccttcttggggtcactacaaagatgatgctaattaaagtcaactctacaataataaacaggaacaatatatggtctctgcatttcacatggatgcatgctaaattgtgtctaattgtttaattattggattggaaaacccatgttatgattctgaaggaattgccttgttttccatggattttctgtgttctgataagttattccaattcagtgtatatataacgatcacgtacgagtcgatttcagaaaacagcaaatgcaataacgacattattgacctatgtataagagctctaaaaaagatgtcctaaataaaattgaccaataggagccaatctgaattgaagtgatcgatgtcgattaattaaccgtgggaatttccttcacaagcacggaaaattcagttttgtcctaattagggtcaagtcttggatcctgaaaaatgaaaagaacttgaccattacaaaagcaactgtttccaaccacaaatggagtctcttgtaataaagcgacggcttaatttgttcttttagaaattagaatcttctactcggtcgatctaagaaaatgaatatatatttcctgcatgctccttgaaaccgtgacaggaaaatgtaattttaagttaattactgacaaaattattgaacataattaatttcaaaatgttctgaaattttcggttctcttttcccatcatgccgtttctcatcagctagcgagcgtgggttttggagttgggaaacggcccacgggccagcgacgatcaggcatcagctctatgggcctcagttcggtccaaaattaggcctgtttttcaacttttttttttcggactgctagaaatttcaacaataggttgtccaaatgcggccttccagtgtaactaagggcttgttcatacccaattttggtattgacacctttggccattgtcaactttttaggctgagttagtttgtcctacgcataacttattagcacatgattaataaaatattagctagtttttttaaaaacaatagattagtatgattttttaaagcaactttcgtattttttttaaaaaaagatcgtttagttatttaaaaagcatgtacgcgcaaaacgaggaagatgagttgagaaatgtaacaacaaacacaaccttagcagtcggttgagcaatagtaattcccagctcttccccaaaaaaaaaaaacacaaccttagcaaagtttgatagtgttcgtatgaaaggaaattatctgaactaacaaaatttggaaaggtaataatgctaagagtagcttagtttgctacctaatcaaacattggtactgctaaattttgagagttaaaaatccgcgacaaaatgaactgccaaacaaaataataaatagctaatttcgatgcaattaaaataaatcagaatattttcgatgccacaaaattgtaactggaaacttttatatttctacaaaaagtataaactactcctttgcttgtcttttggcttattacccgtagccagaatttaaatttaaatatttaattttcaaactgattttgataattattttatcatggtttatttttacaatcatatgactataaaaaatttatcaataaattattaccagttttgatcgataaatgatagattaaaccatttgtttcctcatataaaaaacacagtttaggacatactcaatagtagagcctagtatgatctcttaaattatttagagataatatctttacaatataatagttgagacgacgaaaactcaaattttgtttattgttgttctttcttgttttttctcaccctcatgtaatcatgttttctttctgtaagtgctaagaatcaatattgtgctgttgttaactatatcaacgatattttgtttattttttttcacaaatatttctaattagcaaggttaatagcttatgatttaatacgggttgtacacttgtacatggccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaatttcagtttcatctaaattggagtggagctggctagagcgctctcacaaaatgaactaggctaaataatctgcaaataaaacttttatatacgtgttcttaacgatctaaaaagcaaggttgaaaaataaacttcgatgagaaaacctcaaaatcaactccaaatttaacgttgaaaattcaaaatttggctaataagcataagcataagtgaaaagatgaaactgctaaaagggtggagctagatttatactgccccacaactttatactagacccaattcatgaagttaaatttagaatttaaagctctaacaaacgagtcgtttggttctataccaaacaaaattcccactataatggaaaacaattttaatataatctaataaataaaagaaaagaaaagaaaaatcacccgctcccctgcgatcccttctcgccatttccgcggcgccaccgcactccgccactctccccctcctctcctcctcctcccagatctcctcctcctcctcctcctcgccgccggcgatggccgacgaccccctcgacccgccgccggagccgcagccgcagacgctgccggcggtagcagccgcgtccccgtccccgtcccccccgccgctccttctccgcccccgccgcgaggccttcgagcacggcctcctccccatccccaagctcatcttccccgagggcacgctcgcgcacaccctcgcncaggtcaaggacaagctcgcctccgccgcggatggaggaggccgcgtggccgcggcggcgctcgcggaggcgctgcagatcccgcacgagcaggcggcgctcgcgctcgccacgctcgccgcggtgctccccgcggacgaccccgcgctggactccggcggcgggggcagggccgacctccgcgacgtgctgctcttcctctacatccagtcgtacaagcgcctcgtgccccgcgcgcacaaggactcgcccgccgtcaccgacgtctggccctccacctccgccttcgacggctacctctccgcgctctccccgatccaggtcagggatctaggcctcccccccgttgctttataattagaatttgggtgctcccatgattcctctgcagcagagaacaccttggatgtgtgattgcttagccttaatcatgtgcccaattgagcttagaacatcgccgtcgatttaaacaaggcggctgttgtgccaccttatatccttcatgttgcagctgatgctgccgtttatctgctgtcacaacaaaaattgatatgtgatgtaactcactcgagctataagaaatgctccacagtaaaaagtcgtgcagctctagatatatagtgcaaaggaagatcctagctgctgatacttattggatgctatggatggtaccgtatgctggggtcacttcttgacttcaatttaaggttatcttttttattggtggccgtcagaaatgaatggttggttgcatcaaattacgtatgatggttggacttgtatgctaacagtaaactcagaagcacacagactttgccataattgagcgaccagtcattgttgtgaccattttgttatagattcagtcaattgtatgtttgcttaattctttcgatttgatctggaaccatgcaaacctggtaatttcactataggcacaatattttacttccactcttttagctcaaatttcaaaatttggagactatggtgcattcaaatatgacttacaaaattcccagctgctaaacctctgtttcgtctatcagcaatatttttaaactgaaatcctatgccctgtgccttttctggtttgggtggtaacagtggctacagagggttagtattcatgcctttttgtataaagtttttgtaaaatca

SEQ ID NO: 42881 - DNA, 1122 bp, Oryza sativa
cttctgtttgacaatttgtatcttgttttcttagtagagtgaagctttatgtgggaaaagagtgacagaataatgcatagcatgttctgataatggagtttatttgtttttctatatctcaaaacactagaatcgacccgtaaaagtacatctccgtgttggatgcctggaactccagggccgtgatcctgtaaaattatatgcaaacctacctctcagacaagtatacctctaaatatattgtgatgtatgagtatgcttttggtcaattaggtgttaacttcactcagaaggtgccctgcaaaaaaagaaaaaaaacgaagaccacccatcagtagatgttttgagatagcagattcttttttaaaaactaatatatagacaagcaaatataaaggtagcatatatttgacccagttagatatatctggcccaagtaagaactcatctttttgttaaatttaggatacatgtcacattgtcaccttacatttgagggcattttctgaaggcaattgcctttgtgcgtcctatttaggtttttattccttaggattctttgtggttgggctttggtagaccattacacttcagaatgtaaaataactgtatttcacaatttttgtgcaggtattgaccatggagacatttgaacaccttggatttctactgaagttctcagaaggaacacccttaagccaggcagccactttttttgcaaattctgatcctgacatgcctgctgcccctgtacctgctgcccaggttcatgattggatctcacagaatatatctgcttcactggaattctctaccgagaagtccatatcaaaggaagttagccagcaggttacttccgatatagacgtcacaatggctgatgccaatgctagtaatgcaaggaacagcacaccgactggtacaaatcctgcatactacagaaacacaacatttgtggaaggcttctccaaaacttctgttgtcaagcacgcgtctgatgtcaaaggacattcagtgaaggtatggatcatagctgcttaccataaactatttttggatgctgaaaagactacaaagatatgtcacttttcacatttctacatgtttgcattgtccactaaa

SEQ ID NO: 42882 - DNA, 2079 bp, Oryza sativa
aaaagcatgccacaagtatccaaaatttcatccaactcttgttggagaaacgaacgcagcctaagagagaggagatgaaaaatttagccaaccttatagctaatctattatacatgttaactctaatgtgggtttataactagcagttagctctactattaaacttgctctaaacttattcttacatagtttttaggttgttgggttacagctggaagaaagtatgaagtttgtccaatgctgaacttattgatgtgctattaataacatactgtgctttgattttaaccttttactatagtcaaatttctccttttctgtaccaacaggttgctccatttaatacctactacccacaattgggtgaacatctggcaaaagttggtgtggatcctgcaatcaataaatgggaccagccttttgtgttgggagttgttgatccgcacgattcattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaattctaattatgtcccctactgttcttaaaaaaaactctttaaaggtcattgttcagacttcggactacctgcatgtgcattgctaatttgtctatacttgcgctggtgcctactttagaatgaaccctcgaattttttcccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatttgtcctgttgtttttaccactgacatttgcctcatttagatttttctaattcaactctgtgtttacaccattcatattcagcttgctgcactggaagatattaggaggactattcgggagctgcaaattgatgacaataggaagaaggaattgacaaatgccctccatgcacagttcaaagattggttatatggtaagttttcatctgtacattcagttgctaatgcattcatatctcctttatgcttgttttagtgccatttgcctatgatggttttgcctaagtcattagaattgcaccttgctttctgaaatttagtctcttcaaagaaacagtgtcaagaatcaaattgtttgctttgaccatacaaacaaatttgcatgaatggagcgctcagtaatgagtaattactgctcagcatgaggattcttatgtactgttgggtagctacaatcaaatgtgcacactaatacagtacaaacctgtcacaagaatatatgattgggtcaacctagtagcttcaataagtgttttttttccaatataggtgtagtatagagtatgacggccatacataatgaacttgaaccattattctgggcttccaattccacatgattctgaatccgttttattcagcatgtcagctggagtattaagtacaacatacctacatctatactactttaaaagcctcttgtggtggtgg

SEQ ID NO: 42883 - DNA, 2220 bp, Oryza sativa
catgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgattttttttttagatttagggatgattttgtgaatgacttggggattgtggatgatttttttggatgggcaattgtagatgatttgttgtgcataatttgtgaggatttgagggtgacaataaatggaagcagaaagaaacaatgaaccaatttttccaaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctaca

SEQ ID NO: 42884 - DNA, 9094 bp, Oryza sativa
aatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggacacaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgcctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggtttaagtaaaaaaaatattatattgttaatataaatggtaaaataatatagttttataaaaattattttcaaacatttgtgaatctaatttagacatatatatatgatgatatatataatctatgtttataaagttataatttcttcaaatttattaccactactaataattacaatttcgtctatacatgtagaagagaaagaagaagaaggaagcaaatgtaatttttaatgacataatttatatttttatgtttttccactttatctttttaaatgtgtgttgcagttgtatatgtattttcagcttttttacaagttgtaagtacgtacctttctcgtcggtgcgctgagagagattaggagagagattataaataggatttaatctaatggtcggagataacagatccatcaatttaattaaaaattgatggctagatattgtagttttttttctcacattttctagatttttttctaatttattagagtatattttaagtttaatacgaattttgattttgtatctcatctaacctagaagggaaaaaaaggaaagaacaaagaggagggtaggtacatatgtacgtgcacgtccatggagtgatagaggactttgggtgacgctaatgggcgatcgatcgcctggagcgatcaacctccatcccctcgtataaggtcctctcccctttcctcctccccttcttctcttcctactacaacataatttttttaaaaaaataaaaaaacaaaattaaaaaaatttatgtatagaaatactatatataaaaaatatttgaatttaaattcaaatttgaaacgggtatgtaaacttttgacttataaactttgggtctataaactttaggtgtataaagtttagatgtatagaaatactatatataaaaaatatttgaattcaaattcaaatttgaatcggatatataaacttttgacttataaactttaggtctctaaattttaggtgtataaactttagatatgtaaacttgaggtgtacaaactttaggtgcaaaaatttactaaaatagaaaagtaatgcggtgccaaaaaaaatcacgtggagaagggggtgatcgagcctggcgagcgatcgcgcattaggaattttggaggactttttctaccagtgattctttttccagatgagcgtaatttcaaaatcttaagatagatctatgttagctagaaataagggagaagggaagagttgggggtggctagagggagggagtacgtgctggctaccggaattttgtattttagatagatctaatggttaaaattaatggttcaccgatttaatgaaaataaatttttataatttattataactccatataacaatttaggagtgtttttagagcatttacattgtacatgcccttaggagtctcacgtggcggcttgagagagtttgtaggaagtttagatgttaggtgctctctaatataggccattcattttctttaaaatccatgcaaattttataagtagggtgacgtatatatacaagatattctttttggcttttttttgtcagtactatgtattcgtgtgtacgcgggattttttttgggaggaattattttttaatagatgtgatctgatgctataaaataactggttcaccaatttaagtgataatcgaaggtcggaatttctagaatctcctattataattacataattttaatacgaagatgaatgatcaaatatacactcactcaaacaatgtcaatagcataaaaaagcagggttttaaatctcctgctatagctgtttgaaaagggttttagctatttgctctcatgtataatttagccgctatagctctatttaacccactatagctgccgctatatctgtttaagaagctaaccgctaaatgtattagcccgctatttaaaacatcctaaaaaatagaggttgtagggtaaaaaaggggtaaatggggagagtgaaagaaaggagggcacataccttacctgggtacaaacgggatgaagcaggtgtacgtacacacggtgagatgagagggagggactaactcttcttttaatctaatctaaatctaaaataaaataatagacccaccaatttatatctcacattgtaaaaatatttttattcatcagtgaataatggagtaagtacgtacacaggatgattctttttggcttttttaggtgaatagtgctatatatttatacgtacatggtttggaaggtattatttttttatagatctaatctaatgtataaaataacttgtccatctaatttaacgtgaaaatcgaggattgaatgttttattttattctcaaaattttttaatactaagatgcatataaatatacgctcaaaaatatcaacggcataaaaatgagatgatataaatactcctatattgtaaagtatttcagacaaaattaaataaaaaagtttggggggagttaaaaaaaaggtggggcacgttcaagtatgttacatgcgtgccattgggagggaggcgtacgtacgcgctcgtcagatgaggggtggactaattaactttttctttaatctaagctaatctaatggtctaaaataatggacccacctatttaagtgaaaatcgagggctagatatttctaatatattagaatactacgtggcgatctaagagtatttttaggagtcccacatggcggcttgagagcgtttgtagaaagtttaatggacctttagtatataatagatacagattatttagagacgtgtctttacaatagttgagacgataaaggctctaataattaactcaaaaaatatttcttttgttaatattatttttatttttttatcctcatgcaaccatatttccatattatagtgattaatagttgttgttaagccgttgttatgcataacaacaatgttttatctttactctttctctttcttccatgtcaacaagtattcctaattagcaatgctaagagaccactattgacaaccattgtacatgccctaatccctattttattttctggattatgtagcttagctaccgagtgacagaatatctgaacctggactatttagaagagagttgaagatagtaatcgttgtagctaatataaactcttccaaatagtgctaagtctgacaaaaattaaattactaaaagtatatatgcataaagttcaaaaaaagtatagctgcatatatacactacttaaaaataacttttgcaccgctttcttcacatgcggacctgtatataaaaagatttaggaggtgtccaataatggcccagctacaaaaatttattttcacagccagatctcttaagaggtttgcatgcgaattttggtacccagttggctcccactccttttctctcctccttgcgttaaatcatttcttctccctacttatccctcttctcctcagtcctctcgccctcttctcctcgaccgctagatccggtgatggtgaaggggtgggtaggggaggctatggatcggacgcgtcgaatttgtcgtagcggggagtgtgacggtggctagggtggtcacgacgacaacagcagccttaagggcggtgaattcgtcaatcgtggccccgatcagggtggatccagtggctatggcgactgaggggcagatccaccagcgatcttgcccctccatcgcttttccccctacctagtaaatatgactttgtaaacgtggcagagtttcatgtgagaaggacacttttccatgccggattgaaatacttttttttggcggttaggccaactcacaaggaaatgttcatatatataccttagcattataaggaaaaccctaaagaaagtaagtatataacattggcggtcaattttaaccgcattatcgagtaatgttggctgttttattttggccccaagaaaattaattggctgcctgcttaatcaaattatacgctgcggatgctctgatcccttcatgattccacaaatgctggtgactagccacacccttcttaaaaattaatggcattgacccatcacgggacagcttatatatcatcgatgggcatatggacatatgggtggacaaaagctcaaattaagctcgtggctttgatcggcttgaactcgtttcgtaacgagttaagctgagctagacttttagctcgtgagttataatgagctagctcacgagttgcttgttagtaaaagagataacaatatatatctttatatattccatgcttcttaattagtacgtagtctttaatttacattcaaacttttgtatttgttgagccttttcttagtcagcttttagactatatatattaatacgtgataaattggtaagtttgaaattataaaagtgatatataaatgtgttaacgagtttaacaatttagctcgcgagctgagttgagctagacttttaacttgttaaggttagcgagctgagtgaactgacttgtgacttgtaaagataacgagttcaaacgaacctgagctggcttattatgcagccctagatgagcatcttcggatgcagccacaagagggaatatatcatcaggattttcagtaaaagaaaaggagagagagatcatcaggattacaaggtagtccaatcggcccctctactacttcaacagctgtcgttgtaaattggtctattgcatgtctacgtacacatatatacaagcaatgcattttttttaaaaaaaacacatacaagaagtacttcattagtatataggtggtcacaatccatatcctctagaatgggatcgatgtatagcacttcaccacacaaattctttctatatgttccacatgactatatgaggctctagtaggagaaggtagctaggatgtaagccatacatatatagcttaattaaggttgtacactactcctgcctgattgctgctgtattattggctagcaacatactgatgctttgcaagcacatcagctacaactaaaaaattaattttgagtaaatttcataaaactacatatattttgatcaaattatcacaaaactatatatttaaggttatatatcataaaattacagatttaaaattaaatttatcataaaactacaaatctaatatggagtattgcaaaactacagatttaataagaaagttatcacaaaactacaggtttcagagtttagatccttagcactagtgttatgtttgagttataaacatgtaagttttgtaattaaattgtcactaaacctgtagttttatgataactttattactaaatatgtagttttacgagtactgtgaaaaatttagtgttaaatctgtagttttgtgataatttgattaaagtatctgttgttttataaaatttactctttaattttagagacgattttaagtttttcatcatataagtatattttagcgttgtcttttaaatcatcaagaatacatataatttttactgataagttatttttgttaattgttttatttatttatttttaatcggtgaggcacatatatattagtcagtatcactagcacatattagaagacaacagaacagcacgcaaaatctatagaaaagtttgcaacagtatgtatgatctgtcaagagtcgctgtgatgacagcgaaatttttgtataggcatctcccggttgatggaagaatccatgcacagcattttcagagatacatgtgccctcacacgaacggctgcaacggcttcagcatgattaggcctagccaataatcaaaacgtactgtggcttcttgaatatttaatttagaactttattcgagggttttttttaatttcttcgtcatttccattgcttggctctcttttcatgattgttgagaagataaattttttttaaaaaaactcccctgaaattatatctaaaaataaaattttagaatacaaatcgctttaaattatactacaaaggtgaaataagcttgcaggcctatcgttgaaaaaaaaaacttgactagagaatattggatgataaattacgcttagtctggttacttccaaggctacaaggtcaagccactaaagaatattgaatgataaacaacacccaatctctagtagtctcggacatggaatgcaattttttttacaagaatgtccctcttttccatctcaaaatataagacattactatcttttagaaaaattattatttataacatttgtctaataattaaagtcatatgttataactagatttgtatttagaagtacctatatgacgttaattttctttttaaaaaaatatatttagaaaaaatattgtcaaagtataatgttgcattgtaaaccgtgtaaacagttaataatgtcttatatattggtaggagctatatgagaaaaagtttaactcatagtatatatatatatatatatgaatgaaaatcttttttcacatttcaaacaggccgattcattgtcgacctcaaaagtgaaagcatatatggacatatcaacaacagtactatagtcacttcaagaaagtgcgaggaggccaatacgtacgggagcatgacagtacaacatgtatacttcacatcttttcctcatttgagatctctctgatgttatttgagaggaatatttttgtatacggcttattattaattcgcagccacatgtttggcagcacatgctatatattagatgttgtattatcctgcaagctaggactgcatgctgtgaaccgcaaagccgttcattggttgcacacttgtatataagcctacagtttgctactagtatacatgatatccaaatcatactagtttattaatgtgaaatctgaattattttatatctattcaatttaccaccgcgcttatttattaatttgaacatgtttactcattttttaaaaaaaccgaatgaattacaaagacatacacgtagtgaggcaccgttgttggtggctctgtatgaagaaaaaatgattcttctaaaatacctctttgccttgtcgcttgtgttatgctatatcggacctcttctttccattgccttctctcttcatccttcgcagaactagaattttcttaattctagagttgagctaccgtagttcgcataattttatctttattctctctctttttgaagaaaaaggaaaaacttacatatccttgcacaccagcactccaatctctatggttttcctttctcgattaattatagcttttaacacaaggttgcaatatgacgatgttagcggtattacacgtatgttaaattttaacttgatgagataaattggacctgcaaatgcttttttttttccaaattttgatggaaacactcacagacacatacaaccaaagcttcctttcctgatttgtccggtgtgcaaggtagcatataacctgttgctgtttaagggtccctgtaacgtgtacgtagctagctaaactccgggtaacaattttgtcctcatttattgcatttgatgtgattacagcttagactgactgaccggtcagtagattatagaaatcgggcagccgtactaattcagactactattagtgagcagtaacaataatccaactcaatcgaacttgaggcatcaccattcatgatgcatgtactttaattaaacactgttagtagttagctaaacgccggctaagtacagttttgtcctgatttactgtacctgctgatgagatgcttgagctcatgcaagacagctagaaacatcaccagtgcacgtgaaaaccaaaaggtatgtgggacgtcctgtggtaaataaaatttaattaacccagcacaggaaaagcaggagagttttattcttcggtgatagccaatctctccaaaaaaaagtatttgttgggtcctgtggttaataaaatttaatccgttctttctgtactattacagaaacgctacttatttgcatttttaa

SEQ ID NO: 42885 - DNA, 11229 bp, Oryza sativa
  unsure (1)..(11229): unsure at all n locations
aggtttttcccggcgatctttcaataagtaaagccaaaaaagatcatatcaaagtacgacaagtcatggaatttaaatggaagacaaggagagaagacgattcgattttatttttcaaccagttatctttcactttaaaattttaaaacccaagatgcagcgctaagagtggttttagtggtgtttttttaccactttactaaccatcatgctattatatgccatgcatcatggtggctaatatatataggaaactgtatccacgtttcgcactgttatttccatcatttcctcgcgctaaagtgataagatagggagatgcggggaggaaagggaacaaagtgtatgatatgatgtgtccagtgttagctatttaatacaccctccattctaaattgatctacatatagtttttttaagattattactaaatgatatacatatttatgttcattcattaagtctatttgttatttgtgcattggagtaaatagacattaatgcatgcatccatgcacacaaatatttataacccacatgcaatatcttgatttgctattggctaggaaatagtggggatggtgcatgcatcgagtttgttgctaaagtaaatatagtatgagagagttattagtttttttggttttagtgtatctatgaaatatgtacatcaatttggaatggagggagtagttaattatagtggcggaaaatagtgttatatactatgaatcttaaacggagatttatgagccctattttttcacataaatgaaaatattaacatgttccatttataaccgcggaacaacgtacattattattacacaaagattaattgaagataagtattattcatacatatacaaatatctgtgacgcaatctataggatgtgatatacacctacgaatataagtacgtgaatttttttaaaaaaaaagaatcttggagtaaattattaacgtgatatagctagtttaatttgtgatagggaattaaggatacatagtcatgtcaccttcgtcatatatattaattattcactctcgatcgattgccaagtaattatattattaacacgcatgtggtaaacggtatacccacatacagtgacatggctagtctgatagagaaggatgtacagtcaagtcaccttcattgtcgattttgccaagtagagtaatttttttaacgcatggtaaaatggtagcttagacgtagacacatgtacagtgatagctagtctgatagagaaggatatgtacagtcttgtcaccttcagatttggcattggccattttgccatacacttgtacgtgccgattcacacgcttgtcgatctgtgactgtagtagtgtggcaagtctcggtctctctggcaatgaccctgcttcaattcatactccactggtaattttacatctatatatatccagccgtttattgagatagagacgtgtaacggggagagcaggccggtctaatccatatatgcatatttgtgtgaacgatatataggcacgaatttacaaaaaaatatcgggtattctgacttttaatttctaatgtttgtttttagagtaaactttataaaacgatgatttgaccaaactatcacaaaacaaatatgcgttttttttaaccaaaactacatatttagtgtcaaatttatcacatatctgcatatttaaggcatctacagattatgaggatattaagaactatacattttatagtttatatccatagcagaagtttagtttgtgataaaactgatgttaaatctatgtgattttctaatacaaatctattattttgtaaatgaaaattatgttaaatccataatttttgtgatacaaatttttaaatatatagttttgtgatatacaaagttgaaattaatttaatcttgtttttaatgcaaaaatttataaatactaaaaaagattacgtattacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttnnnnnnnnnnnnnnnnnnnnnnttttttttttccggatggagtacgttttaactttgcttgcgtagtacctatagtagatatttcggtttttgattttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccaccatgattcaccccaaccagccgctggcgctgtccgcggcgaagaacgcgagcaccgtcgtcgtcggctcgccgctcctcgcggcgtcgccggcctcctcccccgcggcggcgtgctgtagcagccagctgcagcagcggcgagccgccgggcccgggaggaggggcgccggtaggctcgcggcgccgaggtgcagcaccatcgagcaggccgccggcgtgtcgtcggccgtgacggtggacaggacgctgacggtgaccgccacggtgaccgtgcagccgcccatcggcgtcgtctacgccgcccgcggcatcgacgacctcaccgacctcatcggcaagacgctcctcctcgagctcgtcagctccgagctcgacccaagtgagcagcacaacatatccatggcttagccgaagctccatggatgcatggacaaacacatgtagtagtaattaacaccatgtctatgcatgcagggacggggaaggagaaggagacggtgagcgcgttcgcgcacaggacgatgaagcaggacacgtacgaggcggagttcgccgtgccggcgacgttcgggccggtgggcgccgtgctggtggagaacgagcaccaccgcgagatgttcgtcaaggagatctgcctcgtcaccggcgccgacgactcctccgccgtcaccttcgactgcaactcctgggtccactccaagttcgacaaccccgaccgccgcatcttcttcaccgtcaaggtactacaaacatcgatcgatctcaccatcacaccatccatgaacacttggaagcatcatatcaacgacgtctagcgcggccatggatcgatgcagtcgtacctgccggcgcagacgcccaaggggatcgaggcgctgaggaagaaggagctggagacgctgcgcggcgacggcaccggcgagcgcaagttcttcgaccgcgtctacgactacgacgtctacaacgacctcggcgaccccgacttcaagatcgagcacctccgccccgtcctcggcggcgacgaacacccctaccctcgccgctgccgcaccggccgcccccacaccgagatcggtaaccccacctcacctcccagaaattttacatcattttcacatcaaattaatcacctattccctccgtttcaggttataaaacattttaacttttgtcaaagtcaaactattttaagtttgactaagtttatagacaaatataataatatttataatattaaattagtttcatcaaatcaataattaaatatattttcataataaatttgtcttaggttaaaaatattactacttttctctacaaatttggtcaaagttaaaacagtttgactttgaccaaaatcaaaacgccttataacttaaaacgaagggagtaataatgatcgaagacaaacctaggacagcttagacctgagcctatgtttatctccataatcatgctcaaaaaatttctggctcagccactgctaatggattaaatgtatatgtaattaattagatccgcggacggagaagaggagggggccggtgtacgtgcctcgggacgagcagttctcggacgtgaaggggatgacgttcagcgcgacgacgctgaggtcggggctgcacgcgatgctgccggcgctggagccgctgctggcgaaccaggagctgaggttcccgcacttcccggccatcgacggcctctacagcgtcggcatcccgctgccggcgcagctcgccgccgccggcgccgccactgccacggccggcggcgccgcggcctcctcctccacctccaccaacatcgtcggcggcgtcatcccccgcctcgtccgcatgatcgaggacaccaccgaccacgtcctccgcttcgacgtccccgagatgttcgagcgtacgtgataattaattaattacgtgccatgattaaaggctaatcggtagtactaattagtactccctccgaatgtattttaatgtataaccgtcgctgactttttaactaatatttaaacattcgttttattcaaacttttttataaatatgaaaaaatttatgtcatgcttaaagaatatttgatgattaattaagtcacaataaaataaatgataattatataatttttttaataagacaactggttaaatattgaaaaaaacttaacgacgacatatattaaaatataaatatcgaggtagtaacatgttgattaagctatcgaggtagtaacatgttgattaagcaatggatcaattggatttggctttgcattgcgcaggagataggttctcgtggttcagagacgaggagttcgcgaggcaggtgctggctggcgtcaaccccatctgcatccagctcctaacggtagcaccgccattcccaaccacatacactattcacctgaggacgacgtcacttttcgatgacgtcatcccccaaaaagaatgaattttcgctcgtcccgtcctggtcatcctttaatgtgtagtggcgaacccagaatttttatactaataaatatttcaaaaaatatacatatgttgatgtctttaggagagaaaagatatatagcagtagaaaaataaacaaggggtacagtggcagatggaaaattttttacaatgggtattaaaaattatgtagtatttaaaaaacatgttagagactttatatgacaaaaaaatgaaacagtacaatatttgggtaaaagctgggtggctgagactaggaatcgaacccaagatccataatgggtatattaaaaatcacgtactccagtatttaaaaacatgttagtgtctttagcagaaaaaggattcaataataaaaagaaaatatgcatcctatatgttagcatcatactcccttcctcaatttatggcatgaagttatacccatcttaaactctcaactgagttttttgctgatgtggttttgaaatttaaaaatatatatataactaacaagttgtaaatgatacaaacaattcttttaattaaaaataatcatatattaaccatacggtaaaattttaatgtttatataatcataaaagtagcccatgaattaaatgcacaggtttcctaaaatttatatgcagaaacttttataatacatactattttatattaaaaacaattgaattcgaatctaaattaaaatctggcataaacttttggtgtaaaaattttaggggtataaactttagttatataaacttaacaaaaaaataaaaatcgcgtgacaaaaaagaaagtgtggccgttcacagtgtgcaaacattagcccttttcgctagataatttccctctcaatatttagctaaaaggttttaatggctttaaataaatgacactattgctttttctaatttctaggactatttgtcatttgttagcatcatattcccttcttcctcaatttatggcatgaagttatacccatcttaaactctcaacttagtattatgttgatgtagtttagaatttaaaaatgtatatataactaacaagctgtaaatgatacaaaaaatattttaattgaaaaatagccatatattaaccatatggtaaaaatttagtatttatataatcataaaaatagcccatgcaatgcataggttttaaaatttatatgtagaaacttttaatacatactcattttatatattaaaaaaacatttgaattcgaatccaaattaaaatcggacataaacttttgtggtaaaaattttaggtgtataaactttagttatataattaaacttagcagaaaataaagtgtggccgctcgcagtgcgcaaacattagccctttcgctagataatttccctctcaatatttagctaaaaagttttaaatggctttaaataaatggcgccattattggcttttctagtttgtatgactatttttcatttgtagaaatatttgtgcaaatagacaaacatacgagtcgtaaagtattattgatgacaaatctagtggtatccctttttttctattttgcttaacattgaacgaatgtctgtttttaaaagttttgaggaaaaaagtctcaaatggtgtgagtagcaactaaggaaaaccgaactcaccaattaattaatggcgatcgatcgacgtgtgcaggagtttcccatcgtgagcaagctggacccggaggtgtacgggccaccggagtcggcgctgacgaaggagttgctggagagccagatcgtggagtcggtgacggtggaggaggcgatggcgcagcggcggctcttcatcctggactaccacgacgtgttcctcccctacgtgcaccgcgtccgcgagcggccggagacgacgctctacggctcccgcacggtgttcttcctcaccggcgccggcacgctgtcgccgctcgccatcgagctggcgcggccgcagtcgccaacgaggccgcagtggaggcgcgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaactccatcaagcagtgggcgtcggattacatcgacttctactacaagtccgacgaggaggtcgcctgcgacgaggaggtgcgggcgtggtgggaggaggtgcgcaccaaggggcacgccgacaagaaggacgagccgtggtggccggcggtggacacccgggacgggctcatcggcgtcttgaccaccatcatgtgggtgacctccggccaccacgccgccgtcaacttcgggcagtaccactacggcggctacttcccgaaccggccgacggtgatgaggaagaaaatgccggtggaggagaacaaggaggaggagatgaagaagttcatggagatgccggagcacgtgctgctggacaccatgccgtccaagatgcaggccatcacgatcatggcgacgctggacatcctgtcgtcgcactcccccgacgaggagtacatgggggagcacgccgagccggcgtggctggcggagccgagggtcaaggcggcgttcgagaggttcgcagggaggatgaaggagatcgagggcatcgtcgacgagcggaacaacgacccggagctcaggaacaggtgcggcgccggcatcgtgccgtacgagctgctcaagccgttctccacgcccggggtcaccgggaggggcatcccaaacagcatctccatctgagtttcgctagctaagatagctagctgcatttgggacaagattggagatggttaagatttgtacactaagatcatgtaccaacactaatagctcccgtgtatgcctgcctgccacgggagaggcatttgctagtgtgtttgagttactagaatgccacaaattagtaaagaggttattgaactaaagctcagttcgctgagttttctagaaattggcagtatgtcatgcggacggatgggatctgctggattcagcacatatcatccaagaaaaattactcacagcagaacaggcatgtcatgcatgtgactgaatcgagcagcattgtgagttgatcaggaccagcatggcatcgtgtttatagttcattggtcactggctaacgaacatcgttacccccggggttccagacaacgaactatacagctaagctgagacactgccaggatgcgtatctttttagaatgcaagacggttaggaaagataagggtattggagccgaccacaaaggcacaaagtgattagtcaggggaagataaggctggacctgcctgttagagttcactagaaagagcattccgagcagcatctccatgctcacgccggctcatttgagtccaaacttgtggagttaaacggttcctaatacatctagccacgcgtgacttggatgtaaaagagtccacttcgctcggttctctgaggtcaagtgatcaaccatgaaaaatttcaagtcttgtgcagtccacttagcacagcagctttgggtttctccgtttgaaactgacagggtgtgcagaaagtgatgcggcgcttgaaatacttgagtaccgctcctcgagtacagaaattgggggggtggagggaagggctttatctctgggagatgcagcctccggttgcactttgacttactaaattagagcaatgaaaataaggcttcgaaatgaagaatataagaacaaaaatggaagtgtgtgttatcgagtgaggtacctgtaaaggatggctcgaaatacggtctggttgttttgaaagagggttcctgagcatcaacctccaagtgttgtgtcgtcgtgctggtcttttgaagacctgtcgactggacaagcttcagtagtttgtctgttatgactgtcattggcggacggagctctggtgatttctgcattgaaggaagaaatacagccagtaatgatcacaaatatagggtgctgaaattcattcgatgaattcataaatcattaggaccgcagtaattagacatttttcagctataatccccttcaattcccatttaggagcagagtctaagcattaaggagtagtgcatgcggtgtttcaatttgcagcttggcttctatcctcaaggtagcatagttcaactaagtaatgtgtaccagaaaaaggtaacggacagttaccttgatgcagagtaagatgatgttgcctaacgtagagatagcttgaggtggcatagatgcatgtattcttggatcagttattctttccaaagaatcaaggttatggagatgaggagatgcccaatcaactagaaactgctcattctgccttcttgaactgaagaggaaaaagaacttcattagagaaccagactacagctgtacaagattaagtgagcatatacctgtcaaaggccttctgcccagtcaaaagcacgagcaaaatcacaccgaaactgtaaatgtcagccttgatgctatctgttgctgggtcagtaagctcaggtgcaacatagcctttaccactgttgagagcttctgagtcctgttttttcaggtgaggaactgttaacggtcaacggattatacagaagatatatcattgactttgaaaaacaccagtatccccttaatatgtgtgtgatttttctacccacttctgaagggaccacggttgatcctagtagggacacacacatatacatctttcaaatatttcaagggagagtagcttgttttgatataacactataatgtataggagtctatccagcgacctacctttgattttggttgagatgcaactgtaagcaatcgtgacaaaattccaaaagtatgggtctaaactggcttattattaatttagtctttcttccttttggaaaatagttcaagagctatagcgttcaccaaaggacataagcaccagcccggtgccttggtcttaggacttgaacccaagcagat

SEQ ID NO: 42886 - DNA, 13412 bp, Oryza sativa
acatggaaaactagtgagcactgaccgttcttatggcactgacaaattggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtgatatgaaagaatgtaagtctatccaataatgcaacatgcaggaatggagaacaagtatatatatacatgattggatattacatacagatcctaacataaggatgaatattaagtgatgaacaagaatatatagaatatgtctagccatcaactacaattgcataagccggttatgcttaaactaataaagttccagtgctacctttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagttgaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgacggtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacgggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcattcgaccatgtactggaagcaaccatttgttgcattgcaacggccattgacattgtgctggcggtgatcctggaggttta

SEQ ID NO: 42887 - DNA, 6529 bp, Oryza sativa
tctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaactgatgccacacaggaaccccgagaacatcccctgcgccgaagatcatgaccaggctgatccaccggagctatgcgcgcaaagaacacctatcaggaagctcacccggaaccggggcctggtgatgcagcaggaccagatggtggtcgcggagacgcccgaggagaagcagccaacctccaagcggaggcgcctcttcagagaccaacaatcttgaagcgaaaccccccctgccctgctcgtcggctgctgtagtttttagcactttagcgtgtgcgcctacctgctctcgtgttgtatgtagagggagagatctattataagttataatagcccgctgtggttttgcctagtgtctgtacaacagtcgggcgacatagctcatctcgtgctagctcgtgtaacagcttagatgtaactaatgttcttcttttaactctattagaatttagatcaggcagcttcgatttttccaaagatcggtggaattgtactcttgtagtgtgacgaaagatcgctagaatttgctccttagaggaatgtagcaccagtggctg

SEQ ID NO: 42888 - DNA, 5951 bp, Oryza sativa
attcccatagttaaagttcaggggagcaaagtttacctttttcctgtaaacaggttctttcattcgattatgtttaatttgatcgacctagattactagtatttgctttcctacaatcatgtactatgggaaggatccaactaatgaactaaaattttattagagttgctcatatattaacaaacaaaaaaaatacaatcatcatctggcctgtaactccttaacagccgtccctgtaaccagatctaacgggaactacaatgacaatatatgctctcaaatgcatcccgcaaataaagaaaagaccaaataataagctgaaatttagtttatatatagcagaacaagattcgggctaagccaacaataaacacatcaattcaagtaacaggaagtaaactgatacaggctagtactcagacttacgctttaaagtctgctgctgcataatccaggtaattggtttcacccagagaaggcaggtggtagggttttgtataagagaagaaagtccggctggcaaaaggaaccacaccaattgttgggtggtttgctttggtagctgcgttagggctttgaatagaattcaggcactttgcttgctgcattggaaggcagtacaaggaaattaatattttttttttcaacaaaggcatacaagttcactcttatattgtggaaaaatcaaagttatcgaaaattgcatagatgtgagaaaggaaacaaaagaaaaggcaccgccttgttctttttttaaaaaagaaaaggaattataaattggccggtttgaaagtgtaaaactagtgctagcaaagaaattgagtactattagctacttacagaaacaggaaggccatggttattgggaatcaccgtgctaaaacgacggagagctccattaaaaacattgttgatagcagaaacgcctcctccttcctgagaggaggaaaagagcaattatgctcttccctgctgtgaaagaaaaaccagaaatttgaaagatttggaggagtgtgtatacatacagcggaggtaggacgattaggcatcgatctggacagcacggacgagaattcctgaaacaagaaacgcctacacatgtcggcgatctataattctatatactgcttggaatttccggcgagcgctatctgcatataaaaaaaataaggggctaaaaccaaaaacaaaacgtaatcaggtgaggtagttttcggcaggcccccatgagcagcaaggaatctcaacagggaacttagaatctaatctaataacaatgacacggaaagaaagaaagaaagaagataaaactgatcctagcggctgcacggagggaagatgggattgaacaccgggcctccaaaccctagcacatcgcggttggggatcgaacacaaccttttttgccaaatggatttaagccatccgatgggggaggcaacgagcacggatgtaaaatatctcgcgaattatctcttatttatgtaactagcatggtggcccacacagattgcgcggctagcatcattatattttctctcatataatagcatatatgttttctcaatgtattattcaaatatattaaattgacaacataattttaaattttgtactaactttacgaaactactaatatgtaatattcatattgtattttatatacgtgttagttattaattatttttaatatcaaattttagttatttgtaaattatattcctatatagactctagactcgtctttcaatatttttttaattccgaatttttgttatctgtaaattgtatttccatgtagactctaggctcttctttcaatattatttatttttaattttgaatttttattatttataattgtatttctatgtggattttaaactcatctttcaatattctttaattttttttaatttcgaatttcaggtacttctaaattgtattcctatattgactttagactcttcttcccatgtgttttttttaaaattttgaattttagttatttataaattatatttttatacagactctaaaccatacttttaattttattatacttattttgaattttagttagctttaaattcctatatggactctatactctacttctaatattccttatttttaattccgaatttccattatttcctaattgtatttctatatggactctatactctacttctaatattccttatttttttaattccgaatttcagttatttataaattatatttctatatggactctagtcttttttattctgaattttaactatttctaaattatatttctatatggactctgtttttctttttcttcgattaatatgagaatttctaggccgtgagagcgaacgtggatgcttcattttctattcctttaataagttaataaattagttttgttaatggaatatgtttaatactccaaatattcgatgtgacatagattaaagtttagtctctgatccaaaattccaaacaccctctaagtacctcttgatgtcttgatggccatcaatgaatgaatagatgaatgatgtagttgtagtaataaactccatgaagtacgtgctccgtgacaagtagtgacaaacaaatgcagaatggggacgtggttgaaggtagaaaacagggtctagttgttgtagtaaaatctgaagccccgtgaaacgtttgttagtacggtggtgacgtggcgtgggtccaacgaggagggagcacgcacggtgagggagaaagtgatgaagttgcggttggtcagcgtcgtcacgagctggcttaagagaaagtgacgcaactgagtacagagtattacctccatctcaaaaaaaagtgcagtcatagggaaccccgtgtccgacgtttgaccgttcgttttatttaaaaaatttatgaaaaatttgaaaaaaaaatagtcacacataaagtactattcatgttttatcatttaataacaataaaaatactaatcataaaaaaatttcaaataagatgaatggtcaaaagttaaacataaacagtgcaaaactgcatttattttgagacagagggactaaaactttatagacggagatgacggtccatgcaagttatgaatgctgaaaagcaagagagaaggaggaggaagaccctctgtgagagcagaattcattaatttttcattaataatataaggaggtggaaagttgataagagaagtcttgtgtcggttgttggtcgggacgggaggaaggttcgtggcggcggcggcgtcgaatgagcgcaggacacggccgccccagaaatcgcccgtcaacctcccctctcgtgtcgcaagccgcagcacacaacggcgaccgtgcgcgcgcgcgtccccacgcggaggggaatggtggcgtccgacgcggagacacgcgggggaggggaagggaaccacgcgcaaacccaacgccctacgagactgtagtcgacgatgatttgataatacagcacggcagagcagagcaatgccaaagtcatggtctcctcctcctcctccccccaatccaaacccccaaaaccaaagccaaaacccctctcgccaccgatgggcgcccgcgcctctcgccaccgccaatcccccgaccaatcccaatcccaatccccatccccacaccacaagcaccaccaccaccaccaaaccacccgggcccccaagcccaagcccaagccccagccaccgccgccgcagcagccgcgatctcagcctccgccgccgccgcggcaccagccccagcaggcgccccagcaggcggcggcggaggatggggtggggcgggtgctggggcggcccatggaggacgtccgtgcgacctacaccttcgggcgggagctggggcgggggcagttcggggtgacctacctcgccacccacaagcccaccggccgacgctacgcctgcaagtccatcgccgcccgcaagctcgcccgccccgacgacctcgacgacgtccgccgcgaggtccacatcatgcaccacctcaccggccaccgcaacatcgtcgagctgcgcggcgcctacgaggaccgccactccgtcaacctcgtcatggagctctgcgagggcggcgagctcttcgaccgcatcatcgccaggggccactactccgagcgcgccgccgccgccctctgcagggagatcgtctccgtcgtccacagctgccactccatgggggtcatgcacagggacctcaagcccgagaacttcctcttcctcaacaagcgcgaggactccccgctcaaagccaccgattttggcctctccgtcttcttcaagcccggtatcctcccatctttcttttctactgcccattccttgctgcttcctccaaattaatataaataatttacacaaaccaaatccaccaccaatctattagccatcatctgctctctgtgtggacacctccaactgcgatgactatggtatcctgtcggattacacttcatttacgctctcatggtcaactcaaagcgggatcagggacaaatatagcggcaaaggcctgtgcatcatgttaggcaaggcatgggcttttgtttcaggaccacaagagaggaaatgtcatgaatcgtagcactgatggggtgctcaaggtgtgttcaaactgatggggtggtgtgggaatgcaggtgagcagttcagagatcttgttggaagtgcatattatgtggctcctgaggtcctaaaacgactatatggagctgaggcagacatatggagtgctggagttatcctttacatccttctatcaggggttcctccattctgggcaggtacattacatatcgctgctctttgcatcaaaaagtttttttatagagcagatcactatgtcatcaggcttttagtaagaaagcccagaaccaggttcaatacaagaaagcatccaatagattttgataccattatcctaacatggaccctttgttggttttaccagaaaacgaggacggtatatttgatgctgttctgcaaggtcatatcgacttctcatctgaaccatggccttctatatctagtggtgcaaaagacttggtcaagcggatgcttcggcaggacccaaaggagcggttaactgctgctgaaattttgagtaagttgatattttcaaactctgctatttgttgccaatcttggttctacgaattgatttgcccatatgtgtggttggaacttttaaagcgcactgcttgctattattagtaaaagcatttgtggtgattttacaaactaaatcttcatctgtgtatagtatcttaatctgatattttaaatacacagaccacccatggattagagaggatggagaggccccagataaaccacttgatattacagtgatcagtagaatgaagcagttcagagcaatgaacaaacttaagaaggttgccttgaaggtaataagatgttttgaacatcaagcatttcttctctatggctttgcactttattctgcaatacatgataaatcttgtcttttattatgttatggctaggtcgttgcagagaacttgtcagaggaagagattgtgggtttaaaggaaatgttcaaatctttagatactgataacagtgggacgataactcttgaagaactaagagctggtctaccaaagcttggcactaaaatttcggaatcagaattaaggcagttgatggaagcggtatgctcatattctctttctgtctctgcacgctcatatcttgattctgtaccaatgccagtagttcactataatggccttgtttggatcctccgagctattaaatagccctccggaatcttgctatttaggagtattaaacgtagattaccgataaaaccgattccataacccctaggctattttgtgagacgaatctaatgatgtatattaatccatgattagcggctaattactgtagcatcactgta

SEQ ID NO: 42889 - DNA, 4718 bp, Oryza sativa
  unsure (1)..(4718): unsure at all n locations
tattttgacaaggaccacagcgggtaagtttacttctgtcatttttttgaaaatcattttgataggttcgatcttttggattaactagtttgttgtttgcttgtttctgtacaggttcataacagtcgatgaattggaagaagctctgacaaagtacgacatgggtgatgaagcgacaattaaagaaataattgctgaagtggatacagaccatgtgagtcactccactaaatacctagaaaactccagtgattactttttgatatgtcatcaacgtttagaatatgaaaataatcattcctgcggcctttaaatcaggataatcgaattgattacattgaatatcttgaaaacattggaggagatttggttttcaagtatgctgaatgttgctcagccatctctaagatcatggatgctggctaattataattttcatagggtaaatctaactatattaataaactatgtaagctagtgaactttgatccatcctgctctctagtaatcgagttcctgttagataaataaaaaggttagctatcgagaaatcattccttctctaagcaatatacttccaccaacatgaatacatgatgtgggtgaataactgaaaattgctgatgctattattcaaaagtgaacattaaaacgggaactgcatggatttcctactaaatactgtgtcctgacttactgcttaggatggaagaattaactaccaggagtttgttgccatgatgaagaacaacagccctgagattgttccaaatcgacggcggatgttttaagcctttcctacagttattgtgaagtttttttcctttcacaaattctatatggttccatcttagggaagtgagcattatctttgtaaatgttacaagagcagttcgtatcggcggaattcaatgaagtatatgcaaggcatattggactcgttatgtatcatggtggatagctctctgaagtgggtgtggtgcgtttgtgtatgtatgcttgtgctttctggccatatgttttctgtctcttgataaaaagagctctgtaaaacagtttctactgatcatatcaggcaaggcaagataacgcttttctggtgaagctgaatttaactgatgatgtatgcttcgaaatttgattacttttctttgccagaagaagaatttggcaatgaactctttgacgatagataagttgataactcgagaaggttttaaggttaagaagaatttgaccattgaagcgaggattggggatccgttaatggtcagcccaatgcatcttgcttcaatgccagattccacagcccaattgacctttcagaatttggatcgcaacaaaatgttcgcgatgacaggaccatatgccagcaaatctggtacaaatctcccttgaaaaggatacgaagaacatcagaagtatctctacaagccagcagctccatttcgaatatgaattttattgtctgctgaaagccgaggcttcttagaagcagaatagcacagcaacaacatggaactgattgggcgctgatgcagaattactacattttgttcatcaacaggaatggcaccactgatgctgacctgaaaaattgacacttacacattcagctctaaaccgcacaagcgaaaatcagatttacaataagcctcttgcttgaactttacagtgatatcacttcacacacacaaacgggaactaatcatcgaactgaggcctttctcgtctttgctgacttgtgcttgataaagagggtagctagcatgcttttagtgctaactggaaccttttggatttcacgccctctaggtttgtccaatgcattaaatgtcgacatatgcatgaaaccaggctggtcctgaaaatgcagacatggtaatttgcttttgttgggtttcataaagaacaaaacaactatatggggataaacccattttactgaatatagacaagtatgatggtaaaatattaacttgtttttaattcatactcctactaagcttattttatattccaattatttacctttgaaccaacatttttcttagcatcaaaactggtgttcccattcggttgcagaggcttgtgcatgggagaagcaggtatgtccttgcctgaaagatcaattatttagatggaacactcaattggcatacgaatatttcaaaatccccctattttacagttaaacgatatgcgcacatccatcatcagatcatggtcatgagacacaacacaatttagcatagtgtttgattacctagaaggtacatggaaccatttgatgcaggtttagacgatatagtatcccctagtctgcacaaaagatgacaagaagatagatcagaagagaatagctccattgcaccttagtaaatgaagaaaggtgcaatttaaacagaactgaacaaaacaactaatgatagtatcttacgtaaatgtatatttctgtgctccagttgtcgaaatgctgttctctgaagacagatgccatgaaagggtcttggctgcagtccaaatatgaaatgttgtttgttggttcatatgaaaagtagcatccataaaatttgcaatctgaacaaaaaggaacaagaaggtccatacctgaaggataaggtttaggttttgaatcctgaccattgtctgtttgcaggcgtgcagcttgagttcttttatgaccggtagctagcttggcaagtaagtataggcaagatttagcatttaattggaaaaaacagtggagaagttcttaattgtatacatccttacatggtaggatatagtgcttatgatgtttaaaagttgttccaccaatcttctgctgcctgaggcctgctctgtcggtgaagatttggcaggtgaggatttgctataaattggaggataggataaactgatattgtcagttaaattgtcatggtttgatcagcacatactgcatgcaaagcagatatagctttacctggtttaagcgtgcaaccttcagctcaaccgtagagacctcagaagcttgctgttcaaacaggtccgttaatttgtatgcaacagtaccaaggtgatcaacagcattgacgacagctcgtacagcataatctttcaggttttccagcaccctatatcagcagaaaagcttcaaattatgaaaatacgatgcactaagaaacaatgctttagaattaccatatggtctttttctaaaataaacattttagaacccatgtttcagaatttcttctacattaacaaatatgagaaaagcccctaatagtaacatgtgggctgcaaaattccaaattgaatatactagtagtatacagagatggtggttagataaatccaaaattccagagaatacagacatcctatattcttctttaggcagtagagtttgttttgttgtcacatctcaacatcaagtccccttgccacacatgttgctgtcctccttcacttattaggtggttttagcctccaatacctatcatataattaactgctagcacacgatgtaccaacgattcgattcaattcaattcaacccctaaaacaaaagacgaaagtagagctagataccatgcaagatgcaaatttaccactgattttatgattgtaaattaaaatggtaagtggtaacaaaatgcaccaaagagctaaaacctcactcacatctgcttctgctcgctgtggaggtaggatttctcgcagtactcggaggcggagtagagctgaggccgcaggttcttgagctcctgcacacgcacagacgcaaggcatcaccaccaccacaaaccaagaaccggccggatccatggacaaaattaagcgaaggaaacgagacattcttgtgagcgcgagggatctgggatggaatgcgggcacgcacctgcagtgccttgacgaagctcttgctccgctccatggaggcctcgtcgacggtggtgggccccaccccggcgacccccgcccacccgcccgccgccgggctcggccgcaacggctgcattgtcgcaccaccgttcttgcctcctctccggttggcggcggccggcgagtgggatgggcaagaagaagaagcggggaggagaagctaagctaagctaagcttagctcagtggaggagagtgagagtgaggacgaagcgacactactcctactaataaattgctcgagcaagtgtgcaattgtatataccacgcagcaagaaagcacgggtctctcttggcgcgtcggaggaggaggtgatggcgacggtagctagcgccggtgaagaagcgatctcggtgggattggctttagcaaatggaggtagcaatctcacgggggaatcatcatcattcatcatcagagctagcttaattggtttgtttgttggtttggtttggttggtcgatcgctttgttttctacctgcaactgtactgagcagtagtggatctttgctgtcctaacctcattgtccttattaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42890 - DNA, 7459 bp, Oryza sativa
aattcctgcagcccattgtcctctgtttcttgtggatattggtcgagcattgcgacgtttactctccgagggtcgatgaatccagtatcgaaaaccctccgccgtcaggccctttgaatctccattctacaacgataaaatggagtatattattttctatagtctacttatatacaaggacctaattaattaaaggagacgtatagtaagaaatctaactgaacgatatacttacaaaatccagcaactcataatagagacgtcgagggcgtccagctggtatagttcggagattcccttgaaattgatccagagaatgtcatctccttgcaagaagtccgtgtccctgatcctcgctccgatcatctctctaccagtggcgctcatctccatgtacagctgatggaacttgtacatttgtgtgggtagggactgcagcagctcaggcttgacaagcggtttaccgagttcgtacatgtatttcacttccaccttttcgattggtgcgactcctagcaattgatccgtattagaccggtgtcagtaataaatttttctatcgtcatttctttaccggtcaccaacggctcgatctcctggtttggttgctctccaagctgagggactggtttggactttccagaagatgctttcttcagcgttcgctcatagtctgatagcttgattgcctgcttgacagatgcagacatacccctgaagaagtttctgacactagggtctataggaatcttcttttctggacttcgaggcttgaattgtctctggacttctgatgcaacgtaagcgtcaagctcctcttgcgtacaatcgtaccccgggtccttgttcttggcggcgtcaactttcgccttcttcgttgcccttgtgtgggcaggcggtggagctggggggcccttgactttgaaggtgccggaagaggagcttgcggaggagtaggtgtaggagcccgaggaggagtcggtgcaggatcctgaggaggagtcggtgctggagcctgacgtggagatggtgctggcagatcatgaggaggagacagtgcaggatcctgatgaggagatggctgagccggaggagatggtgcactatacaccgcttgtcgcccagggaggatgatgtaccgcctgcaccatagaataatggcatggcttgtgtctcgtagatgcgtctcaccgtctccttcatggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgatacccggaactctagatctgcaatcttcgcctcggtatctctcttactcctcatccgattcctgtacgtgtggatgtcctccttgaaaccaatcttccaagaaatcacccctttccctcgtgttcgtcctggatgctctggagtctgcagggcgagtgtcagctcgtccctatctctgtccggtcagaacgtgccctgagaggaggcttccactgcatctgttagtcgtcgcgcagcctctcgtatctgatcgccgaagaccagtgagccatcagctgggttaagcgttccaccgtgagcatagtaccagaacttcgatcgttccggccaattggcggttgccggttcgatacccctctcaatcaagctagcctccatctcctcccacttcggcatcgcgacgctatagcctcctaaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttcttgtacagctctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccacgtgcccttgttcttcgccagtacaccgtactgataggcacgttatcccgcacaacccaaccgctgtgacgtacatagttcttggcggcttcggccggggcactaggacgtccatcttcttccacttctgttatgatgtgccgaccctcaagcttcttcgctgcacctcgttgcccgtgtaccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcatgtgtatatgctaagtctaattaagactacaatagtcaattgctaggagtcgcacaaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatatatatattgcatttcacgttcacgttcgttcgctcgttctcattcacgttcgttctcgttcacgttcgttgtcgttctcgttcacgttaattcgttcgatcgttctcgttctcgctcttgttcgttcgatcgttctcgttctcgttcacgttctcgcggcaacgtacgttgacgtgttcgttctcgctctcgttcgtttgatcgttctcgttctcgttcacgttctcgcggtaacgtacgttgacgtgttcgttctcgttcatgtgttcgttaacggtggtgtggcggcatcgggccggcgcttggcgcggcggcggcgtggcgacggcggcggcggcggcgacggcgtggcgacggcggcggcagcggcgtggcgttgcatgcggcggcggcattacgcggcggcgaaggcggcggcgtggcgtggtggcggcggcgttgcacgtgcggcggcaaaggtggcggcgtggcatgccggcggcggcgtggcgcggcgtcagcgtggcgcggcgtcgtcgtggcgaggcgtcgtcgtggcgtggcgtctcgtggcgggcggcgcgatagagagagagatcgagatcggagatcgatgaagggagaggcggcggcggctcttaccccagagatgcggcggcggcggaggaggcggaggcggcggcgaggacgacgagctcgagacgacggcgagatacggcggcgtcggcgcggggatttgccctaggcagtggcggcgaaggagagaggccgagagagatcgatcggccgaaaacgttaagtgttggtggagaagacgagggcgcgcatcgggaatatatatagccctcgatctttactcccggttgatgagaataaccaggagtaaaaaaaagatctttaatcccggttgttctcaacaaccgggactaaagatatctttagtcccggttgtcctcatcaaccgggagtaaagatgttttcccgctatttccaaattattttttaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatacatacttagcatatgaatgatattattaaattggtaaaaactctaattaagatatgtatgtacatactgcatgatttaaaattaataaaaattgtaatcatcatatatacttagcgtaggaattatattaaattaaatgttaaaaactctaattaacatatgtaaatgccacatgcatgatttagaccttttaaaaattcgaatagtcatatataagtagcatatgaaagatagtaaattaaattgtgaaaaactctaattaacatctgtaaatgccacatgaatgatttaatacttttaaaaattctctagtcagttataattagcatatgaatgatagtcaattaaatgtagcatatgaatgatagtaaattatgccatacatcaattgatttatatggataatcaatacatccaaaataatttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaacttcgacgatttttcttttgcctgggagaaccacttgacgcttaggctcgtgaggccctctgcccttctttcctttgctagacatgtccttcacaaaaaagacttgcgttacatcattggcaaggacaaaaggttcgtccgagtatccaaccttgttaaggtcaacagttgtcatacaactatcatcaatcattacgcctccaccagtcaacctaacccattggcaccggaacagaggaaccttgagaggaccatagtcaagttcccatatatcctcgatggcaccgtaatacgtggcaattgttccatcgtgtcccatggcatcgacacgaacagcgctgttttggttcgtgctcttcatgtcttgagctctcgtgtagaatgtgtacccattgatctcatatccctggaatgtcgcgatcgacccagacggtcccctcgccaggaaggcaagttgttggttgatcgactcgttacccatgagatgttgtcgtagccatgtgggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtaattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaagcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctagaaggataccccttattacaactggtagcagttgtgtcatcaacacgtgacagtcatgagactttaggtttgtgaacttcttctccttcatgcttattattcgcttgatattcgtggagtatccagacggtacctttatgctctccaagcattcaaacattctttccttctctgccttgctaagagtgtagctggctggactcaagtaatggcttcatttctcctttggttccgggtgaaggtcgccgcattgttccatatgcttcagatcattacgtgcttccagtgtatctttcgactttccgtatacacctaggaagccaagaaggtttacacaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccactgcgatgtttaggcttcgtatggtggtcggccttatgttcgaagtgcttgcctttcttccataccgggtggtttgctgcaaggaatcgacgatgacccatgtatacaaccttcctacagtgcttaagatacgtactttctgtttcatccatacagtgagtgcaagcctcgtaccccttgttggactgtccggataggttgctaagtgcaggccaatcgttgatggttacgaacagcagcgctcgtaggttaaattcctcctgtttgtcctcgtcccacatggggacaccttccttcttccacaactgtttaagatcttcgaccagtggtcttaggtacacatcgatgtcgttaccaggttgcttggggccttgaataataatcggcatcattatgtactttctcttcatgcatagccagggggaggttgtagatacacatcgtaacgggccaagtgctatggccgttgctcatctctccaaaaggattcatgccatccgtactca

SEQ ID NO: 42891 - DNA, 17029 bp, Oryza sativa
  unsure (1)..(17029): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatttatacatacttgtaagcagtcagccgcaagaaggatgctcccgatggtaataccggcgttgatggcagtttgcacggtgaccaccaagtagaacacccatccagatcctgccaagagaagagacaaaattgaattaatgacactcttaatgatgaggtaattaatctctacatttagaagaagatgaggtgcatgcggaccgaggacgtcggcggcgagctcgcggaagcggatgtggcggcggccgtgggcctcgcagtggtcgaggaccctggacatgaggtagtaggcgtagaaggtgacggcggcgacggcggtgagcgccaccaggccgagcgcccaccccatcccccgcagcgcgtacgggagcgtcagcaccgtcggccccacgatcgccgtcgtcaggtggaacccggcgtgccaccacttccctggaatcataattcaccaacaattaatccaagatatatactcctccggccatatgtgatgtgatcaggtagtagctaggttaattaggtgacctttggactcgagcacgaaggcggcgccggcgtcggcggcgggcttgatgccaaggcggcgagcgccggacgcggcctcgacgtcgaacaccgcggcggagggcggcgtcggcatggtgttcatcaccggagagggagagcggagcagagggctgcctccggtgccggccatggatctacgtcgaggtcaagaagaagctcgcatctcgctgaacacacttacaccttacagccttacaggggtatggtatgagatgagacgagaattgaattgtgtgtgcgttttgatttgagtttcttgtggattacaactacaactacaaccaggacagcgcgcgtgaggaagagaagtaggcctgaaaccgttgacctttttctttttgacaagaagattattgaaggagtcttgactgtatcccactcccaccccacggcgctggagacacgtaccactcaaaccgtgacgcttcagtttctcatcaagccaactaaccgctcatgcgttgcaggagacccaaggcagatacagatattatctactaacagcaggcagcagcacacatgtagattataccaacaacatggaacctatactgacaataaggatttctaaactaaacaccactagcctgttttgtactccctccgtttcaaaatgtttgacaccgttgactttttagcacatgtttaaccgttcgtcttattaaaaaaaattgtgaaatatgtaaaactatatgtgtacatgaaagtatatttaacaatgaatcaaatgatatgaaaataataaataattacttaaattttttgaataagacaaatggtcaaatacgtaataaaaagttaacggtgtcaaacattttgaaacggagggagtagtacattagataaatgaagttgaatatcactgtatttatctactgtgggtaaagtacaggccaatggggaaactataataaacttttgaggggatgtcccctagttatatttgcatgccacttaaacaattatgaaaaaaattaaaaaaattgagaagatgtattaatatgtgatatatcacttcataaacatgcaactttaaattcaactcctacatatcgtaacaaaaaaaacaaattaaattataactagttaacgtatatttatagtcaaatttattcttttttcgttttgacatgtagaaattaaattttaaattgcatgtttgtagagtgatatatcatatgttaatacattttctgaatgtttttaaattttttaataactatttaagtgttaaataatatggaagtagagattttaaaatccactctccaggcaaacgctacaatgcagcccaacccaagatattcagagagattatctataatcatcttgcttagcgtgcaggttgtactaacagcggcacacatgtagagatgtatagtacgtagtataaacgcaacataacacaacctgtactgacaagaacagtactaaaataacactagctctgggatcaccacttgcttgttttgtacagtacacaaatgcagcgataataaactgttcgttagttcgtacagactagagggatcagtggggcgtgctgaaaaaactgtaggaaatatacaggtcaacgctgcaatgcccaacgagcaacgatacacatgcaagatgcatggtactgtacgaaaaatgcctccagactccagccaactgaagatggaattgttctggcagataagcagctgtgcaatgtgcatatataatgcgaatttccatattactcctcccatcccaaaatataaatatccaagtacttttggctttccatatgacatagtagaagtttgttcttaaaaaaaaaatctactaacagatcctttacaatgtataacatgttgatttcagccccccaaggtgttcatgtgccaaaacactgttgacaaggaaaatacatttatcgattaaaaaaagcatattaataaaaactggaatcacaacagagtagtacgttattaaatatttcgaaccatgcactggtaagctcatgcatgttttccatgattgagtaatataatggcgcatttggtcagccaaactagagttgagtttcagtataaaaaacaaatgtaatacctttgtaaatgaaacctcaagcccaaatcatcaaacattcacatctgccacctagcaaaaggtggttaagattaaatatttacaactttacatacatgtgtaatataatgtaaaaaggcactggtatagcagacatattacaagcccacaacgatacacacccagaatattgtctatactctattgctctgtatcaacaacatatgcaggggacaggaaacaacatacccagacacatgaggaacttagagctgttcgcatgcttaggtcatatatacctaaagaatgcttcaaatgaagtaatggaatttgtacgacaatttgtcaactttgaatgagtaagtggtaaatatatataaaaaacaggtcgtcttaggtactcgtgtattactgttgctgcacactcaagcttcaagaagtacaatctaaaggcttcttccatgccacaatccaatttaactcccttgacagcttttacgtggaaatgagtttttgcaaagcaagggaacatcatcagagccagagagctaacttttctcttcagggacgtgcatgccaaatccacgttttaacttctcaactctgatcattaaaatttgaaattgttagtgcctggttttaagaaatctgatcaaaacgtagttgctgataaaatttatgttactgagtctaagcgttgacacgggagtaatcattatgaatagaagaaactagtaacacaaaactctcgtaatttcatccaaaggaacgatatgatgagcttgcacaatatcatctgatgatttacttctacgtatacaatagactacaaacaatgaaaatactgaaacaaccacagcaagatgaaaatagctaaaagacaaggttatgcatagagcgctctattctttggagggcaaaagatccgatgcccgtaaattgtggacaatgaagcttggataggacataacgaccaatctagttagtacaaacaaaaccggaaatctaattaaagaaataagaccagacaggttggaagagttgtaactactatgcacgcaagctgaaagtattgatcatgtcatgctctagtgttctatagctaaggtggtgtttggatccaaagactaaactttagtccctgtcaaatcggatgtttggacattaatttggagtattaaacatagactatttacaaaactaattacataaatgagaactaattcgtgtgataaattttttaagtctaattaatccataattagcacatgtttactgtagcatcacataggctataatcatggattaattaggttcaatagagtcgtctcgcgaattagtccagggttatggaatggtttttgtcaatagtctacgtttaatacttctaattagtgtcaaatatccaatgtgacagggactaatccaaacaacccctaaatttcctctggcctgttatgtgagatgcattagcttggcctacatgtgcagagaggcagagactacagaggacttttcgtattctgtgattacagttgacgtgaaaagggaaaaaaaatcatgtacagtcgttggctgcttgttattgggtttttatatntagggtgtgtttagttcacgccaaaattggaagtttgattgaaattggaacaatgtgacggaaaagttggaagtttatgtgtgtagggaagttttgatgtgatggaaaagttggaagtttgaagaaaaagttgagaactaaaccaggccttactttgaaatgatatactcctattcaacaacaaattaactaattctttggcatagatgatacggtgcattggaggccatgatttcaaaacgtgggacacaagaacaacaggtgcaacatgaaaacacactgcaattgactgaattgcctggtattcatgtttgttgatgcctgatttttttttttgttaatctggcaacataaagatctggttgtctttagctttgtcagaagatgctgtgaacctgtgactacactagagctatttgactagggttgtttaacttgaaagatattgctgctagatcctgtccagcctagatcttctgtcccctggcacaacatctttatttatttaaaattttgcatttttctcatgcttttttcagttagtaagctcgggcttttcttctcttattggttatgttgtacagagttgtttcaccagtttggcatgtgttcaatgccttaccaatttaatacatcttaagccatgatctgaaccttctcctggctcttctattcttgttggatcacacactcaactcccaacttcaataattagtcagactctgttcattaggttgttctttaaaatgactagtgtaaggaggccaaaaggtgaaaatattgtgcaagaaatgaatggacactacgtgaccacaaaatactggaaatgctatttcacatggtgttgttcgaactgagctgaagaagaaacttacgtaggagcaagctttccaagctttcgtaattttttgccagttgtttcatcaatcacatttccattgatctcaacagaatatgattttccagatatccgtgggagacctcttcctgcaagcaattcaaagtctttctgatgaagttctctaccattgacaataactcctgtgttcccaccggcacaatttttcggcattggataattaaattcctttataaatggctgcaaaaacaaagctctgtcatgacgtgctaccacaaagttctagagaaagaactacgagaaaaataatcatcttacagggatgatgccactacactcatgtcccatgacaccccaaaatccagcgcggtagtcatacctgaatcacaattagagaatacggaatgttaccttacacggaaattcccaatgccttgtgaatttaagttggtgaagatccaacaaagttgctttggaaagtacattaggtagatgatattcccagagtaatttttactgtactaactttgcattttcctcgtctttgtatactaatcagattaattttaaaactgtagctggtaaaaggcagaccattgaattatggagcttgcatgtcgcaagcatgcagatgtgtgaaaataaattatagttcacactgtaccattacgattaacaataacagaacaaaactaatgttgcacatagttactgaatgccgagacaaagtaagaccgtgataataaattaacagatgttaatacatgaactaggccatgcaagaaattttttgagctactagcatttaatgggagcaatcaacagccaaaaaaaaaaaaaaaactctgcaggacaagaatcttccaggtatctcatcactgtacaaaatgttctagtaatcaactcagggaagtggttgatttggctgagaaaagttatcaaggaaatcaggtacataggttggttaatatgcaattgagaattacacagtcatttaatcaccgctgtgcagtataagtcatcttaattcctactgttaagatagattcttctgaagaataacaccaatctcttttgcctgtagttgtgcgtctcttgatttcaaaggcaaatgataaaaagatgctaaagaaaacaatgacaagtgccaacacggtagatatcaaacgctaagaacatcagtccataacaatttccaaatttatgaagggagaaggtgacttaccaatatgaaccagggccaactggaccagacttcttctcggccttccgtaggacacgttcggagattgaatggccattgattgaaaccttagcactgtccactgattgattgaacaaagaaatgtccttcaaacctttcttcaaaaaaccagcaaaaaactttgaatccccgttcttagtagctgcagactgaacttcgtctagttcagcctcagaagaaacacgagaactagaatttgtgcgctcattaactgatgactcaagcttcgatggcattatggcatgttcagaatttggggagagcaattcactataacaatcatctaagtcatcttgtttgcatatcgtagctatagtttcaacttgaatgacactgttattatcttctttgctgcatttgctatatcgctcagtaatgaattctgattgaaagttgttgtcatcttgtttgattttttcttcatactttttgctcacgtctccatcttcaaggctgctggtatcatcattatcagccgtcagcttgtctatgttacccatgcttccatcatcacaaaagccacttgtactttctttgagcttttgctcatgtctactgctgacagtttcttctccaaatccttctttatgatctttgctgttctgctcatatgtcacgtccgatctttcatccctaacattagcatcaacagaatctgccatgatatttaggctacattccttgcttgtgcgatctccaccactacaatcttttagacgactggaaaatggatcgacacatttgtcctctataactggggcctgtagattgcctgtattaaatgctgaagtttctacttgactgtatgcatctccttgacatagtatatcctttgggatatttgcaagtctggaccttctaacagatactgatagtaactgactgctcctgtttgatccacactctttgtctattctgtcataactagaagtagaagacacagaaatattgtctgcaagatccttgttctgctgccatctctcttgtgcttgcagcttatggaaactagaatttccttcatcctgatgttggtaccacccaaaacttttgttaacctgacgactggaactccccactgtttttgatgcagggaaagatgtcggcgcaaccaaaggatgaattttcacttccttaagcttgaaactaacgatctccgagcacgaaccacaccgaacttgaatctgcttccgagctgtgcatttcccaggaggcagctgcagcagctggttacaagaactgcatacaacgaaaggagcggcgcctctcacaggacgacagaaactctctgccttcttcctgaaaaactctgtcctcctcttcgacaccgagaaatgagagtacaatgacgaagcgacagacctccggtcaagctccgatgagactgatggggacctatcgaacaggtgagacccctgctggcctgcaaagtacctcgtcatgggaatgtgctcctcctgcatcacagctctctggccatgaaggcactgtgcacactggcaggtgctctgatggtgattccccccaagatacccagaattctcccactgcctctccggccattgccggaaccgcccactcggctgcctctcatacctatctctatgcatagaccgatgcagctggtcattcggactgtgcggaaagccagacccgtaccttcccgtgtagcgtgagcggtagtgctccggcccacggcctagcggcggcggctcggcgtgcgaggggcgcagcgaggccgtgcggcggctcatgcggtggcgctcccgcggctggtcggtgatctcgcaggacctggtgatgtggtcccgcagctcgtcgagcttccggagcagctccacggggttctccttgagcgcgccccaatccagcacgccactccggtcgccgccgcattgcccgtaatcgaagggctctggaaccctagcccttctcctgtacttcatctccttcgcctcgctccccatggcgcctcccacgggacgagctttccccccccccccccccccttcgccgaatcgaaaaccctgcggggaaaacttccaatgagtcgctcgaaattcgtagccaccaaacacgaaatgggaagacgccaatgtagatcagagcagcgaagcttctgaatgctacggagaagcggaggaggcggcggtggcggttacctcgaccccaatgttgcggagcacacggcggcggcggagactctacggcgcggggatgcggagaagccaccggcagcggctcgccgatagggctacgcggcgaggaggaggcggtgggacgtggggttcgccattgtggtggatggagtggcggccgcgcgctgcggcggcgagaggaagaagacgagtgggggtgaagtggaaaagagaagcctaaatcggcgggaatccagggactggtttgtaattatcaactttctagggggtttcggcgcgatgtagctttgggtttcagttggggatgacctggctgagacgctgacgaggtgggcccacgtgacagctggtctgatctggctttgactagaaaagagcccccctttcttaacgcgccattgcttgctttatgtcaaacacagtaacagcgtgattagtggctgtgctcaacaacattaatactccaactaaaagtaaccaaaaataataataataatcggcctgtctatctatatatctatctaggtgagtgaggctgcttgtgtatagtttgtttgtaattttaaaatcttttcttttcattagcattcgaaggttcatctcataatttggaacgcataacaaccacatgcttttcgcaaactatgcaggagttagcttgctaaatatcatcctaaggggagttgacagagatcaaataattcgattttaaatctacatgtgttgtacggcgcatttttgcgatataaatttgtgtatcagggggcagccccttgtaagagccgcaataaacagtggttagtgcacgttaacaaatgagctctcgtggacctcatttttttagtgaggtatatatctcatttcttcaacaatactacttgttcttctagctatagtaatatatgagagcatacagtgtgttataatccaagcaatcagtttgtcaacgacaaaccagacgaatatatggacctaaacatgtggcatgttcctgtttctttattagaattttgtcaggttatattccatcagcatttgatcaatatctgacacaagaggctgaacattcattacaggacgttttagccttcaaacacaggcggcattgacaagagcctgaaaaacatgcagtgctacgaaaatgagaaagttcagagagatccaaaactgtactacttgagtatttttttttcttctggcattgatctgtatatctattgagttttggagtacatacataatagttaaacctgaacttacatttttcagatgttgaaacctgaaccaaaattgtataattgggtatatcttcagacagggaactgtaatggctgttgggttctggagtacacaggatagttaagcctgaacttacatttattcagataatgaaacctgaacctgcatgattgtaaatgtttccaaactctaaatgcttgcatgctaattaaatgcaatctagctgtagctgcctaatgcaggatacaattaggcaagctatgtggacaatgaaggttgagattaattagcaaagtaatgaagggagtggggactgaagaaaggctgaaaagtggcgagtcatgtcatgggtgatgagaaaacagcgaagcaatgcacctaactctcgaggtcggaagtggccaaagaagatcgatcaccaaacaaactagttagggggcgccaaccaaccaccgtcaaccacagacactcggacagacagctccaaaagatgcagatgccagtgctgcacatttggccacatgaaagtcgcattcaatttgcttaattaaactagtaatttgcctgtcgaatagcccatgctacaccgacgaccgtcggtcctcttctagttttcagatgagtgtgtcctcttaacaggagaagatttgcagctttttcgtgctgaaaaaacggtacggacagtccggtttgtgcgctgtttgtatccaagaacatgacgaaattagttgaaaaaaaaagtggtatctgaatgaagaataaggatgtgtttgtttctgtccataacattaacattttcttgatctgaaaaaaaaacattagtattttctttcagacatatatgtattgtaagatattcatacgggaccaaatcaagtgtacatgcgattcagatttgtagcatctgtgaaacgactgctctgcaatcatattcgtttcagtgtctccttttctaactgtatccatatatgttcatgcgtgaccaaaattaaaaataaaaaccagacatgcattatatctgtttcactgtttgcctaacagcaaaacagttaggcaaacatcacatgggtagcccactgttagccttccgctgatgggctggaaagtcgaactgaattcacggcccaccccctgaggttggacggggccggaagcccgcgtgtggagatgggccaggccggttacttcctctgttccgagatcaccgcctccaagctcctcacagtcacagccacaagggaattgaagccgccgccgcctcctcgtccttccggccgtgtgctctcacgcagggcgcggcggcggcgatcttctgtgctagcgtggcggcatcgccgttgctttggaggtatgagctcctgtcctcctgtgcctcactttccccttcatatctcttggcttcttcaattttttcccgtgcaaccattcagaatttgtttttgcctaaacattcccatctgtcatagaactgctcctttttctttctttttctttttttggctcaattgctatgcagcgataggccgggcattttcaggactcaacctgggccgaacacgaaacctacaactgggctctgtctgcaggcctaatattacaaacttggaagaaaaaccacacaatttcggcggtgacacggcggcatacatacatcatcatcgatatgtctttaacgcagtggagaattatcacgggcgagcggcacatcaaccgatcaaattatcgatcttgacccatgccatgcaatggcgagcttcacatgtccaacaagcaaaagcagcgaagaaaaggcatccgacgatgcgaccacggagcagaatgctaacaacaacatagcagtatatgcatacggaaggagaaagaaagaaaagaagaaaagcagaggcgaggagcgcctcgcatgtgaaaaaaataactcaccggccgggagatggaatggatccctagctagcttggcggtcgaattcatcgtcctccatcgccgccgccggcagctggctcctctctccgctcccgtgcatgcatcccccatccctttttaattaaagccatctgtctagctagctcattcagaataatcctctttctttctcccatctttttagtttttagctagctttgcaacagctagagagcacagttcagttcagttcagaaattcatattcactgagattagcaaccatgcacacgtacgatgtgtgagcctcccctgcatgtgcccgtcgtgagttcatcaaagcttgatcgatccatcagctgtttcctctgatcgctgatggacaaagaggtagcatacacatgctgcttgttgagtttgaagcaaattaatcttcttctttgacatgcatgcatgttgagttttttttgttattttgtgtgtgttgtgctaattgtgttcaatgatcatgtatgtattcatgtaggtgcagcagagaagccacctggagagatttgcggcgctggacgaggcgccaccgccggcaccggaggagaccgtggtcaccggcggggagatggtggactacatgctgggacagccgccgccaacgacgcccgggccgcagagccaggtgtccttcgacaagctcaccttctccgacgtgctgcagttcgccgacttcggccccaagctcgcgctcaaccagccggcggcgtcggacaacggcggcggtggtggcgacgacggcgacgacgacgacgacagctacttcctcaggttccagtcgctgccgtccctccccgccgttccccctcctcgtggcggcgccgccgccgcgcatcaggtcgttgacgagcaggagggcagcaagcagacggtcgacgccggcggcgtgtccgagagcacgacgctggtgcagcaggctgacggcggcggcggccgtgcggagaaggccggtgagcaggggaagagcgggcggcggaagcgtccccggacggtcaagacgagcgaggaggtggagagccagcggatgacgcacatcgccgtcgagcgcaaccgccgccgccagatgaacgagtaccttcgagtcctccgctcactcatgcccggctcctacgtccaaagggtaacctatatcgctcggcgtcgccatggcatttgatttgatttgcacaagtaagaacacacatgatgatctgaatctgatcgatctttctcgcatgcatttaatttagggagaccaagcatccatcataggtggtgcaatagagttcatacgagagctggagcagctgatccagtgcctggagtcgcagaagcggcggcgcctgtacggcggcgacgcgccagcgccacctgcacggccggtcgccgacggagcagttctgccggcgcccatgcagcagccgccgccggcgacgccgccgttcttccccccgagcatcccgttccccgcgtcgtccggcgccggtgacggtacaggcgccggcgtggccaaggtcgcactggacctcgacgcgagcggcggcggcgaggtgggcggcggggtccgggaggagatggcggagaacaagtcgtgcgtcgcggacatagaggtgagggtggtgggcgtggacgccatgatcaagatcctgtcgcggcggcggccggggcagctgatcaagacggtggcggcactggaggagatgcacatgtccatcctgcacaccaacatcaccaccatcgatcagaccgtcctctactccttcaacgtcaaggtatatataaaaatcaattactattacactctacaatactatcgaattatcatctgaacaaacgaagaactgttacattaatttgctacgcgcgcgcgacagatcgccggcgacgcaagattctcggcggaggacatcgccggtgccgtccaccagatccttagcttcatcgacgtcaactacacgttatgaaatctctctcttcttcaagattgtgaaaaagggggtatatatatatatatgtatatgtatatgtatatatatatatatatatatatatatgtatatgtatatatatatatgtatatgtatatatatatatgtatatatgtatatatgtatatatatatatatgtatatatgtatatatatatgtatatatgtatatatatatatatatatatatatatatatatatatatatatatatatatagatatagacacacacacacactatatttgtgcccagcgagtgggtgtgcttagcttatgtgtgtagactgataactaagtatatgcaatcaacttatttactatatatctgcactgcattatatatatgctggtgttcagtgttcaatgatagtatgtagatcgagatgtacccttaattaattaactataggagttacctaattgaacaagattatttgtaagcttggatgctgcttctgtgtttgtatggggctacagaaataaaatttccattgctctctttagtagtgaatacaatgtcatatatctgattaatgacgccatatatctgattaatgacaatacattagctaagtgtaatattatggagcactagcactgttcggtgatgtagaaaggctagctgtgttaactgttaactcctaaattaactggttgatggattttcatcattcgaggatatatatatatatctgtttgttttgtgcatgtcacttaaaaaattatcaaaaaattgaaaaaatattttgacaagataaatcaatatatatgagatatatcaatccacaaatatgtaagtttaaattcaacctatataattagaaaaaaaaatgattacaaatagtgtgtaatattcgcaatcaggtcttagcatacaatgttggtacatatggaaacagttataaaccatacaatgttagatatactagaaaaaaatacctgtgcgtgcaacgggtgaaggctattttaatcttattattgttatatagtatagttaagataaaattcactgcattaaattcgcttagatatatattttgttagaaaatcatgagctgcaattagaagtccgatcgtcttaaattagcatgcgagttttttaaagagatttcttatacgattctttctgtatttctaaaagcgaacgaacttaaaaaccgactcaaatatggatttgtatttgcaaaagcgaacaaatttaaaaactgactcatacacggatgacgtaccaagtatcggaaaaaacaacttcaattcttataatagtagagatttaccttcacttaaagatatagttcagggaaccagagaatgcaaccagcaacacagaatcaacaacacaccagcagtagaattaacgaactaactcccaactaggtcgtcccattagcgtgggaaggaggagggaggttacgaccgagagagctgagccggggaggaaggaggtggatttttgactagctagaacatgattaacacagttctgttcgcgatggatttttgaaactaccatctccctgttaccagacatgaggtgcttgatcgatttgggagagaaattcgaacacgaaaattggaaactccgatcgacattattctgaaactggatccatctataagtgtaagagcaattttatagttcttgaaaagatatcatgaggtatcattttttttattgtaaatttgatatacctcttggtacctattaggagtactaaattttttatgaggatttttattgtgcatggaaggtaacgtaacttttcccatgatggatatctactgttgatttatagaagggtaaatgaggaaaaacagaaaaagaataacacagacatgtacaatttagtaattcttagccaataatcttttctaacttctctcattaccattatttgttgctcacccatttgattacttcatgtcgatctgccgcttataatcgctatgtctcattgatagatgttccggcgtaaaaaaatcctaaaactaaatcttttcttccctccctgacactaatcgctatgtcttcatgatagttttttattagagcatactctgttattatcttcattcaatccacaaagacaaggacatgtagaattcaatcatatacccttacaagatatttcaccaatacgaactatgaggagttgcataatatttttttaattttgtatttggtgtacataattacttggataaaagttttagtttattttacgaagtccatgtaagattaataatatataagtataatattcactaagtaatctcgattacctatttgaactaattgcctattttcatgcgtagttagttaccgagcttatcttcctagcttgtttgaaataatcagggccttttaatttggagatttgctctggtctaaaaaaataccttgggataccgatacatcacggtatcaaattgttttcgatcgttggattttaaaatctttaatctgggtctggatctcagatcaagttgttaatctgttgcagtaagcaagatgttggtgagaccctgcgtcagaagcatctcaaaggtgcagacatatctttttccttgtgttatttatggtcaagccagaaacaaaagacttcatgcagaggccaaggatggcctcggttgaattatatcatcttgatgtaattgattgagtcttaataaagcttccattattttaaaaaaagaaacaaaagactgcaattatatgatcttaagagcgatccatcaatgtttctgatgattcacttttcctatgtccgtatgtcatctttcacacacttgttagctgaatgattagagattgatatcactgaattcttccgtatctaacatacaaaagaactgaaccatatgatgtttagatgagagtctgaataatactttgcagcacttgttacgggaaacaccacattttctttcctgataacatcaccatactttcactagagctgggccatttacatagattctagatagtcacaaacaggataagaaaatagattattcaagagactaaaccaaacgttttcttccggtggagactacagtaaagctgaaaa

SEQ ID NO: 42892 - DNA, 2218 bp, Oryza sativa
ccaaatttctaagaccaaactcaacttcgtttggaagattaaaagaagacaaattctgcatgaaactttcctatcactatccgttcaaagtttgtatttcttgtatcttgcaagcaaatttgaatttggtgttgaaatcttgtggagatatagaccatgcctatacctacctctaatattttactcacaatttttttcatgattgtagagatcttttacgtcctgttttgagaggtttgtatctattattttcacttgatcctcttaggatatgtttggtagggctccaaatttagagctagagttgtggaggtgggaaaaggtatctccacccttcctatgtgtattacggagcagattcattgtagtagtgtttggttcggctccagctctactgaacaaggatctaggagttggagttctgccaaacaaccccttatactagtgtggaatatgaaaaatgacactattttgccttctggatgaattagatagatagtcaaatagtatgttaatgcagctatgtccaaatcgatttgaattatgtagtgagtttctccctccatctactttttatagtcatattttatcttagcacacagacaaacgataagtaattctacctatcatctagttaaacattctactagtcattcctcgtaaacaagcgattaattaatatttacatttctcaatactcatgtagccaattatgtgtagaagaatagagagtcacgcattaaatctgagaaaaccattaagatgataagttgttggattaaaatatgcctatcaaaaataaatttttcagatttaaaaatatgactatcaaaaatagatagagggagtactatgttttatgtggtgcaggtcggaagatgctttcagaagaggcatgaggaatataaggtttgtcattgctgttaatgccgctatatggtgttccaacatttactatatgatcgtcagcgctgccatggtgataagccaaagatgaaagtaggaacttccaggaaccatgaggtgggctagtttgtgttcccctaattgtgctttagactgcactgaacaactaaatattaagtctgtatcccttgaactccgtaccgatcaaatatggagcctggaatattttatttgttttatatgttgaagtgatacgtgcaatatatatatgtattattattacaaggcttctgttatggatattacagagagtcatctcggtgggatgtactagaaagcaggggtggtctgttttgtttattttgaatgaatgggtttattgttggcttattgtaaattgcatttcagcttattccatttttattcacccgcgttgcattttaagcatattatgtcgttatggttgctctattgtttttttttctaaattgggccctttcccttctatttcctccatcccacaatatcataaattttgttggacattaaacatgttcagattcgccaacttagattgttatattacagaacaaggagagtataaaattgaactttacatcattacagacggacaggagtataaaattgcatcagggagagacgaaagggaggaagaggctgacgagtggaccccacactgttttccacctaactttgccacgcggacaaaagtggcaaatagttaagaccatcttttaagaagggcaaaaaattaagtgtaaacctaaaagggtatttaaataattaccaaacctaaaagtggcaaatagttaaattcccctgtatcagcatacagttactggtttgtctctgcctctctgcacgttatcaacaccgttcgaggactttttttttttaagataataaatagataaaaatctagcctttggttcaacagaagctagctacattagagttggataacttaaggtgcttaattatacacaacagctgcccatacacattaccaaggataatcataaaggttggttgcatgtttctcatatcgatcgccggtgcttctaaacctcatcttcgtcaattcgacgcgatcatgccggcaacgaagtagcctgaaacaacggctgaaataatcacagccaagttcaaacgtctgtttgctgtcttgagccttaagttgttatatgtcacataaaggcaggggcagcaaaatgaatatagtcagcatatatatcatagaggagacgttatcaaagtatatagatagttggaatatgtatatataccctga

SEQ ID NO: 42893 - DNA, 17275 bp, Oryza sativa
cagaattcggtagtagaagaaaaggtaattttggaggctctatgaatttaccaatcaacaatgttcatttgggaatcttgtgtccagataacttcagggcctcatcgtttggcatattcatatgcttatcagctaaaatttgaattttcaacattagatttggagctgattttagggttttttcatcgaagtttatttttcagcctttgcttttagatcgctaagaacacatatataaaagttttatttacaaattgattttcgtttgcaaatatgccatgccaaacgatgaggctgtcaatcttttaagacgaacatgattttctggcaggttcttatccaaaaaattcaggacgcaatctaaaagaaaataacattgtatacttaactggtttagagttgacacttacacactactgctaaaaatgcaaatactcccttctcagtatcatcattgcaagctagtttgaggagattaggccctgattgaagttactaacatgtctatcactctttcaagcacacaagttagctacatgcatttgtactttcaaggaaggagccaaccaatttaaattaccaatccaattgctctacagttggatttcaagcatggtttggattgtagtaacagatagagcatgcattaagtgggggtaccttgttgttctttagggcagcagatgcatcagagttgatgaggcgccggaggaggggtccgtgctgaaaccctaccggtgaagccgtcgcacccagacccggagacggcgaggccgccaccgccgccgagaacgcgcggcgcagcgctacccgtgccgccatcgccgtccaactccaacacccgctgcttctattcttcttcctcctttttttttcctttgggaattgggacgcttccttccttcgtaaggctctccgcgtacgggccgccataccaggttcgggccttcccctcgagttcaagcccagcccgaaagtcgaggaacaaaaaggatggcagaattcaatccaaactctgaaggaataagtctatttttcctccctccctctgttgccctcggtcaaactgtatccctccttcaacttcaatttgaaccctaataaattttagtaggataacaaacaacatgatcttaccaataacaacctatcaacatttgatagtttcagaactttcctcataaaaacactaccattttttttagattacacggcagacgcacacgcgcacacacaccactacacatgcaacaccactcaacacctccacgaatgcgtcacctaacacattctctaagagatggaaaccagcggcacatccctgatctcactaaatacatccaaagttattaaaatttggcaatggtaaaacctcccaaaatctagcattctgactttcatcttgaatgtaagttgtaatgctctgttcgggagtgagggttacgaaccctcactctccgcacgcaaaacgaaacagcacgtgattaattaagttttagctatttttttaaaaaaaatagattatatgatttttttaaaacaactttcgtatataaatttttttaaaaaaacgcaccgtttagcagtttgaaaagcgtgcgcgcggacgaggagttgggaactactctaacgaacggtataaagtaaagttaagtaaacgtggtggaattgctgctaattaatttggttttttgttcacctttaggcactccgagaacgaaaggaacgtgcctcagtttttgaggacccttcagattgatgccagagcaccgtcatgacaaactcaagtgtgtgaagatactcaatttctcgtctgcaaagagtttggttgagctaacatgtcacattgttgaatcggcgacatcgctcgagtgtcttacgctggacacaacgtcaggttttcctagtagatgttcagtggacaagctgggtaaatgcctcttgttgcgcagagaggtacccgtggaagctcatagagcactggaggctgtcaaaacgttcatcaggttgaaagttccttccaaagttgagttcaacgtcttggagccttgcagccggtgccatgctgctgttgagtggcctttagatgtcaaaaatgtgcctgtggttctaccaaatgattagttcattattgctagtgtcatgttacaagttttgtgttattttagccgtgcatttgtcccgaaactatatatcagccctgtctactgttgaggtttgtaatatgacatggatttagaacatgttacctagtgtaatttcatcttttgatattctctattttctgtgtttgaacgattgttgatttttcattcatcacaatacttatttcaagagagcgtaatctattttctggcactctttattttatgcactgaacaaaaaaaaagagagagtgaaatgtaatgcaaacacgcaggtgtgtaatgtgttacagtttgtgaaaaatgtgcgaaagataattcatctccatacatttcgttttgtttagttttgcggtgcaagaagtagctgaacattatttttagtgtttggtttgctgatttgaagcggtattcgtttatattgttaacgtttcttgatgttttttaagtttttgaagaatcgatgtttggttgctagtatgggatttctgaataatttatagccataggctgtgtttagttccattcacacttccaaaaattctgtcacatcaaatgcttggacaatatatggatcattaaatgtggataaaaaaatcaattgcacagtttacatgtaaattacgagacgaatcttttgagcataattacgccataatttaacaatgtggtgcttcagtaaaacatttgctaatgacagattaattaggcttaatatattcatatcgcagtttacaggcttaatctgtaatttattttgttattagtctacatttaatactttaaatatgtgtctgtatacttaaaaaaatgaaaatgaactaaacacggccatactttatcataactttaacaagtcgatttttttagaaactttaacgattagacttgagcaacctgaaaataactagattgagatggctaaaatgacacatgtttctttacgtacggcaagttgagacgacaagacgattattattcctgcaatttaaactaaataattttcgtgtggtgtagatgaatatagccatgcttagctaatccttaatttctccttagagagaaaagcacggcaaattaatatccatatccatagatagatagaagaagaatcgaggaggagaaggaggaggatggagcagctccggcaggtcggcgaggccatcggcggcgtcaacgccctcatggccttccacgacgacctccgctgcatcaaccctcgccaatgcgccctcctcgcccacgcctacgccctcgccttccgcgccgtcgccggcgagctccgcgcccgcctccgcttccacgaccgcctcaccaaatggaagcccctcgacgatcccctccgcgagctccaccgcgtcgtccgcgacggcgaggcctacatccgccactgcctcctcctcgacccggcccactggtgggcgcgcgccgccgccgccacgcacggcacggaatgcgtcgagcaccacctccacaacctcctttggtgcgtctccgtcgtcgtcgaggcggtcgagaacgtcggcgaggtcaccggctccgaccccgacgagctcgcccggcggcggctggcgctggccagggactacgacaaggacctgctcgatccaaagctcttccgggagaggctcggcgagacgttcctcgccacgcgtgagctcgccgcccggatggacatggcgtggaaggaggacaggtggctgctgtcccagcttctcgacgagaggaagggcccgacatcgtcgccggagccgccattgacgcggcaggagcaccggctcgccgacctcctcgccgcgccgcgcgggaagctgcacccggcgagcgtgctcctgatgagcgacttccacatgcggaggcgcctcggggggaacgggaacctcaaggaggtgcagtggttgggggaggcgttcgctgtgaagcacgtcgtcggcgtcgacgccgaggcggcggccgcggaggtggcggcgctggcgtcggtgtcgccgcacccgaacgtggcgcactgccgctactgcttccacgacgaggagaagagggagctgtacatggtgatggaccagctgatgagcaaggacctcggcagctacgtcaaggaggtgaactccgccaagcgccgggcgccgctcccgctcgtcgtcgtcgtcgacaccatgctgcagatcgcgtgcggcatggcgcacctgcactccaacaagatgtaccacggcaacctcaacccatccaacgtgatcgtcaagccgcgccatggcgacgcctacctgcatgtcaaggtcgccggcttcgtctccggctccggcacggcgaacgcggccaacccatgcatctggtgcgcgccggaggtggtggggaacgaggcggcggcgacggagaagggcgacgtgtacagcttcgggatgatctgcttcgagctgatcaccgggaagatcccgttcgaggacaaccacctgcagggggagaacatgagcaagaacatccgcgccggcgagcggccgctgttcccgttccagtcgcccaagtacctgaccagcctgacgcggcggtgctggcacggcgaggcggcgcagcggccgccgttccactccatctgccgcgtgctccgctacgtgaagcgcttcctggtgatgaataacccggagcaggcggcggcggacgcggctggagccgggccggcggtggactacctggacatggaggcgcagctgctgaggaggttcccggagtgggaggggaacggtgtcgccgacgtgccgttcgagatgtacgcgtacagggtgatggagagggacaagatgagcaacgcgtgcagggacaggagctccgactccggcagcgacggcaactcgctgtggggagatgacagcgccagcggcgggtccagcacgacggcgacggacgcgtcggcgtcgagccggccgctgcttgaccggagcggcagcacgaggtcgtcgccgccgcgcaaggtggccatcgccgccgccaaggcaggcaagtgtcgcagcggcattgttactcgtctaaagccttcctccaagattacagctagctccatgtccgtgacgtgtgcagggccgccgcagaagtcgaggtcgatgggcacggtgaggccgccgccggtcgtggcccgccgaacgccgaggattaagtccgacggccacctcaatagggcggcaattccgcctacccgacggcgtaaatccggcgggaacgcttcagactcggagttagcttagcaaaatgttgggtagccttctttctcatatgatgagaggttttcacttgtttcagaaatacagtatcaaaacgtcaacaatgaaaaaaatttcactcttgtaaataataagcaaacgaatggatggatgtaatgtaatactacagatacttcaggaatgggaaaaggaaatgctggtataaaacgcaccaacattactcggtttaagtagagtatttatcagcagaaacaatcttagacaaagagaagaaaatgatgaaaatcaactattagcagcacacagcatactgcatgagttttcaatctcaatacaccatcacgactgaatagactttatgagttaggcaaatgcttcatgctttacagccaacttattaatttttcccacgggtccagcaacaattaggatctggaaacagtagtaggatataccaacatgggctgagagggccttatgctgaatgggagcctcagtgctatgatccttctacctgcccttcctacaaaaacagaactcaccaccctacaaaaatagcagttgataatgaccagcactaactccaatttcttcagtctgatatcctcatctctactcctagaactttttgcacaaactcgtatgtcacgaatgcaatagcgatagaaggcaccacctgatgaagaggcaagcaaaggtcagcatgtcataaacaagcactacgatgatgatccattaaggttgcaaatatttgaatttttcgtaggaaacattaccttcactgaattgggcacaagacccttgtacaaagcaccaacaccttcatagcgaacagttttcctgaatgcatcgatcataccattgtactggagcgcctctttgccttctccagtaacaatagatgctgcattattccaaccaaccatctgcattctcctcctgatgacatcaagagggtaagcaacagtctggcctatggttccagccacagctccacatccaagccttgtaactacatgcaactcattgtccttgccaagatcatatggatttgtctgaagcagccagtccttcagagactcgtacacagcaaagttgaggccaacatacggaacctgcaagaagatgacaaagataatgtggaaagcacttgtcagcaaggcactaacgaggcaaagctgttaactaattaaagaagagacctaccactccgataacagatggaagccaccctctgtatagagcacggaagccttcttcacggtatactgaacccaatgcatgaaacataccacggtactgataaggagacttttccgtctgcatatatgacatttagaggtcaatagacagaatatgaaacagaagtagattgagttatgctgtgttgacgttgttgatacattacctgcacggtaatcctacccctaaccatatccatcgggtaagtagcagacatggctatgataccagcacaagcaccagctccaaggcgcaatagtggactaagctgagcatcctctgtacagcataggaacatgtcagtgctgaatccagaattttctgttatcaactttatataatacatcaacaagaatataaattctcttgttcaattgaagcagaacattcaagaaatctatttgtacagaaaaagacatgaacatcaggaacccttccagtcaaaaaaaaaacatcaggaactctgctccccagcatttaaattgttaatttacatttttagaacaatactatacataaggaacattggatattgtgtaagctctaagatccgtcacaggctcgcagcatgtccagcagtgttgcacacgttgtcatattactgacaactctacagcatacaaaatgatttggactcagtgtgcatatacagtgagcacggactgagataacgagaacagacactggagataacgtgcgctcagagtattgcactacttgctttgtactactctttggaggtgaggtattcaatctttcaaagttgctaatggattccagtttggtaggtgattcagttacataagcctgtcctctaatagggatttaaaaagtaaaaggcagactttgttttcaagttcaagcggatgaccaacaacttttcttgtgtgctttatcgtcctaaagcaggactacaaaggtcgctagcagaaacaacaaataattagctgtacaaggaagactttgtttccaagttcaagctggtgagcaacagcttttcttgcgctcatcacttcatatcaggactaataaggtttctagcagaaataacacatgatttagctgtactgggccatctagacgaatgaaggtttttgacttattatacaaggcctcacaatcttgaaaacgatcataatatatattgaaactaaaaactgaacaagagatgggcaagctgagtataaaaagtctacaattgtatttttcctatagataaacggaaaaaaccgtagagcagtcatgagactcattacgtagtcaacaaccaaaggtctgcaataacaacatggtgtgtaaacactttcaaaataactaagatgcatacacaggaaaactaatgtgtagtatggtaataacggagagaagcataccattccctgtttgttgccgataaagccataaaattccactgcataaaataacaaagaaggcaagaatacaattactagtgctttcatgaaacaaaaccatattaacagtagagtaaaaaggaaatgcttctgaccaagatcaggtcaaagaagactcatcatgcaacagagaaaaggtctgcaaagtgcaaaggacaaatagcaagtaggtggcaagagagcaagcagtaatgtaggatgacagtaattggaaacaataacaaaccttgatgcttgctcatagctaaaaaacttcacggcagaatttggaacaattctggcacaattggtaccattgcccttaaaaagtccacggagaccctctgttctccatatgtacttaagaccttgaattgtaccgttgtacttgatactgtgagggttttggacctgcattaggaaagataacacgaatcaggtgttagaaccaactcatacaattgcccacacatttccacgcaaagtacttgtacaaatttacaatattaacaagaactggactagggtttagcaccaagtgcagtgtctgtacttcaactattaatacaaatggctatatatatgtagtgaaagaggttatgtttcaagcaagctccgcaaagtagacaacaatagcatgccaccagataagaaatgcaacagcaatgaaaatatcacctgaagcagaatcttcattcgttcgagcggagcaacagcagtacgtgatctgttcaacaaaaaaagtaaataaatattataagcataattgtgtagttagttagaaacgattggtccaagtagattgtcatttgctggtcaagctcgacaaaatgcaccagaatggataacgagaaaagaaaacctgcaccaggtaaacattctagttgatccgtgtgttttgctcaaacataaaataaataatttctgcgtggacttcagctgactataacaacacctgatagcaacatttttagcccaagaataaaacaagttgcaatactcttaaaccgatcttatatcagatgacataattatgcatataattgattattgttcagctttagatgcaagtgcatgacattataaagaacaacatactccatgaaacctaaattattaaaccataaaggtgaaaactaattggagtgcgacacaaacatgtaaagggtctgatgcataaagtgagaaatgactcttatttagaggaattagacagctattagtgaaaccaaactgagatattgaaatgtccaggccagccgcccagatgatttgtcgtaaaactataagataataacagacaagataaaggctgaaaatttaatagagccataggatgaaaaagccaacaccaccttgtcagacacaatatattgctagggtgttggtgtacttatccagataatatattttgcattgaatacaataattcaagtggaacttggttagatcacaggcaaaccgaaccaacaagacggaaattttaatccaccagatggccaggctataccatgacaacgagttggaccgtaaatgcattcgtccacatggcccagtgaaccgaatcaactaacgagtcaacgaaacgagatctggttacctcgttagggtttaagcgtggcgaattcatcataagagtccatagatcacacatctccggaacagacgttcatgcaaaaacttataaccgcacacacacaacatagccgaaacaaatcgcgacgaggaattaaaaaaatggtaggacacgagaaccacaaatccatcaaggatcaaacgcgaatctaaaggaaaccactgaatctaatccgggagccgcgcagagagaattcaacacggagacgatgagacgcgggcatggagaagaacaggggggatagatagatagatagagagagaaagagtgagggaaactcacactccaccggcgacgccaccggcgaagagagacttgcagatggagagcacctggtaaccaggccccttgaccccctcccgcgcgagcttggcctcctccgccaggttgacgatggtggtgaccgcggtgtcccccctgctcttccccaccacgtcctccgatgccatgtccacccggcccgcaccgcaccggatcgcccgctcgcctcgccgacgagatcagcccccgcgcccgtctcctcctctcggcctcgggtttttgcggcggcggcggcggcggcggcgggaggaggagaggaggggagaggtgtgcgtgcgtgcggcggggagaggcgactggttgctaattaacctatttcgttttttgcttttgtcacaaaaataatatataatgataataatattgctgcgcgcacgcggggaacagctggtccatcactggctgcgggtgggcccgaggagggagtgggacccacatggcggtgactcagtacactgtggcgctgtaggtttaggggcgccgccggggggttgcgatctcgccgtccgtgcttatctccctccgccccccgctgcctcgggatggacgaacggggcccacctgtcattgacacagagagagagagagagagaggaggggagaggcttaacggaaacctagatccgtcgcgacggagtgcccgtgttccccctctctctccgggcctctccctgctttaatttatctttatcgtggagatatagattttgttgttagttaataaaatctgagaagaatgatttcttcggatttaaataacgttgaatttaaacaaatttcttctgctaattagtgttcatctcgttgataaggccatatagtcaccaaaaaaaaatctctactttgtgagacatgtgtaattgcgagcatgaaaatgactccagtgcacacctgtctcctgggctgggcatacatatttcatttcattattttgtttagtttttgttcctttttctcccagcatcgatggtataattctttgcaccatataatattccatcatttccttggtgccaagaagaagaaaaaaaagacattgcttggttcctaattaagggagttcggtgctcacaatcgatcgatcggttggtgaatgactgaatatcatttggtaatgtcggtacggtatgtaacactgactgcacttcatatatggtcttaatttcgaagtggatcctgcatcacacattttatgcggaaatatgtgtggatgccaaaatgaacggtctaatcatttacttatcggatcgtgtatttccatggccaagtttaattctttgctgactttgagaaaaagaaaagaaaaaagttgatagaatgtgacagacgtagactaatatttggcctttcctgctcaacttgggccaaaattctcgttttatggctgtagcaattcgaggaccacgcatcagtgcgcaaaggcatttggcgactgatccatggatgatacgcatactgcaagtatgtaacagcgatcacaaatggttttgcgttgcgtttttgtggatgggataaaataaaacgtcgtggacaacatacatagatggacgcgcggcaaaattcaggggaaggagatcaacgcctctgcaatttgcagtcacataattttcatttcagtcgccatatcaataaactagtggacaagaatatctgaatatgtactcgaatgtatacgttgtccattcatctatagtgcaagctgttttagatttgttctttggtcagattcatttgtttaattaagtttgtagaaaaaccatagcaaaatctgtaacatcaaattgatctcactaaacccactgctgaatatatatatatatatatatatatatatagcatgtttgttttgtgttcaaaatgcaaccatacttggttaaatgaacaagtttaattcagggtaaaatgaaacacttacaggatataaagttgagggaacaggataatgaagtatgtgatgcaagaatccaaaggtggtgtgatcggcaggtagccatcgcatggcaatgtggcggccggagatcgaaagggcgagacaccgtcgttgtctctccgtttttctccacaaactctgggataaggccggggaggagaccaaaatcacacacccccatgacaccatgtatacaatggtatcggggacggacgaaaagaaaaataggactgaacaaattagataaagttttaactttctttgtaaatatatgacaaaaaaattaagaggtttccctcaattccaacattggtattggaactagatgttggttctatggtttgggtccgctcagtagagcacccaccacccgtgtcgagcgaatttattttccatgtgattttactatccttaaaaatataccatactttataatgtaaaatttaatatctccggatactaattacctcgatgtattttttcaagactataaatttcttaaattatagtcatacatacggatgagacacaatggtcatgacaatgcgtgaagcctgttgatgacttcaatatatctcagcaccacgtgcaatctctgggtttgcgtagatataacttgcacttggtgtacatgggtggtgtgagtttgtgcgtaagttcagatactactaagttctcaaaaaaaaaaagttcagatactactacagcgtatatacgtgaagagttgagaaaagaaaaaacaggtgttcaagccccatcgatccatgacagatccgccactaggaataagttcactttaggtatcgtccagtctaatttttatctctgcagcacaaaaccaacttacaaaaccgtgcaaagaagctccctcagcggtatagtcgctggttttggctgacgtggcgcctacgtggcgctcctttgactaggttttcgtccaacgtgggcattgacgtggcgcttacgtggcaatttgatccaaaaaataataaaacccgtgggacccacatgtcaggtttacacaaataataaaaagtggtggggcccacacgtcatcctcactaccctcatctctctctcccacttctctctctccagccggcggagcggggtgggcggcggccggagcagcggcagagcagagggcggaggcgaggggcgaagcggggcgggcagcggcgggtcggtggccggagcggcggcgtgttgtggcccacaacttgtgggcggagcggctggtcggcagccggtagagaagaggaccggcggcgcgtcgtggccggagcagagggacggagcggccggccggcgggggagaagtcgcggaggtggacggaggggcgcggggcgctgaccggctggaggagaggagcttcccgcggcccgtagctgctccgccctcagctccggccgtggcccaccactcgttccacgcgttctcccggtggtcgttcacctgcccctgcacgccgcgcagcgggctccgccggtccagcactgcgtttttcgccagccggttgaacatcctcgccaccgccttgtcgctgcccagcccatttgacaccacgccgccgctgagcagccgcacgtcgtcgccgggccggaagctgatgtcgcggaggctccgcgttgggctgcggctgaagtggacgcccgcctgctccagctccgtcaccgacgggacgaactcgtcctcccgctgcctcttgcggccggtgctcggcggaggtggtggcggcgtcccatggaggaggcttcggtggcagacgtcgatcgggtgtagcgccagggcgtcgccggtgatcagcggtgggtctcgcgtcatcgacacgaatcggagaaccatgtcgttgatgacattatccgtctgtccatcacacggatcaaatcaaatcggttcttggatgattcttgatttcttgattgattgatcgattccgcgatgtacctaacgctttgtgcgggccgcgaacgacggcgacgaggcgccgtcctactcgtagcccgctccggccactgcccaacctgctccgccggccggccgctgcgccccgctcgtagcccgctccagccgctgctcaacctcctcctatcggcttcgcgcgtcgccgcccgctcggctccgccggccgccgccgctccgcactcctgccggcttcgcccgccgtcgtctcccctgtccgccttgctctggcgagttggcatgtgtttagagagaggatagagataagagatgaggccaattgtgacatgtgggcccatgtgggcaccaccaattttttattatctatgtgtaactaacatgtgggtctcacgggttttattatttttttcagatcggattgccatgtaatgccacgtcaatgccacattggatgaagacctagtcaaatgagcgccacgtcagctaaaactatggactatactgccgagggaccttgtttgtatggttttgtaagtttggggatacgttgtatccggttttgtatagcagagacgaaattggactgagcgacaaatagagggacctgaagtgaacttattccccgccactacggtacaagcccacaagtcagctagacagagtgatgggccgatatgcacgtgctttgcttacctttcggcccatatattatgttctctgggcctgtagagcaaacgatcaagcccacgattaaggaaagtagcacatggatgggcccggcctgctatatgcgaatgtggtcgtcgtgggccagcctatcctatgtgtccactactaactactagcaatggattccagatgggctttctctgatgaactaggcttttttagctcatacagatatcccgcgtaactattctctctctttttatattttttctttcccatgagaataacaataataataaaaaacgattgctttcattcaattgactattgactagaccactcactatatatgcaccacatgaacaagcataatagtcgtacaagaccactggctcactatgcaataagtttagggcttaattgttttgggggaaaaacaaagtatctgaatttataaggattacttctttcctgcaaggtgaggagtatagagaaaacataattttttttcatccattcatttttttttgaaaaaaaaatctaataaattaatgtgcgcaaacatttatattcctttagtttttctatttctatagattcaaattcgtccgaatcaaataagcccttactatttagtccaccgttccataaaaaacctacatagtactcgatgtgacgcatcttagaactgtgaatctggataaacatctgtccatattcgttgcactataatttatcacattcagtattagatttattttttctagacggagagggattacacaccaagtaattaaccaatggaaggaacgaacacgcatacttaatttgactttgaaaccagctactagtacgtgtactggcctatatatagggttggaaatgtacatatgttggccgtgcgagcgcgtggacaagtcgatggatcggtcggaaacctaaattaacacacgtgcaatgcgaaaatgacccatatccccagctgaccagcaagcaagctaggcagcaaacaaaactactactccatggagagggatgcaacaatgtcccggttcgtgcaggcacggatgcaactatgcgacaacgacttacttcccagtctccaagggccttttgttctccacgaaccgatccactgtaagctgcaccatgcattgcatgatgaaatcaaaacagtcaaaagcaatattttcttttcgcgaggagtcaaaagcaatattatttgcaagcatgtaacgttgatatatttttcataaacttcgtcaaacttaatgaagtttgacaaaaaaaaatgttaaagcatcttataaaaaagagtgacacgacaattttaatttgctactcaaattaaagagatacttattttacaaattatataaggctatgtttatttgtggagcaattttacagaccttaaggagctaccatgagataaaaaatttagtataaatatagccttatataattactaaaataagtatgtacatacgtaagtaagtacgtatatacacgtatccacccgcgacaaagacagatccatttgtgatttccgcagatagcctagcctatatcatcctccttccccctcgaggaccaagcataccatgggcgggccttttagtggtctgcctgtgagatgagaggttatatatatgtgaaaaccgtttatagtggtattcatcgaatcaaacagtactgtgctacaatattcaccgatgacgagttgacgaccgatccattcatccaatccggccaaatcgatcgacattactacgtacatacaacttatggtcaacaacatctgcatggactcttaatacacattacccggacagtccagatagctactgtacaggtactgtatgcattgcatcagcgccgtacgcacaagtaccatacgaacgtcgtgctcctatagtccctagccgtcgctcactatatatacaaattaaagtcgttcctcgtcttagctttgaataattcaaaaaccaaaagatcaaaaccaagggctacaaaaccacttttaattttaccaacaaattcatcccccgtgtgttatgcgtgtttcgcggcgcagactagtttttggattattgttaccaggtttttcgtatggtcaacctctgaaaacatcgtgttagttactatagcaagttctaaaaaaaaagttactatagcagttttcgttctagtccgtatgcctcgtatatgagcatgttcctagctaggtttgtcctgatcgatcgaattgaaatggattaattattggtcatattagatatcaatctgaggctagtgtcgttttctacctctagaaaagacatgatgagagggaaggggcagcttaagaaaaattccactaattaatggtggagtggcgtcttgctcagagatcgtgttgacgaaaaaatcgaacacactggcctgggagatctatttagctcctgtgcaggtccaaaggttgatgagatgcggacgtgccagtctgtttgatcttgcaactgacaagatatgtaaatagtagatcaaaacagtcgatcggctgacaagccgatggagcaatctcagccgatatcgataatagccgatgccaataccagccgatagcgatagggttttgataaatcggctatatgtccaatgtagatgatgatataaaaggcaatcggctgatgataatataatattgcaatataatccagtataaaccaatcggctagcaatgatatgataaataagcatcgattcgaggtttaaagcacacatcggctggaggtccgatgtcatgaaatccacgagattagattaa

SEQ ID NO: 42894 - DNA, 3538 bp, Oryza sativa
ccatttggaataagcctatggagcagaagcttaggaatctgcacaaattagatgtttgttcaattaacaagcacaaaacaagggcaacatataacgtgggcctacacattaaagcaacaactttcagtttgggaacttcaatatcagtgacaaacatttgtttgcaacatactctcttcagtggccccgcccctacaacaagtttgcctagtgcccactcaaactgactgtatcacttttatacatttcttttctcatggattagtattttaatttatcctgaattgcacatgacatttcaacaattctctacttggacccaaaccacttaagcaatatagtaagaagcctcacgtaattatactatgttagcattcaagtatgaggtccatgaggtttgtttgtctcctgtaaatataccgagagctagtaatgcatcacaaggatataacgtcgacagaaattacaagtcataagaatggcaccttccccgtacgccttggatcttcgtatgggagatttcgaacgaccactagcctccataagccaactttgttgtttctgtacaatgagctagaattttttacataagcctctgtttcttcatctacaaacatataaaaacatgcatttgcctttgaaaattcgctggcattccttggatgttgaatcatatcataattccctggaaaacggtatcaaagtgtgagcagacaagcagaatgcaatcataattaatactattactgaacagtgatgttaccaaaaatagcagaagctacaaccagctcacggcatttctccatctctaacagatcatcatcattgatatcaaatccagaaccttggccaggtttctttcctctaacaaagctgataaaacagcacaaatcatttcattcagcatacacatttcagccattaagttttggcagaagttctggattaaatatgggtaagaagatgcaagtaacctacccacagtggacagtcatagactcactaatgtcaaaagatttatttctctgctccagagatggatgcccaccaaatacagagccctgatttgagaaatttgcagtgatgttgtcttcaaatacataacttaagttcttaaggacaggagatggtgaaggttgtggaggcataagagcgaacgcctggtctacaggcacgtagcaaacatcacatgctacagggaaaatgagaacatatcttacgattaatgacaagtcaaacacaaacaaacttgcaacgctaaccaaaaagatgtaaagaactaagcttacgtcgtggtccagtgcgtttcggatcaaccaggggaggggcaactgagaaaccttcacaaggatgatgtgtaaagtttgcaaatgaaagacgaagtcgatttggaagttcagttttgttgacgctactagcagagaattggtcgctggacgtcattagaggccttgtcatgctgggatacacagagttctgtatggtatttgcgacttcatagttatttgcaatgatcattgaagcattatcatctgaaacaagtcaccaaaccaacaagtcaatgactatgctttctaacaaaaacatatattatttttcattcaagaaacatcattttcttttgaattccttgaataaagtacatgtttgagaattccatagtaaaagcatatggcatgagcagctaacgtcccttgatagttaggattggcagacaatttatcatatctgaggctcccaagtaatataacaaattttagtactaagtgggagggtattcggtgatcaagacggaggccacacagctctgcaagattcaatctaccatttcaaatctaagagtgtgtagttcccttgaccttatgaaggtctctaaccatcaagaccacttgtatgcatcaaaacctggtttatagagaagtactctacctggaccaagatatacatgacactgccatcagaccagatcacagacaacaacatccaattagtctagctgatccgcaacaccacaaaactgagacatgtaaatgggaggcgatcacacgatcagcataggccagtatgtaaccagaatgaatgccgcgcgctattgattcccaatgtttagagcatcacaaagacataaactaatctggatttctgcaagcgtgaactgcgtgaccggaacaaactgctagtacaaatgcccatttcgctacgaacagcagctagggagggaagcgtgcggcgcgaattcagcgcaggcagccaattggcagcggcgagaaagaaaagggcagagcgcgtacaaacctttgacgacggcgaagatggagcagaagacggcggcggaggcagcggcgagcagcagcagcaccccggccctccggcggcccaccagccgcagcgcgcggtggagcagctgcagccgctccttctccccgccgcctcgccacccccaccccctgcccccgcccttcctcccgccgccggccgacgcgagggagccgtagctcccgcaccgcatccccagcgtcgccgccgagccactcatcgccaccgccgcagccgccgcctcccctctctcatcccaatcgccgaatcacacggcgccgcaatcccctccaccgaaacacgcgagatcccgcgagctgtggctggcaaccagatcagacaaggcgccgcccacgcggggattagaggatgcaggtggagcaccgacgcgcgcgcgcgcgcgggcggtgggtgggtgggtgggggttagaagcgcggcgcgggcgcggcgggcggcgagacggggaggattttttttgccggttcacggagctggaacctaccaccacaccagcagcagcagcggcagcagcagcatgtgagattcctgcgcgcgagcgcgcgtgacgactcactgacgagacggcgacgcggtggcctcgtcgtcgtcttcctcgcggctgacgagtcgcctggcgctcgcgtggagtgtagtgtgccgccccgtggtgacaagtcggggaggttaaaaagcggcccaagccgcttcggttaaacgccatcactactagtgatgatgacttgatgagtgatgggcaacgcgatcttcagtagtagggtaggtgcacgtcagagcttgctgctgatggacgaaaatattacactttttatttctcccttctttttaaaatatatagcaacctaataccctctctgttttttataaatgacattaatatttaatgtgaagtttgatcgtattattaaaaaattatataaatatcacttcttttattgtgacacgttttattattaaagaaacattaaatgtgtcttattctttagcacatttacactatttttctaataagatgaatgatcaaatactattttaaaaaacaaaaacattatctactaaagaaacagagttagtactgaattaactgccgaagaaatatgtgataatgattgatgccaaattgccatttggcagattgaaatacctggagagattctcaaaaggatttttttgaaaataaaaaatggaggggatgtgtgagaa

SEQ ID NO: 42895 - DNA, 3096 bp, Oryza sativa
agctacaagcatgtgtgattagtgtggttgtgtgcggtcttgccggctttgcccaagccaaaccgcgttgggtacagatcgtcggtgaccagtcgactatacgtgatcttgatgggtttgtggatcaaagattgacaacagattgggctctttatcttgcctttcgtgggcttttctgctttactattctttattgggctgggcctgatagcagcaaagacaaaccaattctttctttatttgaatcgcaatcggttctacttactacaacctattcatgtccaatccagcaaagttgtcagcatgggagactgagttaagatcaagaaattaacggattcactgaggtaattttacgtgataggaagaacaaggttacagagaaaattaaacgatagcgaaataaacatacaagctgtctcaattgcataacatcttgattattacagccatactcctctaccatataagcatcgtaaaccaatgcaaaaccagcactaactacgtaccacagcaactaattcatctccccatgcaagatcgagtcaatgaattaattagcctagccgatcgatttattcaggcccggtctctgatcttggcgacgacgacgatcgaacacaccaacatggatcaatggatcagtagcacttgttggggtatttgggggagaagacgaagttgccgacggagtagaggccctggaggccattgtcgcgcttgacgaactcctcgaacttgagcggcaggcccctcctgccgtggccggggacggcgcacgcgcgcgacggcgaccggggcacgtacaccctgcactcctggctcgtgaacgacgtcagctgcgacgtctcgatccggaagtagccgccgctcccggccacccccctgatcgacgccacccgccggtgcccgtgccggcaacgcaggtacgccaccgctcctgcacacacatatatacacgcacacgcacggccgccggcgagatggtacgttaaaacaaaacataaatattaggaaagtaccaaatattaaataaatagaagtgggtaaggctttgaacccaaataagctaacccacaatcttgtgaagctagccgaaaaacccctaacagtttctatgttacgtcgacaacgacaccgtgtaatcaagaatattgattttaccgttcttaaaaagatattgggaggtatcatattttttttagtgtaaatttggtgtctctagtattagaaggtacggaaatgcattaaaaaaattattacgtcttgggaggtactactctctcccagaaaaaagcaaatcttagctatgaatctagacatgcatatttccaggttatacgtgtctagtttcgtagctaggattggattattcttgggacggaggagataactctcgaaaactgtaaaatttctcaatggtgaaatgtatggtcggtctgatctgcgagcttacctgcgagcggggacgcgtccatggcggcgaggtagccggggtacctgcaggtcttgcaccacaccatgccctgcacgccgatgctgaagttcaccgtcggcggcggcgggggcaggcccatggcggaggcgccgccgccgccgtcgagagcgagcagcacggcggcgagcgagagtacaacgaacgacttgacgaacaacagtgccatcgcgatcgaattcgccattaattagtcaacgtaatccacacaagaatacgtaataactagctagaagacgacactaattcgctagctagctaagcaagatctagtctggtaagatatggtatagtatacagacagaattaaacacttgggttaactaggatacgttgcgaagacaagaagcgagagatgatggtgcaatttatagcgtgcgtgtgcgtacgtagaagtgcatagacgcatacagtgataataaataaatagtaagaaatttaagatggctcgtgattgctgttttggattctgattagaaggggatcagagagactgtatattcaagttgtgtggaaaatacgagggttcgttggggaatcgagggccaggaaatgatgaactcgcgtgtgggctggagtgcgctgcaagcgatcagtacttcgttaatagcattatctctgtttaattacttgattccaggtgtgttagaagttaaaatacatgacactatgtaccactgtatcgcactactgtggacacatcgtgtttttttaagacaatcacgtacatcggccgttttaattcgcctagtgatcggagtttagtagtgtacactccagtagatctatctaagtaccatgcatccttagtaaaatcacctggttaggcaaatcgaggatgcatgggatcgatgaacaagagtgcatatcttggacatcagaataactgcagtatacgtagcgttcaaggcatcggatctgtttcgatcgggaatgtaataagctgcttaactggtataatcgacgagcccaaagtctgaagtggagcaagtaaatactactctccccgttttatatattataagtccgctttatttttctcctaatcaaactttttataatttaaccaaatttataaaaaaaactagtaaattagtttcattaaattttaaattgaacatattttaatagtatagttattttatgttaaaaatactactgtgttttttcatgtatacttgattaaaattaaaaatgtttgactagaaaaaaatcatatcaatttataatatgattgatggacagtagtgacaatgccgcatatatagattccaaggttgagctattagacctaaaatcccttatattatgggatagagggagtagtcaagtagtagtactccaagtcaccaacgcaaacaaattttgatcgagcagtgtaaaaacagtagttttttctgattccagtacgtagtagctccttgtgttgttgatgtattgtatttgtatcgtatgcagatgcaactgccaactgaggttccgttcggcagttgcaagcgctggcaatctggtctgccttctcgagcgggccaaaaaagcccgttagcccattaaacctgagtcatttggcccaatactcccaagcgggggctgcaggaatt

SEQ ID NO: 42896 - DNA, 5640 bp, Oryza sativa
tgacgtagtccgcgacgtcgctcgcgaggaggcgctccgcgatcagccccgcgggcccttccccgaggttcgtccagtctctcctaaaataaaagacgagaaatcatcgtgttggattcggaaatataccggagggtaaactaatatatggccccgtcgattggattattcacggcatatttgcaaacgtaaaataatttataaataaaacttttatatatgcgttcttagcgatctgaaaagcaaaggcgggaaaataaactacaatgaaaagacctaaaattaactttaaaattaaagtttaaagtttaactaataagtataagtataagcgaaaagatgagactcgtagaattagagtggaggataaactttgtaccaattattaggctggatgaaggcactcgtttcacacccccccaaaaaaaaaaaacttggagggatctgcgatgaccaccagcgccgcggatcattttctgccgtactgatctggatctgggagcttggtgccgctggatcgtgacggttgtacggtagctttgccgggcgagaggctgccggaagaaaatttggtgagacggaggtcctacgctaacaagaaagacttcgtttccaagcgcgacatgtgtgggcaccaatcttaaagcaactccatcctcatcttcaacctcacgcctcacgaacgttctcccattccttgtttgcccagcggctcaccgctgcccccatgctcctaacgagcttgcaaagaggagcacgtgggagcttgcccttccttggtctgccgagcagctcacagcaggacattgggttggggagcagtggcgaactccagcggtctagatgaagaatttgtagcaagcttgactgcttgaatagttgagtacatcgagcacaaattgatgggcagttgagtctgaccgtagggtgaggagcttgctgacctctcgcaggccaccgcttcgcccccaccagtgtgaccttgctgcttcgctgaacaagaaggttgaatcgacgcgttgccctccatgtgtgcgagctcgtcaagatgccgaatgggagtaaggaatcgcctcccgccgatctcctgttctctatgagcgagagcttgccgccagactgagctggacggatcggaggaatcactcatgcgccgtttcatctgtgcaaacggaggaattatctgtgcagctgtaccgaaaggggagaactgagagattgctttgagatcggtagggaacacgtgtcacgttttgaaacaaaatctttctgataaacataagacttcagtcctaccaaattttcttccgaggctgcctggacttggcaggacgctctcctcttcgccccacaagaagagcgcctcggcatcttgcgcgtcggccggacacaaagatttgtaggtcccacatctctcaaggactgaaagcaccgaaggaaaactagtcggattggcccagccgcagcagcccatagttattcggctcgttactgtgtagtcgttggagaaggtatacgcatcggaaacgattttgcgactctttgtgtatttctatttcgggccgagtttagttccaaacttcttctttaaactttcaattttttcatcacatcaaaattttcctacacacataaactttcaactttttcgtcacatcgtttcaattttgatgttaactaaccacatcctcggtacttttccgagaaacaataaaaatgctccattttggatgcccctgaaattggcaacatatatatcccataatcttcgacaaatgcatgcgcatccctgaaattggcaacatatatatcccataatcttcgacaaatgcatgcgctaaacaaacgtcagatgattgaaaaaacattaaagttacaatgttcagtatcaaatatcaaatacgtacattggtcatttcaaggaaggcttttttctaaaaaaaaataaacattgcgcggaagccccatggttaaactccatagctgtattgaagggactgtatcttaataaataaaattatttatttgcttcgaaatacttcaacatgtatataaaactttctccacaaaagtgagaatcatggtaactatgtcgtggcttttttttttaaagaaaacacacaatataaatgcacatactcataatgggcgtacacacccctataaacacacacgtacatcgtatctctattagcacctttgaaaggttaggtatatcactgaaagaatgattagctataaatgcgattttgtagtagtacctaggaaataaacaattaagtggtgttttatatgagtagcgagattttgcagctagaagcggaggtctcatcgtgttcactgtcacgccataattattttaggaattaataaaatgtttgtagaatttatattaaagtgggagtaattaaacaagtgaagttaatatgagaagtaaaatagcctttagtaaattgtggcaatactttactttccccatgtcatacaatactctctggagtttctcagaattttcggagcctaagatttaattttaacaaaacaaacatcattcagtaattatttgaaatgaaaaacaccctctgatcttaggccaattctagcccgtttcccgcctagtgccaccagtccaggaccatttggcccaatagtacttactcacatctaccacccaacatgggccgcagtcggtgggcctatcgaggcagcgtcccccgctcgttgcttttctcctggcatgcaaaagatgaaaaagatttgaaaaacgcctctgaaacaacagcatgatcagatgcacaaactcatcataaatcgaccgaaaggatagacgtactcagataattttttttctcatgacattacactgacgagcgaactaaaaccactgcaaacctaagcgacgagctactacaaggttacaacaaatgctccatcgaccaaaagacgagctagctaatttctacccattattaattccaaataacgtgcacgaacttaattaaaccatgcatcatccaaccaaaccactaactaaattggcgatatgcgtgaacgcacatctcgaattctccatgtcaatatcgatcgtctcatcacatcatcggcacgccggcggcgtcggcggcggcggcggccgggcacttgccgccggtgccggggccgaacatgagcgtgctcttggggcggtacacgccgcggacgcccttgggcagcgacgccaccctctccctctccagcgtgagccccagccacttgttcgacgggatgaacggcgccgcgcacagcggcgacggcgacgagcccaggtagacccggcacctgctccgccggaacacgtccagcctgtacaccatcaccaggaagtagccgttcttgtccgtcgccgtgctcgtcatgttcagcaccttgtccccgtagcacaccagctgcgccgtcgcatctgcaaaatattatcatagagactatgttagtcatggaaaactgttttaatcgctcggatgattgttcacctgtttgatgcatatcatctaaatagctataaaaactttttaaaaaaaattaattacatatattgctccacaaacatacaagttaaaatttaactttaataaattgtaacaaaaataacaaacaaaacttaaattactatatatatctccaaagtgaagattaattaatttctacatatgtaatgaaaatggtttacatctccgacatttgcctacggcactggatactaacttggtaggggagacgcgtccatgtagcggttgtagccgctgaggttgcaggacttgcagtagattgtgccctggacgacgacgaccggctggatacggctcggcggcgaggtgcgcggcggcggaggaacaggaacaggagccggagccggagctacatacctccccgacgcatgagaaaccgggaggagaattgcaaggagcagcgcggccatggcgcagtggatcttggaggacaccatcgttgatcagtgtaccgcacttagctcgagtggaactgaaaaaatgagcagtactgatcgagtgtgagagcccttccagatatgagctaatttatagacggagatggctagggtttcctgccgtttggagtaatttggttggtttgcttcatttgcgatcaaacaactgatagctgctaattgagattccatttggatgcatcgcagttaatgctgttgttggcttatgacagtagagtccgttagggttctaaacaaatgcatcacactactccagtacgctgctgcaagcatgaaagcgtggacgtctttgacgcctgtagatagccaacgcaggatcgaattcgtgaactgccaactgttctttacctggcttcatctcctgcaatttgttgtcacctttgatctcagcatcatatccattctcagagtttttgcttactgcaaatatcggcagaagatactactacacctgaccaagtgactactgcgtttactttgacagagtctgagccttttatcggattcaatccttacaccaacttgacacttctttaccgtgctcagttggatttttcgtgttttttttttacccctgaaagttttagatcgagctaggcagatagctgaagaagaagctgtacatagcttttcggggcgttaaaagtttaatctgatttgtcattggagagcgtggccagtactgatgttcgcgctgaacggcgacgacctgtgtttgtactcttctacatgaacgaactatagagtagttttttgagctgggtatttgtgcggagttgcttctaaggcaggcaagcctccctcctgaatccttgatttctggttctgaattcgttcatcgatcgttactagtcagtactctttttttcccactcagaagatgatctagtcactcgatcaactacttgtcacgaaatggatgcttgtagcagaggaaacgtgaggatatacaagtgttcacgaacagataatgctatcaaattcaaatgtatgcatgaactagggaataaactatatgtctaattttttttcagtaagtttgcctcgactgcaccagttttcagtcgagacaaaatttgactcaggttgactcattgagtgggcatttgggcctgcaagcggaaggcgaaaaggcccatctcggtatctctctttcattaggcaacccaacacgagacgggggccaatttacagtgctattgctcctctattgggactccaattgtaatgcaaaagcccatgaggttctcttttcgctgggctgaaagctcatgtagtcttgcaggagggaaaggctctacatgcatgatgcaactacatcaggacacatcaaacctaaaagaaaaaagaaaaaaagatttggagggagagacgtcattctaaacatttttaagaaaaaaattatgagcgtgttagaaattaaacacggaactatcaagtgcatgtcaggagacatcaaacctgtttttcaactgaaactttgatgaggaggaggtaattgagaagatgcttttcgctggtgatatatattgagcttgcaattgacggtgacctagatttcttgattgagaatctgggagaaatcatgaaatcatcaggagtatgtgcgccgatggaagtacgcttccggttgctat

SEQ ID NO: 42897 - DNA, 7446 bp, Oryza sativa
aattcctgcagcccatttgttttttttaatgattttgataactgttcttattctctgagaaattggagtactagaatttcaggaagcaccgaaggacggccagtttgataggataccttgtcatttgctgaaattaatgaagtttagatagtttggtagctagcttattgagctatagcaagtagtagttcttgcgttcgcataggccggttcccatcccgaacagttggcacgaaaaacggagcggtccattagtacatgattaattaattatttgctattttttttttaaaaaaaaggatcaatatgattttttaaagcaacgttcgtatagaaactattttttgaaaaaacgcaacgtttaacagtttgaaaagcgtacgcgcggaaaagttggaaacttagagttccaaacacaccctaagtgtagtcgtcgaagcattccggtatcgtgaaatgttgcccatgtttctgtatgcgaaccagtaaatttattttttgcatgaagattgaattatctaaaatcacctagatacctgctaactactagtttagattcttgacccaatcaaagttttctgaatttgctagatggaaatttgttttacagagttacaataattcagcaactctgtagcatctggcattcatttttttcccctttcttttgttaatttcttatgtaatacatgtacatttattccacgagccagcaacttgcaatcctacagatgattaattaattaaacaaagagttattgcattccgcaaatatcttcagccttcaggcaagctgaaaatcttcaggtttcagtatatcctattcgcaatcaatcaatcaaccaatcaatcaataatcttaattctgtgttcatttctcgatgaatccggtcatctggaggacgaggttcctgacgttgcggaggtcccgccctttgagcgtcctccccttgccggcgcacatggagtacgccgccgtccttcctcggagcctcctccgatcaacaatggcgtgcggcggcgcgaccataactccattattcatcatcttcttcttcacagcgtcgtcgtcgtcgttggtctggtcgaacatgttgtactcggaagcccacgaccgagaccgccgcttccggcgagaggcggcgatctccaccggagcagacaacgacgacgactccggcgagcccacaggacgacgagccaccggagacggcgtcgtggtgacaaccaccgcgccgtcgtcggagttgtcctccgcgggctcgggccacaggatgtcagcctcttggaattcctccatggcgtcgccgtcgccgtcgccggccgtctcctggacgacggagagaggtcggcgaggagacggcgagggcgtatttatatacggtggtgtgcgctgcaaggaggaggagaagaggaagaagctggcgtgtcttggtgagcaagcacaattccttggggagacggcaatgagaggagcggagcggagtgtgtctgtacgctggaaggaaccgaacagggttgatgtggagtgcggtgcaccttatcgtcggctgccacgtggatagcacacgctaatacagttgcgttggtcatttttgtttttgaacatgtgggtcattttagtttttactgtgtggcacactctcgctataagcccttgtgtagttcccaaatttttttcccaaacacatcatatcgaatctttcacacatgcatgtagcattaaatatatatatataaactaattgtacaatttgcatgaaaatcgcgacacgaatattttgagcctaattagtccatgattagccataagtgttacagtaacccatatgtaattaggcttaataaattcgtctcgtggttttcagacgagttatgaaattattttttttcatttgtgtcagaaaaccccttccgacatctgatcaaacgtcctatgtgacacctaaaaattttcttttcacaaactaagcagacgctaaatccctgagaatgtggagagagtctgaaaatgaactacagttttgttcagactgttttgatttgtgctaatataaggatttgattttctttttaaaataaattatctgaaatattatagcatgggtttaattgggttgtactccctccatctcataaaaaatcaacttagtactacgaatctggacataggatgtctcatattcggttctagattcgtttttttatgggacggagggagtatatattagcgaggatgaacaagttcttttgtgcaccacagcaaaacggcaaaacggcaattttagagtggtgttatgatttctgccaagtttaatcctacgctctctctaactaggtcgcttactgtgtgcccacgtgttgattaacaacgtaacacacgaggtggtattaaactggggtagtccagtttcctggtaaacccaacttgataaatgacaattttcacacggcaagataggtatttacaatccacggcatcctcagtgtttgatcccttttgatatactgaagcatgacaaaatttcccggaacttatttgttcaagtaaaattaaagcaacgagaccaattcaaatcgagctcccaaatcatcttcttacattttaattcctcattcatgatacaaatccagtacttccatggatgcatatacagcttcaacttcataacctgtccttaaccctcaatggcagcagcgcatgcatcatcatccttcgatgaacccggtcatccgcagcaccgagttgcgcaggtggcgcaggtcgcgcgcccgcttgcacggccgcgtccccaacgacgacggcagcgtgcacggcgccgccgccatctcctcctcctcctcctcctccggccgccgcacgccgaacagcagcagcaggtgcggcggcacgatcaccaccttcccgacgacgctgccgtggccgtcctcctccatgctggcaccaccgtatctccagttccaccggtgtaagcgcgctcccctgcaggggacgtccaccggccgagagtgcttgacgcgcggcgtgggcgcgcgtgtctcgtatggctgcaccggcggcgcaggcgagatcgccggcggcggcgcgtcgtcgtcggcggcgtcggtgtcaggccacagcacctcgaactcgtcgagctcctccaccaccatcgccatggcaaggcgtggcaaccagctgccgagagaaagagagagagagctcgcagctcagctcagctcaaactgaggcgcgcgccgcggcgtcgagcgcgtctaaatataccggggcgcgcggcttgcctgcctgatgggattctaccgcgtctgatcggatcggatcgcgagagaaattctggggcgacggcgaccgctcggcgggcgagctccacacgcgtccgcgaaagagaagcggcggtggggaggtgtacgtgtggatgccgcggccgccatcgcgccgcgggctccggacgcggcgaacggaacacacgtttcctctcgccggcacgccgccctgttgcagcgttgcaagggaatcgacgcgagccacttagtacgtgactgatcgcagtgtgcatggtttgattttttttgtttggtgatgaatttattaagcatgggttgattaattgggcccggggtcgtaatcaaggctgtaatcagtgagcagttgggaattgggatcgacaaaatgcaactagggatataggaatatacagtatatgcttctgttctgctccagtgcactactacgccagtacgtagtagtagttgcgcccgtcaacatcctcactattcatcagcatggatccatcaatgatcaatccgtgtgaacagccaaacagggcaattttggctctggtttctgggtggatttaggctggacgtgtttagttacttttcacaaaaaaaaattagagtatacggacacacctttctttgaattattaaatgtagactaataacaaaataaattacagatttcgcatgtaaactacgagacgaatctattacgcctaattaatccatcactaacaaatgtttattgtatcaccatattatcaaatcatggcgtaattagcctcaaaagattcgtctcacaatttacatgcaaactgtgcgattgatttttttcgtccacatttaattgctatgtatgtgtccaaacatttgatgtgacggaatttttggaagtttgaaatgaactaaacatatccttagttcttatcttcactttcccaactcatctccctcgtttttcacacacacgcttttcaaactgataaatagtgtgtttttacaaaaattttctatatgaaagtaactttaaaaaaatatttttcaaatttattttggttaatacttgattaatcatgcactaaacactgctttgttttgtgtgctagggagtaaggttcccaaccctcactcccgaacacagccttatccgtcttcccaacgccggagaaatacccagggtattttagctagattctcatggtgatgggctagacaatctggatttaaagtttcaccccttctaattatttatattaggtccttctctaatattcgcgtatgtcttcccaacgctgcagcagggtgtgaagtcggcagacttgctacaggcctacagctagtgatctccacgactccacctaacctaggttgtgtttagttccacgtcaaaattggattgaaagttttttttaaaaaaagttaaaagtttatgtgtgtaggaaagttttgatgtgatggaaaagttaaaagtttgaagaaaaagttagaaactaaaccagcacctaaacttaggccctgtttgattcagcttataggattattataatctagattattaggagtaagctgaaacaaacaagtagattattatgctagattattataatctataagccagattagtataatccaataatcttttttagaggagtttttttccagattattaagtggctaaatactctctacccttaaatgtctccaataatcccaagaaataaacaactcacaacttattttatatcagattattataatctagcttagagtaatctgatttaataatctagattacaataatcttaaactgaaataccttaaacctgcacggaaatctcgccgggtcaaggacgacgatgagggcgccacggacgatggaccagacggaattggggcagcccggggctggggcggcggggggcggagcttccgtagttgtcaccaagaccatgcgagatcaggtgagtcgtgatgtggacgagtgtcacaactcacaaggatttgttctgaaaaaggacgtccacatcacataaatctcaccacaatcagagccgttcaatcttgatcgaacggcgcagcagacaacgagatgcacttggtcttgatagtgcctaagcacaattaaagccgttcaatcttgatctaacggcataatatacaatgggatacacttgacagtacaatagtaaaatgtgtattgttataaccctgagtttccgtattctatacccgacacgttcctccttccaaatcttcaatagacattttcacgaaccaaatctgctatggtgtaaaaggaaataatctatggttttgctattctctccgtttcatattagaagacgttttgattttttctaaagtcaaacttcttaaaagctttatcaaatttataaaaaaaatgtaacaatatttatagggattaattcgactaacataacatttatagtaggatgttatatagcaatttcctaattatagtattaaattagttttaataaatctaacattgaatatattttaatagtttgtttgttctatattaaacctgttgttgtattttttttctttataaatttgatcaaactaaataagtttgacttataaaaaaacaaattgacttataatatgaaacagaggcaggatctcatttgtaacagattttttactcatatcttttgatttttcttctgtataatcttacataaaagatttatatcctgtagatccaacttatagttgcacccagttatagagcactttatactttgttacttctatatagtaattacactcagctacaatacaataaaattatattttacaactatttttgtctttaaatttacgatttttgacatatttattctttttttatttcattcaaaacgggttgtatctattggttggtaattccataagatttgagcctctaagttctacctaaagatcattagtagtcccataatcaaaggctatcctgtggcgatacgtttcatcccctgcgctgacgtatcacatgctcaatccaagccgctcaaatgtgatcgaacgtctcacggagtcccggagcgggttgactggttggttcctcctcctcgccgagtcgccgttgccgacttgccgtcgtcatcgagttgccgcccgcccgccgccggctactgtacctcagtagttcgcgccggtgcgccgcctcctcgctgccctagacgattgcccgatgcggcagcctcagccgccgccgtccactggcactacggcggcggattcagttgccaccgtggccaaatcaaaggatggctactcatcagggcgcctccgccgccggccatggcaccctgccctgttgccctgaattatcactggcacggcaatgtccggcaacgctgcctccgatgtgcagcgggatgatcacggcgacggcagcatggagttacacatgccgacggcgacttcactgtcggctgtgcactctgcactagtccactactgcagaagttcagagccatatcatcctgatctcatgtttagtcagatcttgcaggccgcaggttatagccctctggtctgtgacctaggctgatcctgcggtgcaaaataatcgatcgaacctgttgattcagtgaagcagattgtgccttctctgctcgctcgtgtcaatttggccgggcacagtattgggatttgaggaaggcgtcaacattaagtttagtttggatcaaaaaattgctttccagtttctcttcttttctttttttttttacatcttcttgtcttgtcattctgtacataaactctttctatataggcgtgaattgtttatgattatttcgttatcaaacatgacaggaaacaaagcaacggttgcagcaaatgctatacaattcagacagacagcaccatcaaaagaacctccttttcaggcttgaaatctctgggaagtgatcagtagaatccttggaactcaattgtcaaataatctcaaccaaatctaatgcagaaattttatttgtacaaagttttaatgctgaaactttgcttttttgcagatgaatatatctttccccacagtatgtgcaaatgtgcaatcagcatctccattgcaacagttacagtatcttgagagttgagtgagttgccacccttgatttcctttccctagtccaa

SEQ ID NO: 42898 - DNA, 7722 bp, Oryza sativa
cacccccacccccctttccacataaactccccccaccccatctcctctcccccctgaataacatcggcgcctcccaaaagcgaaacctcgacgccacacgcgcgcgcgccatcatgcctgtagcctccgtcgtgctcctcctccacctcctctccatggcggcggcggctacggcggcgctggccatggaccccgccgagagggagacgctgctgctcgtcatggaggccgtctcctccgaccgcgagtggcgctccgtcggccctgacccgtgcggctccccgtggcccggcctcgagtgcaagcctgtgccggccgccgggaacgtgtcgtcggcggcgggaggctgcacgtcacgcggctggacttcggggtggcgccgaacccgacgtgcaaggacggcgcggcgttcccgcacctcgcgttcgcgcatgccgcacctccagtcgctgttcctcgtcgactgcttcaagaacccggcggccaccacggcgttcacgctgccgccgtcggccaacctcacctcctcccgcctgcagcagctcagcgtccggtccaacccgtcgctgtccggcacgctgccgccgcagctgtccagcatccggtcgctgcaggtgctgaccgtgtcccagaacgcgctcatccgcggcgaggtcccgcagggcatcggcgagctcaagagcctcgtgcacctcgacctcagctacaactcgctcaccggcacgatcccgagccgcatcggcgagctccggagcttggtcggcctcgacctcagctacaactccttctccggctccatcccgggccagctcggcgacctcgccatgcttcagaagctggacctgagctccaacaacctcaccggcggcgtcccggccaccatcaccgggctgacatctctcaccttcttggcattgagcaacaatggcctaagcggccacctcccggccggcctctccgacctccttgacctccagtacctgatcatggagaacaacccgatgggcgtcccgttgccgtcggagctcggcgacattgcgcggctgcaggagctccggctggccaactccggctactcggggtcgatcccggagacgctcggccggctggcgagcctgacgacgctgtcgctggagaacaacaacctcaccgggaggatccccgccgggctgagccggctcaagcggatgtaccacctcaacctgagcaagaacgggctggacggcgtcgtgccgttcgacggcgcgttcctcaggcgcctcggccggaacctcgacctcagcggcaacccggggctgtgcgtcgacggccgcgccgtcttgcaggccgacgtcggcgtcggcgtctgccgccgcgccggcgacggcggggacatcgcctccgtgtccgccgccaccgacgtactatcagttggcacattgttcaggcgagatggacaactctggctcgccggcggccgctggtcagcgctgctgctcatccggccggtcgccgtggcgctgtgctgcagctgctgccttctgctctgagctcgcggcacgcgcgcgcgtggtggtttgatctgtatgtaactctgctatgttagtggtagtataacttgtcacgttaattgcgagaattccgaggcaagggaaaagagtttggtagtgttggggtacttctacacttctacagtacttgggtgtggattggattggattggcacgttggtttcaaatcgtcgcgccggttgttgggttggggcccggatttgtgatcggtcaaagttagcgtccgggtcccaggggagttaggctgtgtttagattcaagtttagatccaaactttagtccttttttatcacatcaacctgtcatacatatataacttttcagtcatatcatctctaatttcaactaaaatttaaactttgcgctgaactaaacacagccttatggtaactggctgtgatttgtgcgtggccgatctggccataaatccggctgcgcctgcaatttgcaagcagttttcaggcactctgcagcctgagctctgccctgcttttcattgcttgccgctgtataatccaatgagtgttatgcccctcattgccttaagtaagggaaccagatgcagtggtcaggtgatcatgtactccagcgttgatgtctgaactgtttgtactaactgacagtatggcttgtctatagggatgcatgaacaaagtaggagtatgtgttaaccggactatttctcatctgcactggaattttatcatctctttggttctttctttaactataaccacggttcgggcttgatgtccgggaagatggaagagttttgaagtcctttgggaggtgctgagagttgcaacgttttttgagctagggagtactccacgtagtactccaagtagtactagtgcatcacattaccggctactggacttcaccgtaaagatctcaagcaaggcttggtttagtttccaactttttcttcaaacttctaatttttctatcacatcaaaactttcttatacacataaacttccaacttttccgtcacattattttaatttcaatcaaacttttaattttagcgtgaactaaacacacccgaagaaagaaaaccgtgtgacgagaaaatacggcagtactgtttgtactgtacggagtaagagtagtacagtactgtactcctaccaaggaggaaagagaagtcccgtgtcctgtgacgggaaaatacatgctgaggagtacctggcaatgtacaaaatcattggtgtctatgttcagcgtgcatggacatgaactgttgaaaaggacagtgataggataagtgattgacatgataaatgtacatcctgccggggctatacaacaagcttgcggtagctaggggcatggcgtaaacctgaaagattgttttttaaaaaaacaagagtaaacatcaaagcgatcgattgatcgaagtgataatatgaaaagaagaaagaaaatcggttccctgcaggcagtaggatcgatcctgaccatgttagcactactgccggctggatactcctagatcgatagataccctccatggctccatgtaccgaaagcgagcgagcgggagagagagagagagcagagagcagagagcagaaaccagttgtcattagctgaaaatgacgaggggaaaatggacgagtgattaacgcacaattaattactccctccatcccctaatatagtaaactagataggattccagataattatcctaggatgggtctagattgttatagtctggacgaagatagtagtaagtagtattaattattttaaattcagaaaataaatttatttgattgcttaagaaaactttgatataaaaagtctctaaaaagaacgtactaccgtatactccatccgtttcacaatgtaagtcattatagtatttctcatattcatattgatgttaattaatttagacatatatgtctagatttattaatattaatatgaatgtgggaatgtttataataattgacaagagttgctcccaaacagctcaaacaaaagtagcctaaaccgtcccattcttataaagtatgtacacatatcttaactactttaaaagtacgattgtttctcttcctcttcttaaaaaaaaaactgctccctttatttcgaataaaaatcactaaaattgtggtaaaaaaaaagccagtgcagccattctccttgttccctgaaaaacccactcaccatcataaaaaactccctatagaaaccggtaaaaaaactacccttaaaaaaaatctcataatcccgttactacttcaccgtaccgcatcgtatgtgtagcgtgtggcttggggcctctcctctcttacgccgtgtaacggtgtaagctcgctcgctcgctcgctcgggacatcgccggtgaaacatggcgtcgattgtagaatatgcatgcacggtgatgctacattctctactcgcgaaagaccaccactcacccatcgcccatcggcgcgcacacgcacacggcacacctggtgcgcccgtgcgggcgcgggtgagccgcacaggaaaagagagcagcagagcgcggcacagtgcctcactgtgccgcctgcgcgcggtgcgtgcgcgcgtgtcgtgcacttgtgctgtgccctggtcaaagcgccgcgccggggaacagcaacgcaagcaaagcgagcgagcgcgcggtggtgggcacaccaaggaaaggagtagtacgtactgtacgcgcgcggcggccgggccgtgcgcacgggcgcgcacctggctctggctggctggctggctggggttctctgcccgcctcacgtggggaggagtcgcgagcatgcagcgacgccctgtagcgatggatggatggccaggacggctcgtctctatccgagacctgggaaagggatggggtattggggtgtcgtcgtcttgttgtgtgtgccttttttgatgctacgcgccacgcatcttgcggtggttttgggagcctcggccggccggccctggcgcctggcggcctgggcttttgcaggaaatgggcggcacctgagtcgtcgtctcacctgccgctgttttggagtacatttgtgctacttgcacaagaaaattagccgtactattttgtgcacgtgatgtgtttgcgcgtgcccagtggctggcggtgaacgaactggtcacttgtacaggccactcaggcgaagttgcagagtacagtgagccattctacatctacctgtctactctcattgggcctaaaagatatcgcaacaagaaagagagcccacagcaaatcacgcctagtggaccttaggagttaggagcccgttcagcccagaggaggaagcagatcataacgcaccggggccttccaaaggtagcgactggctttccgtttgtcgttacaccatcgtcatgggccttatggcaatggcacagtactgtactccctctctcctctctgtctcttacaaatttaagatttgattttgctatatctcactcgaaagattttttcttatctctcactcgattttctcactcaaatttacagtgtattttcttgtaagttacagtgtaatttataaaacttatgctgtaacttttgtaagttacactgtaatttttgaatcttcgcatgtaaattttaaattttgtattggatttggtctttttcttgaggatatggtaatttagtgttcattatggtgtttcttaattgctttttgctttttattatatctatcggattttaatccaaatattaaaaatctgtgtgatacgatcataaaaatctttcgaaagatgtataggtactccctttaagattaacatgatatattctaatacaacgaatctggatatgtcaaattcattgtactgtagtactaaatcatattcagttatatattcattttcttagaatggaggaagtagtactactctgtccctaaaaaaataaactctagctaaaaatctgggcacgcatgtgtcatctgtccagattcataggtatgattttttttttgcgacagagggctacttctctagttttttttttatggttgtcctagcctattcttctctagaagatctgcgtgatctaaacaaggagtgcaaagacaagtgcaggtagactcagatcagacgtctttgcacgctggtacttgtagctggattgctggaagcttgctcagggcacccgcaattcgacccctacttgagtggcaactgagaaaccttgatctcagcttttcttgttaatattttcctgtacaatgcattttttgtggtggttagcagtgtagtattaatataagagagaaaaatcttggatttgtcaccttattaaggctgtgtttagttggggaaaagaaattttttgggtgtcacatcagacgtttgaccggatgtcggaaggggtttttggacacgaatgaaaaaactaatttcagaactcgcctggaaaccgcgagacgaatcttttgagtctacttaagccgtcattagcacatgtgggttactgtagcacttatggctaatcatggtctaattaggctcaaaagattcgtctcgcgatttatagctaaactgtgcaattggtttttctttttgtccacatttaatgctccatgcatgtgtccaaagattcgatgtgataggtgaaggggaaaatttttgggaactaaactagccctaaggtagtactactagcattgtaaagtgttttgatattattgaacgtgtgaaggatggatcttgctatagttctgcagccttttcccaacagtatatgcctgtgctgtccaatcatgggaagggaataattggggcgggacaagccgttggttttgcacgaggccaatcgcgttgctctccccgcccgttgaaagctcatcacggagaaaacttgcgagttactctcctctcgagctactcgcaacttgcaatgttgcaacagattgtgcgcgccggcaaagccatcagcccatgccccatgcccgttaccgtgccgtgtcaccaacaaatcaaaccgagcgccaggtgatagccagaggccgccgacctggcctgacaccggtgggtgggtgtgtgacagtgtgagaggaacaagaggaattcgcgtgaaacatcgccaaaaaacgcccaaatttctcgtgggattcgtgtgaaatccgagcaaaactcgcaaaaaccggtcgactcgtgcgtgcgtgccctaccccgtgtcggcgtgtctcgcggtgtcccaatgggaccatctctggtcgttgcctgtcgtccgtctctggttaccatgcgacgcgacgcgatgcgaagcgacggctcgcgtcgcgagtcgcgcgacccaccaccgacccggcccaccgcgagcgagcgcatctccgcgcgccacgaggccgccgctggcaggtgggacccacgtggcccaccaccaccacctcctcgtcctcttcctccacctccccccctctctctctctctctctccctctcctcctcctcctcctctcctctctcccgtcacgggcgcatctctctctctctctctctctctctctctctctccccgcacagccgcgccgcgccgccgtcgccttctcgggcgagggcgaagagcgagggctcctgctcgccgccgcccctccccctcgtccgcggcgcgccggaggtcaggtaggagccccccccccctccgccatccctctctcgcatacactctcactcctccctcctcttcatcatcctccaccacgttgccggcgcgaattggcccgagcgtttgggattggggacgtgggaattcctcccatcccgtcctgcttctcgtggagagagatttcgcctgcggatggattccgtacgggctctctctccgcgccgccagatccaggaggggagttcgtgcccgcgatacgctccagtgggcaatccggtttcgctttctgtaggttagctgggcaggcaattttcccatgaattgatttctgggattggggggcgagtttcagtcatctttttccgcgggataaattgatgtttgtttttgtgttcctaccgcagtaagttaaactatgcatcggtaactcgtcgagatccattgatgtgctgtaatatcgtacttaatactcctgatttgataatagctatgaagattttgtgtctcctaaagagcacaaaaatgttaatatgcttcgactgggacttaggtagaa

SEQ ID NO: 42899 - DNA, 9297 bp, Oryza sativa
tcaagatacttagattatttatgcacccacatatcattcgcctttatgaggtgatagacaccccagctgatatttatgttgttatggagtatgtcaaatctggagagttgtttgattacatcgttgagaagggaagactgcaagaggaagaagctcgacgctttttccagcaggtaggctttgtaccattttcctggattggtttttaaggaatacactcagtaatcccatctctagttagggtttgcacaagttctaaatgcagcaagtcactgtcaatttttcattttctgttgttgcttccgcattacagatttggtaattttttatatgcattgtactgatatgcttcagttagcatccgaggataattttcttttgtttgatctttgaattagatcatatctggtgttgaatattgccatagaaacatggtggttcatcgtgatcttaagccagagaaccttcttttggactccaaatgcaatgttaagattgcagactttggcttgagtaatgttatgcgtgatggtcactttctgaagacaagttgtggtagcccaaattatgcagcacctgaggtatttatcttgaatgatttgcattattactccttcttcatgattgcataattgcttctatctttctttacctttttcaattccttttccatttgactaggtgatatctggtaaactatatgctggccctgaagttgatgtgtggagttgtggtgttattctttatgctcttctttgtggtacccttccatttgatgacgagaatattcccaacctttttaagaaaataaaggttagcaaagatgtgatatatcctactgataaaggtgctgcctcatctccttttatatgttaaagtaaaactctgtccgttttgatgttctagggtggcatatatacccttcccagtcatttgtcacctttggcaagggatttgattcccagaatgcttgttgttgatcccatgaagaggatcaccatacgtgaaatccgtgaacatcagtggttcacagttggtcttccgcgttatttagctgtgccacctcctgacactgcacaacaggttaaaaaggtaacatgctgccattatgcatctaactatttaaagccgtattctgcttttgaaactttcagtgtttgatttgatcaatgtgagttttgtagctcgacgatgaaactctgaatgatgttatcaatatggggtttgacaagaatcagctaatcgaatcacttcacaagagactgcaaaacgaggtgtttgcttcactccattgctcctctttgttgtttcttggggaatgcatgacaaagtttctgaataatgtgcaggcgacagttgcctactatttactattggacaataggctgcgcacaaccagtggctaccttggagctgagttccatgaatctatggtatgtcaactcatctctctctctcatttattgctttctattgattccaaattcctggcaaatgtgctgttccctgtagcactacaaagtttatgataatttggtgctttgctttctgtgatccaggaatcttctctcgctcaagtaactccagctgagacaccaaactcagccactgatcatcggcagcatgggcatatggaatctcctgggtttggcttgaggcatcatttcgcagctgacaggaaatgggcccttggtcttcaggttttatgctgttactataaggttcttatttattcactttatttattataagttatcctaattcatttgtctgtatttatttaacagtctcgagcacatccacgagaaataataactgaagttcttaaagctctgcaagagctaaatgtttgctggaagaagattggacattataacatgaaatgcagatggagtcctagttttcccagtcatgagagtatgatgcataacaaccatggctttggtgcagaatctgctataattgaaactgatgacagtgagaaatcaacccacactgtgaaatttgaaattcaggtatcattttgaacttgacatatgattattaaccctgggatcatgtatcggttagaacctttgaaatgtagatctgtgcacgatctagttaagtcttacatagttacgcatgcctttactctatatgtgatgattaagctgcagagtatttatgaactgttaccatattcatattccttaaggctatttatgattgaggaagtccatataccgcatctttttttgacgtgtaaagtgtaatgtttggaatattcaatttatgctgatatacttctaattgctgcagctttacaaaacaagggatgaaaaataccttcttgacttgcaaagggtcagtggaccacagcttctctttctggacctgtgctctgcctttctaactcagctgagagtcctttaattatgccgttgtctgcttcccaactgaacttcctgcagcataccgtggattgtcacgtttcatttaagatatgtacataatgaccataatcctccagtagataatatttcctggagtgtgtagacgttagaggctgccagtgatgtattttgacggtaattggccaaaccagaggtaacaggcaggaggcaaacctttctctgtttttttatttgccgttgttgttgttatatgacggtttagacttatctagagtccttgaaccactttgcttgtttacggtgatctttactagcctgattgcccagcctgagaatcacctctgtcgttatgaaagttgagcagttggcatactattgttgatcctgcattccttgacagatgaccgttggatacatgcagagctgttatctttttttttttcacatcataattactcagattggttacccatttgcttctgtatgtgttgactggaatgttaaataagaatagttccctcttgattatactagactgtgcaacggttcatctgagatctgtgctaccattcataaatcaagctggaaatcagatcatgaaatagtcaggtgttaagttattgagaaattcgagcatagatctgagattttaacgaggaatcttagaagggcaatggagtacaaaaatggatatggtctactaaaaaaaatttatgcacagtagtcagcggatagaacagaatcataaattgtgaaagacctattgtaatctaataaaaggttgaaatctgtaaagtaacacgcaagcctctaatccgatctaagctataatttacatcttcgctaatttacacacgaactatgaatccgcgcaaatggtattactgcatcaggtatgcagagtctgctcggctgaagcaaggtgccccatttgctcggtgatctgatcaaccttctcccggtgatggaagccattgcagcctaattctgcttttacatcgtccttgggagactcttgtctttctgactcatccaaacatgaccgtggagtctctgtgaggaaccgctcccaaaacacatcgttggtcggtccatgcgaagcttcagtttctgacgtgccatcttgtgaagtatcagtggaggaggcaatctcagaatttacatcagcttgtgttgggtatcttgtcacatggatatcttcacgaatctctgccattggcagctctggactctgcacaaaacctggagactctgtgagttcagtggataaatggagatgggcattccctgtgttgggtgagctgggatggaggctagctggtaactgaagatcgatgcctgtctccattggagcagtgttcatctcttcaggacatatagcagtgctgggttcagtaccaccatgaccatgggagtacatttcttcagcagctgtgcaagcatcatttgctctctggaagagtttctccagggagaccaggctcagctcaaccctgtcaaaagcctcaccattggtcacaggaagcacgggaggcatggccggtgcatccgtcccaattccctggaactggaacaccttctgttcttcgcccgccgcgcaatcgtcgacgaagagatccatcttcgggaccctcctcttcttgctgaaatggtcggactccagcagcgagctcgacacggcgccaccgcgtctctgcagcatctcgcacagggaggccacgatgttcttctgccgttgctccatcgccactagcctgccttccatcgcctgcatctgccagttgatcacgtactgctgctggttctgcctctggaggtccgcgacgaggatgctcttctcgtacttgagccggttgatctcttcttcgagctcgcgcctctccgattcggcgagtggtccgtttatctggttctggagggagtggctgtgcacgggcttgcgtcgatggatgttcttcagaaggtgcgtgtgccctcttatgaaatcctcgtttgcgaactcccatctctcaggatcgatttttcggaaaccctgaaaggaagatgccaattgaagtcaaaattcagctacggtcaaaccaaccaagaataaagaactattttacagaaaatcaaataggctatataaaaccggctgctgtgtcaatggtaaaatcatccaaacaaaccaagaacaaggaactactaatttacaagcaaacagtagcacatgattgttgcaatgtttgtttcgtttcaagaagcaaaggggattgtgtttgtgactcacgtaggtgttgagctgcctgatgaagctggagaagttgttgtgcttgaagtacttgggcaacaggtcacgggagaagtcgagcgggttccacacgacgaagctggcgccgccggggccccacgacacgacgtggttggtcgccgcgtcctccaccatctcgtacgtcttgatcaagaacggcggcggcccaccgccgccgcctccgccgccgccgccgcccaggttggaactctccatgtcaaccgcgcctctcaattctcaaaccagcagctgctctgcacgatgcaagaacggagcccggtcttaacgcgcgcagcttcgctctcccacgaacaagtcttaaccacctgaatggactcggcgccaaatccaactcgccacgggccaaaatttttcacattgaaccgcggcgcaaattctcaccgagtcgccaaaagacagcgactttccgatcgaacgccaactagttctgcaaaaagaaatgaccagagcatcacatacaagcacgtgtatacacaaaggcgccgcctgaacagttcaagcaaccatagccgtcgaagcaaagaatgcaaagaaattaagaaaaagaaagcccagtgtatgttttttcattatctcctgatacaatcttgcctgccatgccaaggcgcgccggcacgatcgaatcaaccagacaaccacgcgaaaactcacaacctttctcaattctcacctgatcagccacggccacggagacggcagcagctcgcccgacgacgcgcgccctgcacgagcgggagacgcgagaggaggcggcgcggcggagaaggcggtggtggtggcaacgggtgcagggcgtgcagccgtgctagtgcagtggcgcgcgcgcgtcggcgataatatagaggagagaacgggaggcgtgcgctgcgcgccagcgcgagcgagcgtgcggatttctcctctctccggggcgtttggtcgctgcgtgagacggttgactgaccggggaacgaacgagagagagagagagagagagagagagcgcaatcaggagcgcgagggcttctagaaatggaccggcagcgcagcgcgcggttcgctcggcgcggccgcccggcgcgacagtggtacaccggtggtggtccggtccgaccggaatcgatcgtcgctggtgtgcctggctggcaggctggcatcagaccggtactggtagtatttgattcaaccattcaaataccgcaacaggatttcgggatactgtgcgtgttttcctgcatgctttttccatggccatagttaactcatagtagtactaagtaattaataacgttagtacctggtacctatcaaaagctactactaccttcgtcccaaaataagtgcagccatgagtttcagcacccaattttgatcgtccgtcttatttaatttttttttataattagcaattttgttgttataagatgataaaacatgaatactactttacttgtgacttatgtttttaatttttttcaaataagatgagtggtcaaagttgggcatggaaaactatagctgcacttattttgggacggagggagtagtactccatttatcccataatataagggatcttgagtttttatttgcactgtttgaccaatcgtcttattaaaaaaatttaaaattattatttatcttttttgacttactttattatctaaagtactttaagcacaacttttcgttttttatatttgcacaaattctttgaataagacgagtggtcaaacagtacaagcaaaaactcaaaatcacttatattatgggacgaagtactagtttttctgtcctaagatataataaattttaaagaaggtccaacgaatattattgatgagcgccgaatttaaaaaaataccatcgacaagagcaagtttcatgaaatactattatacatgtgactttgtcctaaaaatactgtcatcgttatggttgctaaggagggttctgttagcaacccctccgttaagtggtataggatggaaactttatttaacatcacggaataaggtgaatcctaacgataatagcatttctgggataaagtcgtttatacgagagtatttttggaactcgcactcatcaatgacatttcttaaggttggacgtttgtcaagatattttttagattttctctaaattttacttatgaatattgataaatggggtagtagcttgtactactaggttttgttcgtctattacttttcccaactcatctctctcgtttttccgcatgcacgtttttcaaactactaaacggtttattttttttaaaaaatacgaaagttgctttaaaaaatcatattaatctatttataaaaaagataatacttaattaatcatgtgctaatgagtcgctccgttttacgtacgccgaacattaggtcccaactactccctccgtcacacaaaaaatccattcttagcatccgaaggtggaattaatagatagtgagaatgactaaaatatccttaatcattgaaaaaagtaataagagtgataggtaggtaaaagggtattgcaggaataaaacttctcgttttatgtgttgatggtaggtaagatggtagtgttgatgaaaaaatcgaacacaccggcctgggagatctgcttaactccagtgcaggtccaaaggttggtgagatgcgggcgtgccagtcagtttgatcctgcaactgacaaaatatgcaaataatagataaaacagccgatcggctgacaagctgatggagtagttccagccgatagccgataatagccgatgccgataacagcggatagcgatagggtttaaacaatcggctatatgtccaatgtagataatgatataaaggcaatcggctgatgatgatgtaatatagaaatataatctagtagaaaccaatcggctagcattgatatgatagaattagcattaatccgaaggttaaagcatacatcggctggaggtccgatgtcatgaaatccacaagattagattaaacagtgaaacctttgttgtcatcggctaaatccaatttatatgtatgtgcaatccttatgagccgatgcaacgtccagataactcaccggctgaaaccccgataaaaccctaattggcaatcaagaagcaggctagagattatggttctaagcacgacttagtagatcaaacttaactaatgcagcactaagtatgaaaagaaacatgatatctagacaatcaagctattgactgagttttcagggtggtagatgtctaagataatctaatctagcaacacgatttagccgataccggcagaaaccctaaaacgagaagcagccgatagagctaaattgatatgctaaaactagattaacagagacatatgataaataggtaggcaaatatatcatccaaactagagcaatgcaagaggtcgaatgtactgatgcagccttgaacaacgccgacgtaaacgatacaattgcctggccggcggaacattggacttaccccttagccggagatcgaacaccgatgcagccccgtgtcaggtgccaagttccgccggacgataaaataaagtagaaaaggtaaaaggtggcgatgcgctgaattgtattgatcatgaagatagattacatagaccccgggtgtacatatttatacccatgggttgatacaagtccttgttagacaagaaagaaacttttctaaagataaaaggaaaagataaagttcttatagaacactaaacacactttcctaaagataaaaagaaactaacaaactattcctaattaatagataactttccatgccgcattctctttgaactcggtctcttctgtataagcttcctttagtagatcaatttccttaactgaatatagaaagaatccgacaactgacgacttgataactctcatcggctaatctcaggacttcgaaaccgatgtttactctaagccgatgactactctgagcttatgttgttttttagacaaaattcaaattctggaagttgatttttttttttttgcacgaagggagtgcatactacatacgaactcagcctagcagtactacgatgcacttgacaccgtgtcttgctcttgtatctccaccatttccacacgggaaaaaaactactactccagccgtttcaagttataaggctttttatcttggttaaagttaaactttttcaagtttaactatgtttataaaaaaatatagtaatatttataatactaaattagttccatcaaatcaataattgaatatattttcataataaatttgtcttggactgaaaatgttactacttttttttataaacttgatcaaacttaaagcggtttgatattgaccaaagtcaagacgtcttataacctgaaatggatggagtatttcacaaatcttattatttcatactgcttctaaaaaccaacagcagtgcacagctaggcagactggcaattagcatgtgcctcttcggctcatccttcttttttttcccccatagagaagatatgaaactactgaccgctgaataatgtcagtgttcatggattggaaaaataactttccccctagcatgcaagtaggctgattatgccctccctgcaacctg

SEQ ID NO: 42900 - DNA, 3341 bp, Oryza sativa
cccggtgtgatagttgtattcatagagaccaatttgcaaaacacataagtacagccaaaccctcagccaggaatctttgaacacccctgcacacccggagaagaggagaagcagccccgaagctaaccacgaagtaatgatccaccagatgccatctttgtgtcgcatcgatggacaagaaaacatctaacaaacctgtcacccactgtacatacatcatttgaattactgtagttgatcaccatcaaacattcaggagccagccaaaaacgccatcctgttctgcattctgcatgcatgactgatgagaaaccaggtcatcagtctccgcacctccacagtaccgcgtgtgaactcggcgaccgttccaatgccagatttttcacctcatcccggtggaaatttcatcgcgtgaattcagcatgtggttggctggcggcaacgcaaggcgtctatatatgccgggaacgacagcgatgtctggaagcttccactctctttggtgtcatggtgtgcgttactaccttacctgcgctttgcccccaagagaactaggccatatttaagttcctaaaaacttttcgcaaaaatatcacatcgaatttatatatatatatatatatataaaatattaaatataaataaaagaaattaattgcacaatttgcatgtaaatcatgagacgaatcttttgagcctgattagtccatgattagtcataagtgctaccgtaacccacatgtgctaatgacagcttaattaagctcaaaagattcgttttgcggtttacaagcgagttatgaagttagttttttattcgtgtccaaaaacacctttcaacttttagtcaaacgtccgatgtgacacctaaaaatttttatttcaccaactaacaagcactaattaaacactgcaacttttactatgttacacacaggaggcgcctgtacaattaatactataacatgcagcagatgcatttcaaggcaactgaaaagtacttggttaattaactatcctcagcttcaggtttctgaagattgattactatctgatcctatcattgctcggtgttctagatgaacaacgactttttgatgcaagtctcagtgatgatttcagctgagttagcttgccctgatcttctagattgtacagccgaggatcagtacagacacatggtctgaactatgacaaaaaatgtgatgaacttttgttgggattgtaacatgtgacagtcgtattaatatacagtatctgcttctagaacgaggcatgcggcaagacaaacgtaccgtccggattcaggtgattctgttattgacaatttaacaaacctcaatctaattattatgacaagatattggtcatcgttttctcagaaaagcatctccctggtaattaattcttttagtgactagagtctcatcggttatccaaatttactaataaatcaattaatttataggtaaaaatattatatatttattcgtagagacttaaaagctaacgctaataagatattatattgaaaatatcttaaaattaattttaaaattaaattcgaaaatttaaattttggtttttctttgattcaatggagctcctagttaacagttactaatacggagtaaaatttgacagatttcaacgaagaaatttgtcgaagtttttcgaacatcggactcagaacttaattactcttctgactgcctcttgttagggtaccggatatgatcgacgactgtgcaggtttatgccttggttaacaagaaagatgtgagaacaattttctaaggttggaaaatatgtgcacgtcaccaatcctccaggattattgttcaacccaagaatcttagaatcgttacttcaagtgaaacaaatatactgtacttatctgcagtctgcagagacttttatttcctgtaatatttgtgttgaatctcatggccttattaatgattttttttctttcctaaaacgtctggagggacatgaatcatgctgtagttatccttttttccttctcaataattcaaaattcattcagggacacaaaatactgtcggcaatggtggtctgcggggggaaaaaaaagcctttttttcaggtcagattctatctaaatgtattcttttttttttttgcataatctatctaaatgtatttgatttgaatacaataaggaacttttaaatactggtttattcttgtatctttaggaaataccgattgacttcattgactgcatagtaaccgaagtgaaatatctttcttttttttaaaaaaaaagtcaacccaagaatcaaaattttaaaaaatcactaaagactcctttggaacaaggaagtttggagcatttgatgaaataatccgttataacatagtatctcaaatttcaaatcataagcttttgagattgttcatttcagttggttgtcgcagctacacaatttacggcttgttcgtagtagtaaaagctttctcccgcagtagctgatggtgcgatgactacggctttttggagctgtagtcgagcggctgtgccatgccgctgcagcctaaaaaatcaccgtaacatgccctttgtaaagttgtaggccctgtttgatacagctccaacctataaatttaactctagaagttaagtgtgaagtggagttgtggagctgcctaaacccaactctacaactctagtatattttgtgaaagagctccacccaactccactcctaattttaatggagctgaaactgtttggctgagctctagctccaggaggggtggagctcgagctgaagctgtgacaaatagtcccgtactctcaaaacaacacttcaacacgagctgcgcagtgcacctgaaaatctgacggccccaaccaacgaacgcccgtgagttagggcctgtttggggagctttagattcttacaagcagttgtttggtagccagcttctgagaatctggaaaagttctgaaatccagcttctccagcttttggcttcttagttcatttttgagaactacagattctcaaaagctgtgaactatttaagacaacttttagcagaagcagtttttctgcagctgggacaagctccccaaatagggccttagacctaacccgccccgttccgtttcgccgcggaaactgaacggaccacgtggcccccctcaccgtcacgcaacgcgaatacgctatcacgaacggcatccagccacctgtccacgtcgcctccgttccgcaatccgtccccaccaccgcggcagccgctgccaccgccggtctccctcctcctccaccaccactccatcccccgcttcgcttcgcctccacaaa

SEQ ID NO: 42901 - DNA, 4811 bp, Oryza sativa
  unsure (1)..(4811): unsure at all n locations
cgcggcgtggaaccatggagatctccttcgacgcgtgggtcggggtgcagcggcacgggcaggacctcgcggaccgcctcgcgcagggcttctcgggcctcctcctccacgcgcacccgccgcagctccactggtccgcccccgcgctgccggccaagctgatacccttcgagatcgacctccccgtcgtccccttcgtcgtcggagggaggcgggccgggggcgggaggggcgccgccgacctccccgccgcggccgtcgcgtcgttcgtcgagatcggcgggcggctcggccaggcggggtccgagctcggggcgtgcgtcgggggcgccgtgcagcagctggcgcggcagatccttgtcccgttcctggcggagagcgcgcggggccggaagtgggaggcgattccgccgcagcctgctgctgcggcggcggcggcggcgacggtgaatgagggggaggtggctctcgcggtggagagagctgaggataaggggctcgcatcggagagggtcggagacagagggcctctcgaggtagctgctgcagcggccgcggcagccactggaagtgccactgcgactagcgttggtggtgcggaaggtggtttggatgaggaagatgatgggttcggatgcgatattgggactattggtaacttcaagaaggctaaggtacacattaccgatttgctgatcaaatgttgcgtcgtaattaccacttacctgttacacaattctgcaactgtaattggaagcaagttcaatcggatactcagaatgtgcttaggagtgacatttgtataggttctaggtttatttggggtgtaaaactgtgtatcttgtctgaatgctgaggtagtgagattttagagggctttggtgcttggaactcattgatttaatatgcttggaatcttcttttgcatgctcatagaaagattctgtccatatgcttctagaatagccatgcatatagttcaaaaattatttttctaatatcagaatttaagtataagcatacaggatcggtactaaatgtaaaggttcaaattttgtagtggctggtgcatacatttggttaaatctaatgatagctggagtgcagtgtgaattccatttgctgaagtacatattattatgctgaacatgatgcagggaaccataaatatctcagcaacatacgagaccaggcaccatgactttgagacttcagttgttgcacgtggggacctttggaggttggagtcgtcgcgtggtggttcaaattctggcgatgaaaatgctccgcttttccttgttcagctgggacctttattatttgttcgtgactctacacttcttttgcctattcatctgtcaaagcagcaccttctttggtatggctatgatcgcaaggtacttttcttcccagctacccaggtcttgatctgaaatcttacatgccataaactttttgcatcatagtgttttagaatctcaatgatataattatggtgcaaataatgcctatcaacgtgcattggcttgtattttgttgcatacccatactaatagtctaaaacttgtgtgtttattttagaacaaaatgcactccttatgtccagctatctggtcaaaacatagaagatggatggtgatgtcaatgatgtgcctcaatcctgtaacctgtgtaagtatgcatgttccttctttgtctttttctttcctcaattccccctgtttcctagttgctatcaggtatcagttatttttatacttcagtatgatggactggttttgcaaatcatcacttttcatgctacgggcatgcaaatccagtaacaatgtttaacatactttactgttacattttgtcacgtgtattcgtgctatcaaatgatacatgtacttatcgtgttctttgtagaaagtttcctatattgatgattactttctgatgcaattggctgtgcagtgacttgatttggactcggatgtagaatcttgtataacaagaatatcaaacctactcataactttttgcaacagtctcatttctaccctcattgttaacttggctatttgtttcagtctttcatggatgtgcagttcccaaatggacagctaacatacgttgctggagaagggataacagcaagtggatttttcccattctttggtggtttgcttcaagctcatggaaaatgtcctggggaaacaagattaagcttctccttcaaggttagtgtctgcataataagccaactgtagctccacttcatccttccaagacctgttcctaattatttcacctgccatgcttatttcctgttgctttgcttttgaagagcaaacaaggcacaaggttcacccctatgtttcaatggcctgacaattctctttcatttggagttgcacaagccttagcgtggaaaagatctggccttatggtgaggcccagcattcaagtcaggtagttagatataaacacttctgcaactcanagccacgttagtcaggcccagcacaaggttactcgactatatttttntgggtcccacatttattttccacttctgatttccttgatggaactacatgcatcagtgtttgccccacatttggaggaagcgatcctgggatacgggcagagtttgtccattcattgaaggaggaactcaatgtaatgtgtggtttctcttgtgccagacatccctcggccttcacagctgtttctgtaagctctcagatcatgttacgcttctgtttataatcaagcacacgctttactttactgctaactgatgtccttgtgtgttgctatgcatccgcagctcgggcgatccaagtggaatggacaagtcggcagttcaggactagtaatcaccttggaaacaccgctggacaacttggctagaccatctttatctgttcaattgaatggaggttttgagttatgacgtctattcctgtaagctgtacatatcgctgtatatattgcacggtgtccatactttcatgtttctggagagagctgccaacctataaattgtattatgtggacgttggttgaatctccttttagtgccccttattataggttttagcccagcaccaaagtcgcaattcaataggtaaggaagtaagtagctggagctgttgcaggtgcgaatatgttgcgtccattttgtcgtcatcgcttgtaagtagaatgtatgtattgctgtagcacaccataatatgggttcctgttgccattgttggtcaatggtctggtcgacattgtagccctcgttgtcacactgttttctgcgagggaaatgattttgtacttttgtcctctggagtttgaactgtacttttgtcaagttacccttatgtaaccaaaatgcccttgacaaatgcttacatagtgtttgtttgactctttagcgcgctgattttacttatatgcaataaactaacaattgcaagtatcacatttttcaaagaaagttatgattcgggaaaaaaaaatgcttgattaatactgttggtctaaaaaataatccaccatatttgtgagttctaaaatcctcttgcaaatttaatactctagttctttctccgtggaacaaggagtttacataggaaattcgtaggattgaaatccgaatttttcatatcaatctcttaggtttggaagattaggctagaaaatcattaaaggaatccttcctttcgttcactttttagaggatttcaatcataaacttattaacctcatagtttcattatctttgagaagtccaatgtaccatctttctttatctctcctctgaacttataaacctcttaagaattttctatggagtatccaaacggcttatttgacaagttcttgtattttccattcctgtaacttgcctattatatggtacacccacatttcaaaaaaaaaaaactgattttgggacagaggatgtatgcaagttgtagatatctaaactactcccttcgttaaaaaaacaaaactagatggaaatacaacagtaccaaatacaacaaatttggacggtcaactgtttatattcgttgtactagattgtgttacatccccacattgggtttttttggacggagcgagaatgttaggccttgtttagttggggaaattttttgggtttggttgtcacatcggatatacagacacacatttaaagtattaaacgtagtctaataacaaaccaaattacagattccgccaaaaaactgcgagacgaatttattaagcctaatccgtcattagcaaatgtttactgtagcacaacattatcaaatcatggcgcaattaggcttaaaagattcatctcgcaatttacacaaactgtttaattggtttttttcttgtacacatttaatactccatacatgtgtccaaacattcgatgtgatgggtgaaaagtttttgttttgggaactaaacaaggccttagggcctgcttagtttgcaaaaaaaaaaaaaaaattggttgtcacatcagatgtttgacaggatgtcagaaggggtttttggacacgaatgaaaaaactaatttcataactcgcctggaaaccgcgagacgaatcttttgagcctaattaatccgtcattagcacatgtggatacccggccgctacacgctacgccggtcccactcacgaccgtactcgcatcggccaccggacgcgccatggacgtgagggtcgcgccgtcctggctaccacccgccggccgttgaggccacaaccgaatgggcgcgccaccgcgcctgcaccaggccgggcgcactcccctgcgtccgcgccatc

SEQ ID NO: 42902 - DNA, 9553 bp, Oryza sativa
catcagatgtctgacaggatgtcagaggggtttttggacacgaatgaaaaaactaatttcataactcgcctggaaaccgcgagacgaatcttttgagcctaattaatccgtcattagcacatgtggattactgtagcacttatggctaatcgtgtagtactaattaggcttaaaagattcgtctcgcgatttcctgcataactgtgcaattattttttaaatctatatttaatgctctatgcatgtgtccaaagattcaatgtgatgtttttgagaaaaaaatttgggaaactaaactaggccttagtattccttttcatttggaacagtggcaactaccaagttgtccttctagtcaaaacggtttaattgtgttgttttgtgaaacttcaagactataatatctggttgtatatcaagttatcaaccaatgtggaccttgacgtttagtttccttaaactggatgtttatttactgcaaaagaaatcatttacatcagccttacaacgtagaccctgtttagttccccaaaaactttttaaaaaatatcacatcgaatctttggacgcatgtatggagcattaaaccgtttgcactgtttgcatgtaaatcgcgagacgaatcttttgagactaattagtccataattagccataagtgctacagtaacccacatgtgctaatgatggtttaattaggcttaaaagatttgtctcgcggtttccagacgagttatgatattagtttttttatttgtgtcggaaaaccccttccaacattcggttaaacgtcctatctgacacccaaaaattttcttatcaacaactgggtgtgtttagttcacgcaaaaattaaaaatttggttgaaattagaacgatgcgatgaaacagttgaaagtttatgtgtgtaggaaagttttgatgtgatggaaaagttgaaagtttggaaataaataaggcctaacggcccgtagcaaaacaaggcagcacatgcagcaaagtatgcagctggccgaaacatcacaagagaagattacgtgtatggaacagaacaccatttccctcaacaacaaaaaagaaaaagaaaaacaggagtgcaccaaaacacctgaaagaatgcaactgacatgacaggggaacaaaacaacgaccctcaaccctgaacctgaaccccggtgtttttccttttttttttttttggcgatgaagtgagtgcaccatgattgcattgcgcagtgcacaaacggcatattatttccagccagttcatccacagattgtgccggatccatcttcatttgaaaaaggaccattttatgctctaattcgatctaaagtgaaaaggttaattgcaagcagaggaatcaagaaacggcaacagagttctcctacaatggtgtccatgtcagaaagtccagaaccagaagaagctagtgcccaacaccaggagtcggcactggtcgcattaaccgctcggctctgccgccgctcgccgagaatcccctcggcctcggcggcggcggcggcgccagacggctaccctgagctccaagccgccctcgaagtgcatcacctcatcaccgcctcgctcctccgccgccagcataagcttccgcccttcgcaccgcgagcagcggagcaggagcacgacgaggaacgcggcgaggcacgcctccgcgaacctagtgacaccgtagccgcccatggtttggatggtcgagctgcttgatgctactctgctcagtgagtgacagagtgagcgagtgagtgaagctgcttgctcgagttagctaacgaagacgagagggtttctattgctctatttatagcgatcggcaagacgattgattcctcgtggccggcttagagctcttcatgcaaactacagacaagaacagcatagtggaaatgtatacgtgcgacggcataaatacttgattactcagtgatttagtcatagattgttctcaagaaaccggctgactaatccgttgtttagacaagaaaccggggctgtttttagctttacagtacctgcttaatttgttatgtcaagcgtctcgagaaaagaacatttggcagcataaagcatgtttcactgcaaatttcgtttcttctatcttcttattccatctccttccgcaaccgtcggccgatgcggtggcgatggcgcggacgcaggggagtgcgcgcggcctggtgcaggcgcggtggcgcggccatgcggttgtggcctcaacggccggcgggtggtagccaggacggcgcgaccctcgcggccatggcgcggccggtggccgatgcgagtacggtcgtggctggggccggcgtcgtgcgtagcggctggtggtgtaactccatcaaccggcgttcaccggcgactcccagtcggcagcgacggaatccaacaaaaacaacaaaaacggaatcgggaggatgcgaggaattctttttcgcaattcaatgtccaagatgcaaaaggattcaagagatttctctaccttcttctttttcggtctccgttagaacatcgtgctgataacgtattatgtaactcctttgctacatccgtagtctagaggggttgcataatgtaaagtgaagatacaagatataagggtgtggcttattctcatttattcttctagcaccaaatgtacaatatgagcatccatctccttcttatacagccttccttcatatatggaaggtttggaatggacccaattagtgtatatgggctgggtcttcataggcccaagcccataggtttcctaatagttttgtgaaacttcaagacaataatgatccctccgtttctaaatgtttgacaccgttgactttttagtatatgtttgatcgttcgtcttattcaaaaaaaattgtgaaatatataaaactatatgtatacataaaagtatatttaacaatgattcaaatgataggaaaatcattaataattacttattttttttaataagatgaatggttaaacatgtttaaaaaatttaacggcgtcaaatatttagaaacggagaggtagctggttatatatcaaccaatgtggaccttgacgtttagtttccttaaactggatgtttatttactgcaaaagaaatcatttgcatcagcattacaatgtagcaaaacaaggctttcatttgccgaaacatcacaagagaagattacgtgtatggaacagaacaccatttccctcaccaacaaaaaagaaaaagaaaaacaggagtgcaccaaaacacctgaaagaatgcaactgacatgacaggggaacaaaacaacgaccctgaacctgaaccccggtgtttttcctttttattttggcgatgaagtgagtgcactacggttgcattgcgcagtgcacaaactgcatattatttccagccagttcatccacagattgtgcccgatccatcttcatttttttgaacgaatagatccatcttcatttgaaaaaggatcattttatgctctaattcgatctaaagtgaaacaagcagaggaatcaagaaacggcaccagagtcctcctgcaatgctgtccatgtcagaaagtccagaaccagaagaagcatatatagcctgttcactttgatgtcattttcaagcttatcaaattttagtaaaattgctaaaaaagtggctatatttagtttgctgctaaatttttgtaactatataagaaatcatgccaaaattttagcttgccaaaatatggtaaggttttttttttgacatcaaagtgaacaggcttttagtgcccaacaccaggactcggcactgatcgcattaaccgctcggttctgccgccgctcgccgagaatccccgcggcctcggcggaggcaacactgccacgccgctgccaccgccgcggcggcggcgccagacggctaccctgagctccaagccgccctcgaagtgcataacctcatcaccgcctcgctcctccgccgccagcataagcttacgcccttcgcaccacgagcagcggagcaggagcacgacgaggctcgcggcgaggcacgccgccacgaacctagtgacaccgtagccgcccatggttaggatcgagggtgcaagcgactacccgcgaaaacccacttatagacttatctaaactacgaaatcgtttattttgatctataagtgggtttgcgggtgacccacttgcacccctagttaggatggtcgagctgcttgctgctactctgctcggtgagtgagtgagagaagctgcttgctcgagttagctgacactgctctattgactatttatagcgatcggcaagatgattgattcctcgtgatcggcttagagctcttcatgcaaactgccggcttgaaaagcgtatctttttttctgaaatagcagtacaggttttgttccgttgttctctttgaaaggactagcagaagcagaatgtctatattgtatacaagagcggcatagtggaaatgtatacgtgtgacggcataaatacttgatttcccagtgatttagttatagattgttctcaagaacatgtcaaccagctgactaatccgttgtttagacaagaaaccggggctgtttttagctttacagtacctgcttaatttgttatgtcaagcgtctcgagaaaagaacatttggcagcataaagcatgtttcactgcaaatttcaaacctccttgatgaagttgaacgaatcataaattaagtattctactggcttctcctaatcgagaggctttatatagtatattaaattgtataaaaatcgtagcatggcgcgtcatcatcctggccataggggcttcttgacctatcagaaattcagaattaactgtttcagcatccgaatgtcggcctggtagtggttagccgctggtttagagtctgaaaacgaaaagaatcaatggcggaaacggtcggtcttcagatgggggagctttggacgaacggctaagagccaaagggaggctaaatctgactcgagaacgcattgcagccggccaggatctcaacatctggtgaaagctgcgtcgcggaaagtttatgtttctttctgaaccatttctttctcccatcttctcgcgtcgtttcttcatgcagccaatcaggttagcttgtcaaaattggcatattcgtcgcttcaccggctaagaaaaactactacctataagagtatatcacgattgaaaaaaaaaactgccctttcttttaactgaagaatgtctatgaacatgcaaatattcagagttatcatggccgaccatgatagttttgcaaaaggggacggcaaaaaactactagcacacagaatgtttgcagagaggcctttctgtgttgtaggttaggtctttaaataattccgtaaactacaaggatgatgacataaactgctctgcggagaatatgcttaggagataaacacactcagttatactcgatcaagatcccctgctcgctgctttctgaaagcataactccaaactgaaatagagctctacgtagcaactttgtcagtggagaatgtagcccatcatttcaagtactggacagcaaatatgatactgaacagcagcatgattcttcgggtttctttctttgattagcgagacccaaaccacgtccattatccacaaaaccaagtgctccatcggtttgactactactatttccaatttttaatagatgataccattgattttgaaaatatgtttgatcattcatctaaaaataattacataaatattatttattttattgtgacttacttatcattaagtgtaatttaaaagtaataacttacattctttttatatttatacaaaatattttataagacgaatgataaaatgtatatatacaaaatatcttcgtgaatctcaagatatataggttaggatgtatatatgtgtgttataggtgagtgtaacgcatgtttatatgatctcctcctccgttccaaaaaaaaaaacttaatcctagatttgaacctgaacacccaagtttggttttttttttatggagagagtaagcgcttaaaaaaaaaaggaagtatacatcccacggacaccgcagtggctccaatgctccatcaacgccgtccatccgcaacagtcggctcatcccagccaccggagagctgaacggcggagaagacgaccaacccagccgtacgccgtcgtcgtcgtccttgtcaccgtcacccccagcttgcatccgcccactgtcaccgtgtcagcgtcgcgcgcgtcgctgccagctcgtgggcgaaaaggcctcgtgccgcacagcacagcgcgcgattggacgtacggtttcgacgagcaaagtagacgcgcgcggcgacggcggagaggagcggagctccctcgcgcgacgtggcgcagcgcgtggaggagaggagtcgcccgcgttttcactcctccgcctttgtagcgttcgcggggatggggacagaaacgaaggacgatacggatcccatcccatgccgcaatcgccgtcgccttcgatcttctcagaggaaaggaaggaggaaagaaggagacgatctccctgcgtgattggatccaaccaaaaacataagacataatatacgtcctaggttgtgattggatctagtgtgctcgcgtgttcttgttctgattagggggcgtgatgtgactacgaatttgattgagttttgattattattaaatttttttcattttctttctttagatgagtacatcaggatccgagagcgattcggtggccgcaaagcgatccatgaagcccaagtgtacgtgcccattcttgcccctgtctctttaattgttctctgattttcttttgtttggtttggttacatgtctaagatgaaatgtcgcaatgtgtttggaaattgatgagagtttcagttcagggttctttctttgtttcttttttctttctcctgcagattctaagttcacgcagcaggagcttccggcatggaaaccactatatactcctggaattgtatttactcccaatctctacattctgttcttaatttcttcctgcgctatcaaattatttttatcccaaaaatggagtgctagattttagcaatctctgaataatgtaacctggctccatgaataggtcatcggggccttctcgctcatcggcatcatcttcataccgatagggctcgtttcaattgcagcatcacaggaggtaattgcacagatatgcaacatgtattcttgaattctgattatttgactattccggcactacgtgaaatacatttctgcttatatttattaactagctaaatgtctgtactttgctacggttaaatgaaaatgtattaatgtggtgtccatctttttctatagagaatattcatcttaatctcaatttttatgtatctatctatttagatttgattttttaataatattaagaagtttaagggataacttaataaaatttacaatggaagtaggtggggtggctgattcacggccaccaccattaacttcttttaatggtaatttttatcattcttaagaaaatactggcaagtactttttcaaagacaatagaatttctcttcttttaaagaagtatagaagtatagatagtctggcttgcaacggtgggttaaatttgtatttaaactcatttcttttaatacagtgacgttgcaaagttcttacgcgtttgtcaaaaagaataatctggcttgccatgcaggttgttgaattggtggataaatatgatggggagtgtgtgacggctaacgacaaggtcgggttcattcaggacaccaagactgacaaagcgtgcaccagaacgattactgtaagtttatgcccgttcgtttccttgtttgacagttgcaacttccttgtttttcattaacttacatcttaatactaaacgtgtgttttttatagtagaagtttctttagaaaatcaataaatatatatttcaagtttataatcatttaatttcaattaactatgcattaatggcttgcctcgttttacgtcaagagaaaaactaacagctactatggtggtgtttggatccagggacttaactttagtctatgtatttagacactaatttagagtattaaatatagactacttacaaaactaattacataaatgaaagctaatttgcgagataaatttttttaagcctaattaatccataattagataatgtttactgtagcatcacataggctaatcatggattaattaggcttaatagattcatctcgcgaattagtccaagattatggatgagttttattaatagtctacgtttaatatttataattagtgtccaaacatccgatgtgatagggacttaaagttttagtcccatctaaacaggtctatgttcactagaattgagccttagatgacacaactacacaacatggttgcccttagctcttaccagatttatagtatccagtaaataatgatttttctttactcatttttcaggtgccaaaacctatgaaaggccccatacaagtttactaccagctggaaaacttctaccaaaaccatcggcggtatatatacgctagacctggatgagtgatttcaacttaattaactggccattgtggtaccgaaatgaacactaacgtacaacaatcttaattcttagatatgtcaagagccggagcgataaacagctgcggtccaaggagttctcaagtgtgataaaaacttgtgatcctgaagccatcagtgaaggcggagcccctattgttccgtgtggcctcatagcatggagcctgttcaatgacaccttcacattttctgtcaacaagaagactgtccaagtgaacaagaagaacatagcttggagcagtgacaggaccattaagtttggcagtgatgttttccccgaaaatttccagaagggtgggctcataggtggtggtcagctaaatgagaaattaccagtaagtgcagtcaaatcaatcatctttatcacactagactgctcttttcgtgctaacgcgaatattagggaataacataatatcgaataattagaaggagtgaggcttcgaactcaggtcgcctagcccaccaccttattgagctagccggaaaacccctaggcgtttctcgtgctttcttttttcttgaactgaattgtcctccatattcagttgagcaagctttctctgcagttaaataggtggctctccattgttcgctcttcatcttatcggtcatagctaaaatttaaattttcaaacttaattttaaagtttattaaaaattttttatcgtagtttattttctatattgattttttaagtcgctaaacacacataaggaaaagttttgccctataaattatatttttatcgttaataagcattatggcctataatcggctgctggaagtaaatttagttacagctttatcacactagactggtcattttcatcattctttttttttctgaattctccttcatgtttcagttgagtgagcaagaggatctcattgtctggatgagaacagctgc

SEQ ID NO: 42903 - DNA, 3003 bp, Oryza sativa
gagcggggatgttcatgtgttcatgtcccattgggttcgtctgcagcgttggattaaaattgtgtggtttgtagagagcaggatgaggagggggtaaatgaaggggaatataataaacgtttggcccggccaaacctggtccattatgttagcccggcccatttagggagcgacccaaaattcagtccctaaatgggcctaccaatttggccctgtggttcacgtggcaatttttttaattatttttagaactttaggggtatttttttaaaaaaaaacgaactctctcaatacgaatggttaaatgtttatatttatattttttaaataagaatggttaaattttatatgaaaagtaaattacatcatacattgggatgaagagagtgtttatgtatttatacaaaatctagatcttatcatcctgtctaccatggcaacacccccgtggcatgacatatgtagtggcgtagctaggatttaaagtaaaggtggttcatctatatgtagtatgtcaattaaaagggtgatccgctatacaatttttattatattaactagcacatatactataattttaaatttttaggtggtccattgaccacggtgccacctagctagctacgccactggacgtatgtattgttttgccacactatttaaactaggagtccaaaatatttaagttccaaagcaaattttgggttctatttttagaattttctattaaaatggttttcaaatttttaaaaatcctcaggaatgcagccgagcgtccgaagcttgtgcactgcatgagcgttactcacactgtgtcacactgtcccgggtcaaatgtgcaggcaggtggcggtggatgtgcaggtatcgtgtacgtatgcaacgctgcgacttgttagagcaagtttaatagtgtagccagctactagctccaatttatttagagcaagtataatagtgggttataagctggctaaatggtaaggtggaggagagaagagaggagagagaggagaagcgggctgtaaacttaccgccggtttggacacaagaaccaaaaaactctgtgagagagacaagtagaccatgtattaattataaagagctacactattatatgggtagactgagagaaggctatagaaaaccttatagccaacaggtcggctgtattattagccttgctcttatagccaatctaatagcttattcatataatagttatctatgaacatatactacatcattaatatatagtttcacctttcatacacacgatgtattagaatccgtgttacagctgattatatatctgtagcccgctttccttctatcttttatcttatcttctcttctcttctcttctctatgtgcttacagataactattatatgaataagctattagattggctataaataaattgaagttagtagctagctacactattaaacttgctctaacaagtcgtagcgttgcatacgtactcgctcgttccatacgtactcgcagcgtaacaaaatttgcttctcttctctatatgcttacaggtaactattatatgaataagctattagatataacaagtcacagcgttacatacgtactcgctcgttcaatacgtactcgcagcgtaacaaaatttgcttctctatgtacaatagtctgctattgtactcgctcgttacgtgcggccacaccgttagtcagaggaacagagggatcgaacgacgccaaatgagggggagaaaacgggaagcaacagcggcgtgaggcgagggatctcgggttctcgctggcttcacgcaattgccaacatcctcgagtagaagtgtaggcgtcactcgatccgtgtagaacaactgaactaccagacgttcgtccgtcctgggaccgaccgaaattaacggtcgccggcatgcaccagtagtcgttggtgtcggcttcaccagtggcccagaatcgcccaaccgggcagtttcgcgtccgcgacctgcaaattttccaatttcactaatccctccctgtgattgattaatctggagtattcggtattccacccacgtggccgtgagcacgagacggcacgagaactcgacgaggcatcgtgtgctgtgtgcgcgcgtttgtacgttgctcagcgagcgaatgctaccggcaagtgtcaagtggcaccgcgtttcgcgcggcgctcctcccgtttagcccacacaggcacacgcaccggcacgcgctccgcaggcggatccaatgtgggtacaaggggattagtctcacaaaacccatagataccccctaaaccctcctcttaatttttttatcatagttgataagatataggtgctaaaggtatcataataatattttagcatagtttaatactgagattatatgtttatatcggtgtactgggtatgttgagtcccctaactttttatttctgatctgcccctgcggacatacacgagcttttgcacgcacgcggtgtgccccggcaggccggcaccgtgctacattgccacgttggtgtgcctgaaaagcggctcaacttgagtgacatttgagctagcatagctatatcttgacacgtcatttttttccctctacgaggtcatgttcttttcagctgtgtcggatcggattatttgctcctatctctaaaacggcattttaaaagataactttattctacttcattgcttagactatttgttctagtttttcaaaatatatttctcaaaatatctaattcattttaataattttcacgaacgcgcaaaaggatcgcatgttaatatattagaataaaatagagtttgtttacccaacgcaatcagccagaccggcttataccaaggaaaggaagatatttcaataattaagtagtgggcaattcatggcaataattcacatagtaatctagataaaaaagaaataagaagacacgaaccaagtgatgggaaatgtaaaagtttttcaggtgggggggggggggtgaagctt

SEQ ID NO: 42904 - DNA, 5939 bp, Oryza sativa
attcctgcagccctttgcctccctctatttttgtgggccgaattcctttccctcggcccatccctcctctcagcccgtttcccctccccttcgcacgtgctgagcacgcgcgtcgtgcccgagccaagagagagcaccgccctctctctctctcgccctctctgcttcctctctccccggcgccgattcccgccgccgccttttgaacccgccaccgcctttagttcccgcgcacgcgccggtcgtggccgaccgcccggtcgccgccgcagtcagcgcctgcgtcgtgctaccgctcggccccgctgcctgccgcgagctctgcagcgcgtgcccaagccgctccacccgcgtccatccaaatcctggaggcagagcactccctctcccacctccttctcccaaaccggcatggtaaagcccccctttccaccgtcctctcttctctttttccctcccaagcaacgacaccatgcctccactccttggccgctagtgctcggaggcagagacgcagacgccagcgccagctcgccgcccccaccttgaccgcgccagcccgcgctaatcctcccgctcccgcaatttgattctcgccgtccgatccaccgccttcaccgcgcccttgcatccacgccatcgctgtgttcgcaccgcccacgaactgcctttgttgctcgtcagccaagcgccaaccagctcgcccatgcctcccaaaccgacctcgctccactataaaaacccgagcccctcccatctccctcgttgtctcgcctcctctccccaccacaccattgccgccttgaccgccgttgtcgtcgtcgcgcgtgccgtgggagccggcgagtgagaggagccaaagaggagctccgggccgccccatcttcgcactccctctcatcttccctgacgcactcgccccgacgccgcgccgcctcggtgtcatccgccgtgcgccgcctctcggtcgcgtgccgccatcggccttccatccctttccatcctcaaatcgccgccgataccgtttccgcacgccgatgagctccttgcccaaattcttgccatttgcatcatcttggataagccccgagccgttcggttgctcgctcgtccccctaaacatgccgccccgccgttgctctacttcgccgccgccgccgcgcccgcctgtgcaccgccgtgggccccctcgccaatccctcgcgccaccaccgtccttgagctccctaggacctccccaaaccattccctagcgtcgtcgccgcccggcacggcctcgccgccattgccgcacgctcccggagaccgcctctcgtcgccggacctccacggcgcctccccatcccatccgacgccacaaacgagttccctgagtcctagagatgctcccacccctttgagtcaaaccctcatcgtctcatcgtgttgtccccttttgctcgccgccggtggccgccgtcgaaatccgccaccgacgggctcctcccggtgaatccgagctgacgaatcgctccctctcgcccctaccatcggtccggtgtgctccccttgagctgtagtcgctgcgccatgtcccggtgaagccgccgccgccagccgttcgtcctccggccggccttcttcctcctctcgccgcccacgtggccgccacataggcgccacgtcggcttgacccggtcaagccggtcagccatcccctcctccccgtgcgcgtggtccactgtgagccgagcggctgcacgtgggcccgccgctctcccgtccacccggtgcccccccgcatgagccgcatccaccgatccgctccgccgctctcgcgtgcacctcgctcacggtgagccgagccgccgacaagcgggtcccactcaggaccgcgcgaggtgagcccggtccacccggctccccttccccccctctctccccgcgcccctctcttgggccgcctccccgtagcccatgccagcccaataagctcggccgagccgcgcagatcctctcgggccacgccaagccgctcgggaaagtctgatttctctccctcgtccattttctttccaaaaagggtttaataaattattaaatcctttctcctttgattagaaaatccttagaccttagaaaatccatatcttcccaaccgctcatccgattgacgccgttctacttccagtaattccctaaaattgagatctatttaatggcactattaattgtgtaaataggatctttcttttggtcttttgtttaggtttttgattatttgcgtatagttgcggtaaccgagatattagtcaatcgtggttttctcgaagattcgtgaagctccgtgaagaccttgagcaaggcaagtcaccctttgatcaattgcccctataactggaaaatcattattattttgtttgcaacttgcattagtagaatcacacttaacttgcttggcctcggtttgcacgccaaaccgacggacctacccagtagtcgcactaattcctgtaggatgtactaccctgattccttgtcgctccacccttgtggtacttcggtatccgtgctctttgagcgtgtataccaattatcccacatacaccgttgattgtcgaaaattgggaaatgggtttgagaagccttgaaaacccgacctgaggtgtcggtgtgtttaaaaataaaatgaattgtgaaaactcgcgatgcgggagccgtgcctacgtggcgctgtcccgtattcgcatataagggccgattcctgtgggaaactcatcgagcataatcaaagtacaaccacaaggtggaatgggacaccctggctaagtaactagttggttcagggaaacctcgcatgccaatagttgggaacgccggggcggggtcggacaaaccgggttcctggtaaggcaaggacgagaagcttgcttacttaccgatcaaggtggttggagttgatttgtgaatgcctaaaatggcttatgtttatgtgaggatttgatccttctatgtggcatgaggtaaccctgggtcggcttgggaaaggctttgtcgcgcgcctctgacaccggccagtgtctggagtaagttcgtgtcttgtgggtaaagtgtacccctctgcagaggttaactaactgttcgaacagtcgtgcccacggtcatgggcggatgtgaggtagttcccgttgcgtagatttgtttaccagtgctttgtgaaaagttgttgtggtgtgggaatcgtaaccagaatcagcctatgtggcagatggatgacctgagtggtcagaaacgaatctgtgtgattcgggatatctgcgggcatcatagactaggcttcccgaggggaagcggattgctttgctgctgggcagctggactctgggagtccgagaaaatgaaaaaggctctgggagccgcctaatcaagtgaaatggctctgggagccgataagtaatgatctgacccgggaggtcggtacattaccattcgagttgttgaaaagcatctcttaaagtcgaatcaagacgcaagtctcttttcgacccaaacttaaaaaaaaaggaggtaaatcacttagtgattccaaaatgctttcaaacaaaagatttgcaaaacaaccttacctctcttccaagcttgcattaaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaatggctccgctaccctcgccaccgctgctggccgaatcgctcgcgacgctgcgcacagcctcgccgtcgccgcccatcccctgctctcctcgccgcacccggccgttggtttcagctaggttcgcaagaacggccggccgccggagccggagcacggggggaaggagagaccttaggagctgtgcctatgcggcggaagctgagtacggcagcgcggaggatgaggtcgccgacgacttctactccgttcttggcgtcgtgagtgttctggaacattctgttgaacaattcctttgcaataatttcggtttacagtttattaggttagtagggaagaactgtgcattttagactggaatcattagagatcaatttcttctctgtaaaaaaaaaaatcctacttttggtgagggaggaaagatgcttctttttttcagagtggactcagacaattgttctgaacttctgatgagtgatgagtgatactctgatagtggttttcctttgagacgacggatttgctgctaataatgacccctgatttttgcatctccagatgccagatgcaacccctgaggaaatcaagaaagcatactacagttgcatgaaagcgtgccatcccgacctcagtggggacaaccccgaagtaacaaacttctgcatgttcatcaacgaggtttacacggtaaaacccttcaatgaaaccttgggtccttgtgattgcatatggcaattgtcttggaagatgtgttttgcattgaattcttttttgttcaaaacgctaacatgaggtgttgaagagcaggtgctgagtgatccggtgcagcgtgcagtgtatgatgaaatccatgggtatacagcaaccgcgaccaaccctttcttcgatgacagtgcacccaaggatcaggtgttcgttgatgagtttacctgcataggtactgacattttttggtatgaatagagctataaaagatgctatttggttcttcataaagagatttgatatatttcaccttgttgatgtggggctgcaggaat

SEQ ID NO: 42905 - DNA, 2005 bp, Oryza sativa
  unsure (1)..(2005): unsure at all n locations
atgctctgaaacccaacccagcataatactaggactgtttatctgttcataacagattactgaatgtgttattcatgtgtgttatatttccatgtccagcccagtcaactgtattcactggacttctgctgcacagctttctctccttgagaatgaaatgcggagaatagagcgggtgaatgtaagtaatccttctttcagttatttagatgtacggtatatttttgtggtcatataaatctccagttctttggtttgattattaggagtttaggaccttatggttaacttctataacatagatgtaatcacaaaaactcctagttaaaataaacggtgcacaagaaagtttcttatatccctgttcctttctttctgttagcatttttctggaactcaagtgatattttacaggtgatattatcttgttttctcctaatagcctagtagtacactaaagggaatttcaattttgaacaggttgggctgatgagtgctgggatgggagtttcagttgatgtattccgattggtaaatttgtatgtctttattatgtaaatttggcatgtactatctaaatttctctgtttgcatatcctcaagattctttcttccatgtctatgttaaggctaatagagtatagataaagcatacttttgtttaagcatacagattatattatgcataatacttctctatgttgttaattttacttgttcttaagatattttctatttaacaggctagcgtgcgttgggaaaagagacagtcaaaagttttggtatggttccttcccccttcgtcatctttgtgtttctcatagagttagatgtttttaaggatttcgttatcatttacctatttgtatctttgcaaatgggtcattgttttgtaaactaaacattttatgtaaacctttattttgttacaggaaaaaattaggacacggatgacaaacaaaaagtattcagatataagtagttcttggactgatatctggggatccccaactcgataccaaggaaatggtaagctaaaacaaataacacagtttgttagaaataccttgcatggtaaccatgcagaccagcatgtattgtgtaaatataattgttgttaccaaaaatataattattgctcattcttgtatttctgaatccgattgagatttgctgatgatatcagaagaagaaggaacagagagagcgaagagagcagctgctgctgctaggagatggcgagaatactcgagaaaaggcgcagacaggccaccggagtacaaacttccagaggcagcgggcaataaagagtaatagcagaacaaagaaatatttctatcctgcttacgttatctgatagcatttcgtcacctgtacatatagccttattgtttgaagagagctgacatgtagattgctctctcccaattcctcatttttcatttgtaatatatagctgataacaataacctgtagaatacaaacgtcaatagttaaacattcggaatgtaaaagatgaatatgtgcacattctccttcaacaatggtatacatcctgaagatccatcttttcttgtgtgtgtttgtgcagatgaattccggggcaaatttcctttggcagtagtctggtaacccccaggcatcgatgatgaactgcaacatctgccaaaggacaacttgcccagcaatgcagctgcacatctcatggtctcaacctatttctatccgtgtgccacatttagtttcatgtgtagagcgcacagttcactgatcattgtgcagtgatatttatactcgctcctgcatggtgaaaggnnnnnnnnnnnnnnnnnnnnnnnnggcctttctctgctcctcctgcaaaggcacacggaggctgataggatatactgtaggacaatgcctgctctctagattgtgcccacttacaggaacaaagtctgaaatggagagatcattgtagtgcatatatctccaatctttttaggtcatggggctacttccc

SEQ ID NO: 42906 - DNA, 1915 bp, Oryza sativa
agaaaacaggattagcatattatcatcaattgatcagcaacaaatgttatatgccatataacatacagcagctgttcttttagtactaaactgagtattgctaaagaatacccttttacaaagtacttttgtttctatttggcatatgtttattagcattacctttcgtctagtagtgcttgaagccttccaacaaagtaaactcgacttaggctccaatctcctgcaaatagatcaataatccaaaatcatacccaagcttcttatataatgtggatgaatcctatttgatagctctattcatgtggaaaatttctaggataaaataagactttgcagctctaaaaatttttcataaactactgaatatgtgcagtgctgtatcaagtgcttgttttagtgcaatattatttttttttaatttgggtatcatctgttcccctccagagtatctgctgaaaaaagtactcctctagtacaagagagtagcatagaactacttacaaattctcttgctctagcttctctgcaatcgacatagctttttgtctagaccaacctccttgttgtgaacaagtttctgccttgttaatgacatgagcaagagataccttgccccttactatgctgttttgtcggccatgctcattattcacaacttctcgtccttgaagaactatgttttcttttctgacaccggcgctgttatttggttcactatgccagtccacttgagaaggtcctacttctataatttcaccttcagtcaatatatgtggatctgattgcacccatcgtgtctgatttgaattagcaccatggaccacgttgtctttttgaagtctcctaattaagttttcacctctggaagaagcggaactatgtctagtgaaagacctccttaatgccacattggaagtgctatcctcaggatacggtgaaatagctggaacatgacctgcccttgcatcatcctttggttcgtaccggatttcaagtgttatagcagaagcaaggacagactcaaatgcatgtagaacttgttcccttgacctctcagctttggatttattcacacgagagctgaacattagttgcacagttggtgctggaggaaaagaactaagtgttagaagcaagatatattggaaaatggaaacagtgtagctattatttcgccaacacaatattcttaaaacaaaacatattacacgttttcaaggaatctggcatgcttagttttttggggggctatgtgtgtcttaataacatcaacaaagttttaaacttgctctcatcaattctagcatgaaaatttagtcaccatgtggagatgcatattattttatttacatgagatattttatggtccttgggaggtatgcggtattgagaaatgagaggtagatatatcttatagtatagaaaacatgtactattacatggcctaggcaccaagattgacgcatattacttgaacaaagcgatttatggtgtttggagggtactagaggtatcaggcacctttacttcaataaatttcaacggttgagatgtttacaggcacacatagcaagccattctatcttattgcttgattacttatgaaacagcatatttatccatcgcattacttaaaacaataataggtcatccttggatgtattctgcaatgaaatttagacatgatataactagtaatatacagagaatgagcaagaaggaatatcttgcctgtgcctaggctgacagaaatcagtcgtgcttctttagccagcatctttctcactgaatctgatcggatatgctctagtacagcctgccaaatcatctcattgtcactttttctgtatctagataaattcactctagtagcacgcgctaataatacatggttgtctggtgtatgttcacc

SEQ ID NO: 42907 - DNA, 12870 bp, Oryza sativa
  unsure (1)..(12870): unsure at all n locations
gcgacattgagattctctgcccaagcaagctcagctgatccaaagtcatctctgcatccctcagtgacccatctgaccgggaagcaataagtttcagggcatctctatcaacatctagtccttcgctagtagaaatccactgtaaagtgttgacaatgtcacactccttcagtttgggaaagaagaacttttggcacctcgacacgattatatgtgggagatcaagattggggctgatgaggataaaaaccacacgccgaggtgcacgttcgatgaccttcgatatgacactccacgtatcaggtggcaatgtgttgcaatcatctactataaacaccctgtgctgagttggtacaggtgaaagcatcacattatcaaggatatccacaatgctgtcaaggtcaatgttaccaacaggcccaatctccactaagctcctactcttgcccagattgtgtgcgatacaagacgcacatgaatcacagggcctcgggtgctcaggagaatggcaattcaacgcctttgcgaacacccgagcgcatgatgtcttgcctgtgccgtgcggcccgtagaacacatacaccaacccaattttcctcttcaggatggcattggagagagcctgcaccaccaagctctgcccaatcatgtccttgaaagtcttgggcgaatacttctgcgtgaggctctggtgccggcctcgatgcgagccccgtgacctctgccccgaccgtgcctctgatgcgaggtcagaatcaagctcactggtctgattcgagaatatcccgagctcccccgagaagctcctggcaatgccaccgatgccattgcgcacgccgtcgacgagcagaggcaacgagtctgagtccgaactggtcgaggtcagcctcgccgtgaccgggaaatgcggatgcgaacgcgagccgtccatgtgaccgcacgagcctgcggaggtggcggcaatggacctccgcgccgccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaagaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaaaatcgtaaaaatgaattgaaagtcagcaactagaaaacacaacttctacagatttttagaaactagctatcagctacttcttgtttcttaaaattttgaactccattgaacaagtctgagaccgtctgtgacacgagattattacccttgtgctaaagttgagtggtctaccgctaacagtggcaaaatggcgctaatagagctgcttgtttatgctttcttttcgaggctatgtattgaggctaaaaaaaggaaaggtgctaaactgctgattgcacgttgtgtcgtgctacattttagtttagataggtaagttgttggtttattaaggtgagctaggatgccattcggtgggagaatctctctacgagactcgacacgctgctgattatcttttggttcagagcttttccttttgttgacttcacgttgcctacttggtctatgctttggcaccgtaccacgaacgtgcatatgaatatgtgatactggccgacagcgtcggtaattacttattactgtacctaacaagttaaccggagtaacgtaccagtaggtaatgttaatgtcaaatcatgagaaattatcgtgccaagtacacgacagagtcatcgacccgtatgagagtagtaccgcggtatagccatggtgggtccgtaatctagcagtagctgcggtactctagctgtgggcctgcatgtgttatctgtttttttttttgttcacagtgatacactagtacatccatccaaaatgtagagtaatatttctaacatattacgttgtctcgaaataaagttatttctccgcctatcttctctcaaccaatcacaactattcttcttcatctactttctcttttcaaccaatcacatattttctccaatcattctcatctacagtattttcttaatacacgtgctaaccatttaagttatcgctatcctatggtttggtgattattgcacgaaaccacgtaattatcgtgatatatatagtaattttaaaaattgaaaatatcatgatagccgcactgttttataaattgtgatggtgacagggattggggaggggtgtacagcccacgcggcagtggcgagcactgggcagcacggcccgggctacgagtagactctacggccccttataatcataggaatgaaaaaaacgaaggaatagcaaaaagattctgacaggaatacaagtgtaaaacagaggattataaaacacagcaaaaacatagaaataaccgtttgattgagccgcagaaaaaacactgaaatttgaggagagataaagactcagaggattcttaacatgaggtaaaacctcatgctaaatttcctccaaaacttacatgggaagaggcattccataggaattttatgggattacataggattcattcttttgattcaaatggctatataggaaaaattcctataggaataaaatcctttaaaattactatgaattttctttgaatcaaacgggcctacgagtgaaattgctaggcccagaaaatactccgttcgatctgatcttcctgcattcttcatcagccagatagcactgtagtttgtgcggatgaattcacgcgaattctgagggtttattttcggtgcacaacaccagcaatccagccaaaaattgaaaacagcatatcacaatacaccgggaaacgtttttgaaagagagggctcctacccccaatgggcgcggaaatcgaggcgaatcattgtgttctctcgtccaactgcagctctcggaacagaacgaaaacgaggagaccgaggagaagatgagtgcatcgtagtacactcgcaccactggaactccttcctgtgctcctggcgcagtagcttcagttcgccgcgagtcaaaatctgaaacctctgatgacaccctcaccagtactgcaaactgacatatgggcccccacagaccctcgggcccatatgtcagcgagcagtacggcagaggatctagattgctgatgaagcgtgtgcctcacccgatcttcaggtaaccagtgtgtatcgttacatggtacaaaagtatgctcaagccctctttgtttagatttataagctaacttataagtcgaatagtctaaacctaaacaaacaagtatctttttcgtttggattttttgaagccataagccactctaacactattaagccaaaagctaggttggataagttttttttggcttatgtgaggtagatgtattacttaaccactaaatttagtacattaaatccactggcttataaatcatataagccaataagctgacttaaaagtctaggccaataagtctaagcctaaacaaagagggcctcaagctgccgggcaatattatcttttttgacgctgacttatttattttctttactctgaatgtactccctccgtttcacaatataagtcattctagcatttcccacattcatattgatattaatgaatctagatatatatatttatctagattcattaacattaatatgaatgtggaaaaagttagaatgacttatattgtgaaacggaggaagtagtatattatcttcagtcttacttcaccttgcaccgtccacacagtaaccctgactgaagcacagatcatacagtacatgatacgtgtagtaccatttttactgtatcagggtccaatatggagtagtcctagactctgatgagaagttgacaaaacatgccctggtgctctggtgagaaattgctacaatactctctctttacatgtgggctgcttcacacacagcacggcagcatgtagccggaatactgcctaaccctatgaggacatagacaaagtagcaatctgtcacaaaattgatcagtgaagctataagccagctaaatactgaggtggagaagagaagagaggagagagagaggagaagtgggctgtaaacttacagctggcttggacataagaaccaagaaactctatgagagagataagtgtgccatgtattaattatgaagagctaactatttgttaggaacctaattgggctgtatatgggccaagctagccaagtcaaagcgaggcccaagcaagcagaagggggcagcatacaaaagcagcagcagcagcattgttggaaggcatcgaacagaatagaacccggcacggcggctcagcaacggcggcgacttggttcgggcttgaaccttatcgatctccttcttcctccctacttctgctagtaacttgtatcccctattcaatcccatttccaccacaaagcttgagttgtagtaatacaattgcagctcaaaaccacctcgaccttcattgcttgtactgtatattggttcattgagatttagatattgggttgctaacaatctggtatcagagccgttcggttcactgggattcttgtcatggaggagtttgggaggcagccatgcaagagggagcaggaattaggttgggaaagttttcatccaagcagcgcccaccatctgttcgatgaaatgtcaagcccattggaggtgtttgaggaacacgttcttcttgtcatgagtgaggagaacatcacatgggatgaagcactccatctgttacaagaggaactgaaggatgcccaatgtagatttgatgagaagctagatcgttttttggaggtgttcggcttgatgggagacaagagcaatcaatctgagggagacaaaaggagcaatgaatttaaggaattcagtgcctccatcaaggagctcacccccaccaccgaggctgctgcatttcaatcaccccaagcatcaccttcttcagcgcccaccaagtgttcgatgatttgctttggcctcgacaccatgtccgacctcaacatggcagcagcggttgtgtgcgccaccacttctctagcctccgtggagttagtggctagagggaacgcaacctgtgaaccctacgtcaacacccctggtcatcccaaggagacgcacaccaagtgttcgatggttggctttgaggtcaagggtggcaccgaccacaccaaggtcacatgccataccatgatgggtgtgcctgatggcgttctagtacctgaagcatcattccatgaagcgtccaagtatccaatcctgtagcccatcacagttggatacgctgtgacagattggcgtgctcacccccgccgatcggaagatttatttataagagcaggtacaataacaagctataagccaactataaatatattttaaagagataaaggaagagagagaagaacagcgagctagagatctgtagccaactgcagcacggactccaaaagcaatgcgtgtatgacaggtgggaccaggtattcatagtatagtaagtaactattgtacacatttgctattacattggctatagataatttagagttagtagtgtgctatactattaaacttgctctaaacaggccagatccgacaacggcaatctatcagcagcgattccagaggagaaatcatgaacaacgatggtccctgttatggcgtctgcttgcttcatcatttcgtttaggctaataaatcaaaattttaaatttaatttaaaagtttagatcgcacaccgtactgtttgtttgcaccattactgtagcaccgaatctggacaattgatcggaaaagccaaaattatatgcagtcgttaacttgaagttcctaatataactgctgattcgtactcgtagtactttgttcatcctgagtgtctctctctctgtcgttttggctgatatgtctgtctgcactcagccgcttgtcccactcccaagtcccaaccgcataacattgtgcttcaaccttcagatgtgttctctgcatactagaacaatgtaagatgctcattcgtgctgctggactcgttagttcccatcacaagtcacaaccccagcatgttgcagcagtgcaacatcctgtatatgggtttatatatgtaatgaggtcgtacaagtaacaagtgtacaactctagcgcaagcaagttcagagacaatgctgcacagaaaaagcctaattatagagtaactgcagaactacgaaagtaacttaaacttcatttatgttctgagaaatacagtcctgagtcagcgatcaatgaacgatttacatcatttacaggatctgtttttctattcacataacataaatcttcactcaaccatcacggttcacggatcaaatttgttggctcactcaaaacgtacttgggcagttcatacttggcacctgcagcagagttttaaaggttgttattagtcttgcgtgatatagtggagcaaaacagtataggtggtgaagaaacagcgagaattcccaacgaagatctgctcacctctctcgtcataacaaagcgtcatgtcagaatttgaaacaacaatcccagcactgttcactatggtttgtgcaagaggtaattcagcttcagcagcagccctaagtgcatcccaaatctctgtaaagatacaacgagctaccagttatttaactaaggcgatatttgtcagagcacactgttaaaattaagcaattgtgttcaaattttaagccatgctacagttgtaaaataaactccaatgccaatatgaatgatttctacaaactttcttaaattcgaacataacagggcttgttgtattgccaaaccaaataaagattattcagaagagggcatagataaagatggaccttagcaacttagctgcgaaatatgatttaacagtatacaaacattcaattgattttgtttgacatacataatagataaatgtcatagatggaactatggaagagcgttttcccaatcagccttgaaaaatcagctaaatacctttctggcctccatagtgtggagccgtgtcccagaattcttcacgcatctttgagagttgtgttggtgttattgcctgagtgtgcttccaaggttttggctttttgagcttcttactgttctctgcattaaagaagaaggttcaacattacttattcattctaactcatgtcaaagaaatctaataaaaccttgctaggatataaatgcatatcaagcaggattctagttccaggaactgttctgcaataaggccttgttacaacacgacttatttataaacctacattcatctactgtgaatagatgtatcataattttctgaacaaaaaaagcagattcatctttggctcttcactaacttggcctgtatttaaagtagcaataccaggcaatccaactttcgaaagaagtataaccagtgctaaaaaaaattgaagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctctccgccatttttccgccgcatctggagctctaaaacccaaaccctagccactgcgccgccgccgtcgccttcgccgccggcccgccgccgccgcttcagccatgaacgcctttcggttcctcggggacatgacccacctcttctcggtcctcgtcctcctgctcaagatctacgccacgaaatcctgctcaggtgagcccgagccgtacagtgggggtagggtttcggccgcttggttgggggtgggggggattctccgctcacggatctgtgtgttggcgcaggggtgtcgaggaagacgcaggagctgtacatgctggtgttcgtggcgaggtacatggacctgttcacggactacatctcgctctacaactcggtgatgaaggtggttttcatcaccagctcggcggcgatcgtgtggtgcatgcggcgccacccacaggtgcggcgcacgtacgacaaggatcaggacaccttccgccatgtggtgctcgtcgccgctgccttcgtgctcgcattgctcttcaacgagcggttcaccttccgcgaggtgatgtggtctgaccttactttgcttgttcaccgcactgttgaattgatgctgcaatgggacgcccgataaagtggttaattctgctgaacctatgtgcattaagaaatatgatatatctgcttaatatgttttcccatgctacatttcgttgctaggaaccgtaattaaaattcgtgtacaaggctgctagtgctgtgcaatgtaaccttaacaaatttatctcagtatgagccaccctagcaatctgagttcacagtttgcactgacttgaacaagactataggcacaatcatcgttttgttcagtgcagtgaagaattgtggataccctattaataaaatcctacttaagtaaggcaatgcagactgccgacagatgtttgttgatctatatgctatttgctgatgttgtattgttgttagacttcaatagtggtcaaatgccagacaatttctcagacctcattctagttgttttcaaagaacactgctacagtaggagactcatctgaaggtagcatatccatagaatgtaacaaaaggttaggtgaataacacctatacctattgaattaatttagaattttagaaacctatgtattatttgctcagtatacatcatcctgcactaatcaggatttcttccctttgggtaaatagaatctaatcccatttttctgtagtttcaattgtatggtacagattatattcttcgaagtggccactttttttttctagagcacacatacttcttcctcttgtttctactggaaccaattagtcagaatgatgcatagtaaagtagcacattagtaaaacacggtcatgttgcatttacatttgttagtatgatacacaaattaacataatttcaccgttcagatctgctgggcattttcgatttacttggaggcagtggcaattctccctcagttagttttgctgcagagaagtagaaatgtggacaacttgactggacaatatgtattcttcctagggtatgagttttaccacacaagctttttaccataacatatttatacatgattcctgtattacaagagaatgaaacatgtttgcttttcatgcttcaacggcttctgttgcagtctccaagtttatgatggaaacatgaaatatatgcatgcattaactatttagtttttgtttggtccttaggcttgagaatattgaatatgcatgtatttttttttctttatggacatatgacatgtcacatgttccttctgtccatttatattgctggtcataaattttggcacatgaaatgcatcccatctattctttttttgacgtaagaaggtagagctggctctaccttatagccatttccttaatagaaatgaggtagtacaaagttttagtgaaggaaggaaacgaagaagaaacggaggggactttacattagttttggtatttacagatttaaggttctatctgcagtagctgcatcccatctattcttagttctctttcgtcgatcttccatttttcctggttagttctaggcttgattaattaagcctacatttttttaatatacattgtgtccagattcggattagggcatgctttaaatagtgaacgatcgacatgcttctaggttcccagttggtctctttcaagtctcacaatacttgttttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42908 - DNA, 799 bp, Oryza sativa
ggcagaacatattgtttatcaggagcaagttgaagcagagcagctgtaagccacgtcatcttatcattagagaccctcaactgtttttcagcttcagagagtgttttcaaggcctggcgtagtttttccatgtcatcttttgatactgtaatccatatattaagatgttagattgtgtggaagaagaatgtttaggtaacatgaatgctactaaaaaaggagagatcagcgatccacgtactactagcccagtcaacaatgtattctttctataaaggaaaggcgtaaataaaatatgtactagtatagccagatctataaaaggataacaatacattggtgagaaaaaaatgctagagcatgacttttacaatacatgactcatggatggatcaacccaactataaatccatctgaagagagtgataaaaagggagtgatattgcttacaggttggacatttgaagaattttcttcgaaccctttcctgcgtgaatgcataggtgccagcaaggatgtcagtaattattgtggcaagctgagacatcagggccaaaggctcaacacctgtttcagtaatatctcttaaagttttcacggtgttcacagtgtcagcagacagtgccaaatcaagcaaatcaaccaatttatcatcagaaaccaagccgacctgtccaaagcaaacaatgtccagttgttattgtcaggtaaatttttaaatgaagtatttttatccaataatataatagcaggttattttattgctactgttagaatttatacaatgtttagtaaacaa

SEQ ID NO: 42909 - DNA, 11592 bp, Oryza sativa
agatactctatactactacaaggtcgctctgattagcgcgctagctagctagcattcatacacctcttggagcacatatggtactgtacctagaatatcatcatcacttaatttcacatgtcacacttgacaaggtctcaaagtatgaagagtttatataactcggatcaagcaaaagggtgaggtgagggagcacaatggaagagccatagtacataatcatgtcaaaatttatgaaattatcacctccctactgacggtgcatatgtaccaacctatttaactcaaaattttaagctggtgagagaagatgggggagaagatggacaaagagctcccagcagtagcagatccagaagatcgattcgttcatgtgtcataacgtgtttatcggtgtcatagtatgctaattatgcttcgattatgaagttataatatggataaacagtttcgctataggttttaccgaaagtcgttggtgtcgcttgacaccagcccttctactgcaaactgcatacggactagaggaccgactctcttgactctccactcttgtataaacataagaggacgtgaattgattgcataatttgtcctgtaaatttggatgggttcgcgcagaaaattggaaacgcgggccaaatttctctgtagcttgtacctgctctgtactgtataccaaagctatcaaaatcgtgcaataacttttccacagtcggtgttaactatgcattcgtaggactacctccgtcccaaaataagtgcagtaataagtttccgtgtctaattttggtcgtccgtcttattttaaatttttttatgattagtatttttattgttattagattataaaacatgtatagtactttatccgtaactaattttttttagtttttctaaaaaaaattaaataagacgaatgattaaagttggacacgaaaactcatggctgcactatcttgtgacggagggagtattggcttactgtgatttaaaactgtgagtactactgctagttccagctatcttttctgatacgccttctaagctcaactgctgctctaatctgcctatgaagtctgaaagtctgaaaccgaagaagtgatggactgatggtcttccctgcatgcatatagcagaaaatgtcgaaactcattctgttcacttttctaaacgaaaaggaccgtgtaatgactaatgagtcatcccttgagatatattcatatatatacaggcagctgaggaaaaaaataattagataggtgttagcttgattgtaggtaatgctggttccagaaaaatcaaagcgtgttgctgtagtctcgacgtgattgataataacagaacaaaagtgaaagtgcatgttttttttcctttccatgctttgcgacgtaagcatcgtgcgtccggtgcgtcggtttatggaggtgttcagcgcatcagcaaaaactgaatccaagcaatgacgcacagagacaaatactccctccgtttcaaaatatttgacaccgttgactttttaatacatgtttgatcattcgtcttattcaaaaaatttaagtaattatttattcttttcatatcatttgatttattattaaatatactttcatgcacacatatagttttatatatttcacaaaattttttgaataagacaaacggtcaaacatgtgttaaaaagttaacggagggagtattttccaaacggacaagaagaaagaaaacgatgagatatgggagtaagtatgaacagcttgtattactggtctgtcttaagacaattaatctagtagattctatttaccgtttcaacaacttcactaatctaatatgctaaaaaatataaaaaggtgaaaaaaaacccaaattggtcctcttcgggggacaacccgtaaaagaaaaatacagatcggggtgagttctaaacaaaagagaaattaaaaaaaaaagaggaaggaagcttttttttttttaacttgagtcttgacacgaccttggaatgcacgaccggtcgagcaatgggcacacgtcgcgctgccttgccggagtccggtcaggggaggaggacgtggagcgaggcgttcttggtggccgcgcagacggggcacgcgtcggcggcggcctcgcagccgcggcacaggcagaggtgccggcacggcagcagcagcacgcacgcgtccgcctcgccgcaggccctgcacgccctcctcccgttcccgccgccggacacctcggctgcgcctccgtcgggcgcctgcacgaagcagcacgactgcgcgtcctcggcatcgccctcgccctcggcggcggcggcggcggcggcgcagggcgactggaggagctggtcgagcgtggcgcggaggcccgcggcggcggcctcgtggctcttggcgatgcccagccacgcctgcccctccgcgcccatctggcggagcctctcgtcgagctccgcgttccgccccagggcgcgctccagctcggcctccgcggcgtgcagccgccgcgcggcggcgcgatccaccgccgacaccaccgcccgcaggtgccggcgccgcgcctcctccagcccggcgcgcagcctctcattctgtaggtaggtgcagatcgagtcaaacgcccattcgagagaggagagcagacaaaacgacacggagctccagcgcccatggcgataaataaatgcgcgatcggtggcgcgcacctcgaagcggacgagcgcgtcgacctcgacgctctggcggtagagatgcgacaacaggaggccaccaccgcagacagggcggccgctggtggacgccgcgccggagccgacgaccctgctgctactcttgtgcacgtccccgaacgcctgcggcgtcacctgcggcggtggcggcggcaacagcgcgcggtgcccgccgccctccatgacgctgctgctcatcaacagacccgccgccgcctctccctcgccgccaacccgcgcgcgcttccgcggcacgaagccgccgccgaagtcgtcaaagcggcgctggctacaagtaagctcgcttcgcaggtcactgaacaccgccgtgttgttgttgttgccgccgccgcccaccgccgcagcagcaacaacaagctgctgctgtagcagcgccgctgagacggcctcgtccaggaacaacgccgatgcgccgctgctcggcgccgcgttctccagagccggcctgcgaagaaaattgttagccactcgcgcgaggataaataggtggtcggcagcggaagaggaaggaggaggagcgcgaggcgcatgagtgcctagagcgcgcgcgcgggaagggaggcggggccgcgcatgcatgcacgcgcgcggcgcggcgcggggtgacacggacctgatggcgtacgccgcggaggaggaggagcgggaggcgtgggcgacgtactgcgcctgcacggccatcatcaacacaaacaccgcaaaaccaccaaacaccgcgcgatggagaagaggcagcagagcgcgggggttatatatgggaaggggcggtggtaaagacacgttggtgcggggtgggggaagggtggcaataaaagggggacaaagcctgttcgtcttgacgaggtgggactaaactagaacgagaaagatgagaggaggcgggtgtggccttgactgggcgagcaagcaacggatgcgtggggtggcggattgatgggtgccggtgcccggtgatggatgatgcccaccctagcttccttttctctcctcttccctttctttctcctccttttccccgcccgctttaataattttatcgtttagagcacccgcaatggtaaagtaaagtgctctctataaaacatgtataactcagcaatagactagattaatagtaaaccacctcaatagtatgtctacatgtgtatctatagctctctaatgcattgcctcgtttttctctatagactatctccagattagtagatagctttgctctctcttcatttaatatcttccaagtaggaaaatatactgatatggatctcttatagagagcctatagataaccattgcgggtgcccttaccatattcgtcggagcatgcacaacatttcgagcatttcgcccctgctttgcttttcgatgccgcaccgatggcgaggcgacgtgggattcggttcgggggcaacgcaaagactgcagcactgggccagctctatcgcccaagataacgtgaaatttgacaatatggagtatctactaatacacgcgtctttgctgatttatcatctaatcatggcttctaatatatagcactggagccataatttttttatttcataccattttctctttttattccttctcgtgttcacggactattttgcccataggctcacataacatgagaacaaaggtgaagccgtagagggagggagggataagataatacaataatctcccttcagtaaagcctcaatgataacaggggcatcatagcggcaggggcggcggcaaggtgtgtccctgatgttgaagcatagtggtgtcggcgccagagataaggggatcatgacatcggtggcgacaggccaaggaggcgggctagcggtggtggagcagcgttgggatgctgccacatgcactatgatggagggcctggtttgcggcagcgctcgttggaagccgtgactcccatttcttccaatcccctcgctctttcttttccttgtcgtgtgggcctaggggcaaaagagtacatataagtgaggaggagaaataaaaaagaaaagcaaggagaaagtggcatgttaaaaaatcatagtcgcattattgtattttagaagtcatacgaattggataatatatacgcaaatgtgcgcatattagatgttatattgtcaaatttatcgtgaggtaaaggctcgtgttttactcaactgttcagagtctttttccccgtttctttctgttttcgcttgtaagcaaatgaagagtggcttaagcaagttgtgtttggtgacgctggcgtttccgttttgtgggtgaactgttgatgataattcaatactgggtgcagaagatgtatcaataatcccacgaattaaagctaattaaccccctcaccttttccttctttcatgtgcaagcgttttctgatagtacgagagtactactacagcgttattagtggcagtgcttcccttttctaaaaaaagtcatgcgccttggtgacaattcacgcgagatatacgattttcgatcatacgagcagtgaagcgccgtacgcacgtacacgatccgatcgatcccttagcagctttgatcgatcctccacgtgtacggccaccgccacacagctgcccaccacgccgtacgtttcgtcgtcttcttcaggattattaatccgtataggatcgagtacttgcaaagaaaaaaaaaccgaaacaattaaaccacccgtactaattgggagtaagtataattgataatcccatggacgcattcataagtcctgcccggaaaaaccgagcgatttttgaaacggctcgtgaccgcggggcatcaacgcgcgacacgccacgagtattcgctggtcccatgatataacgccaagtatagcactagtacctgacgtgatgtggtagctgggatttgttattggagtaaatttcacactgaaatgattttttttaactaaagttttataacggaacatgcccgacccattgtttgtgcttaacaccaaggacgaagctataatatatttgtggaatgaaatccatgactatattgtataggctatgaagatgacacttgaaatcaagtaacattaataatgcattacgatactgatgagccaattttctagctccgtccaggcttaacaccatgtattcataatttgcactttggactggcccaatagtttggctcggcacgtaggcttcagcccatgcacacgatcaggcagttgttgccccttttctcttttctcctcgcacaggcacccatgagggccatggcccggccgccgctacaggtgaagagcgcaacacatctagtggcaccgatggcgtgggaggagggaaacctgtggctagcccgcgcagggccaggtggtgagtcaccgttgccaagcttgcacagaaggcagcagctccgacattcacaatgaaagcatgtcatcgttgcaaagcttgtcaaaacaaagcagctccgacttcaccacatacttgtgtccttgttaccgagctcatcacaaacgaccaagcagctccaacttctcatggcggacatcaaccaaagccaccgtaccacctcttcctgcctattgctggcaccagcatgtacacttagaaagagactgcaacatgttatcattgccgagcttcgtctcaccccaacaacaaagcagcttcgactccacctagcaaaaatcaaacaaggatattggccacctgccacaaagcaagaagcggatccaacaaggagaaggtctcgctgaacattttcgccttgttgagtgttggtgtggaagtaggaagccccggagctaacgtcaaaatcataactagacatgtgcatgaaaaggttctccaaagcggcacccccaatagggacgagatgtgaatcgccgctgccgcttgcccattaaccggggcaagactttcacctggagcacaatgatggaagaagagggaacacgtcttaacaatgcctccgagaatggaaacggcgccgaaggcgttgccagagccagaaggcatggcaaggctttcgcgtatggttccctgtgctcctacacacctaaccaatccgcagacacgactatcgcaagaatgccgcattggcctcgactcaccgacctccggcgaccaagcaccccggagctccccatgggcacgacctcaccgacggccgcaaccaacgaacaacctccaccacatataacagcacaaagcgtccccgcgggcaccgcgtcaacgccgcacggccgcccaagcttctcgaccaacgctgccaccaccaagctcgccggcgtagcacggccgccctggctcttcgctcgacgccgtccaagcacgccggcggcgcccagtcggccggtgtcgtcagccgctgccacctgcgtcccgcctgccagccgcgccgtcgcccgcgtctcccacgccatatgccgttgtctttcctgccaaacaccatcgtcctcgcgccacccaccgccgttgcccacgccgtcatcagcttaccagccagatccgatgacgacgggccggatccagcaacggaagggccggatccggtgacggtggcggtgccggatccgcagccacgcgccgcgccgccgcgaggcctcccccgcacgccgtgccacttcctcgcatcggagacagctcgccaccggggtttttgtccccgctgccgtcatcctagttcctacgtggttttcggtggcggcgaggcggtgagaggaggggagggtggcggcggccaggggctagggtttgcccctggtcacccgtgtgtggacgaccgaaggcgcgtggagctgattccccctcataggggttgtttggttgatggctaagttcgccacatctcactttgccacaagtatgctatgctacaccaaatgatactaacaatttgttgaccataagcgtggctaaattttataaaaatttaagtctacgatgcgtaggcccaaagattagtaaaatgaggcatgacacagatgtgacaaccaaccaaaaactatactaccaaattgtgtcatgcctaatatttggcatggtaatatttgggagctacctaaatagccccataatttttggagcgggtgcaacaatgctactaggagatttgaaaaactaagttgtggtaagtattatgtgttgccacagtacgtcatgaagttcatgtaaagtgtatatctattataatgtgagcaaaataaatctattagcttaaagaaacacttgtgtcacagtcactacgtatcaagttaagtgtatatattaactctactggtgagctaggatttgttagtggcgtggttggcgcctgcccgctgggtcttctaggcagagctttggatgtgagaccgagtggcaatgcaaggcaaatgattaagatggaaccgagaaagaagcaagtgctattatacaaagaccagcagcgactttttttttctttcgaaacacatccctttaattacatacatgcatacactacctctataattagctctgacaaactgtaccgacatatcttgaaatttagggttgttgaaatgctgggccaaaaaaaaaacaaagagctgcactgcctgttacttgaaaggagcaagtatcagaaatacaaacagtagcctttaggagctgaagtaccagaaatttaggagctggaactaacaaaatgtctgtcttgcactgagatttatgccaccaaaaaccttacagatcaactaaaagagggggggggggggggggggcgcagaagtagtctcatttcttaagtgcattcatcctgtcccgcaggtaatacaactttgctctcctgactttcttcctgtccaagactttgatttctttgatgtttggagagtaactgagcacaaaagaaaggttgcatcaagaaagactgaaagtcaaaacaaaatgaatcatgtgtaaagatatctttcatatttgactccagcaacttatgataattttgtatgaaaaatttagatgaactacagaacaaggggaagagagaacaagaaatagtaagtaaatatatatgaaaacatcctattgcattacttccattctagaaatatacccacaacaccacagtggtgaaggaacatgtgtttctagtggtgaaaattgcagtttcgtccgagctgaacgtgcatatttatggaactacattctacaagctccatgtgcaatagagctcaaacacacacaggagtttattgcacatctgttctatcaagtactatcgatatcaaatctcggcattcactttcttaggaatttgttaacaaggtatttatcaatatatgattatgaaagttatacttggatttacagaatgcaaacaacgaaggtagtgctagcatgccactgttatcatcagcctattagggatatcaagaaggctaaggatacccaagaaacaaaaacaccaaacttgaatgagcatttctaaatttgcaagcagataactacacttctaatgcaaaataacacgcctatagttctatgttcacttgtagccatatggaaccgaaagtatgtttacgcacaatcaaagaaaacaatcctgtctaccaagcaaaaaaatagtgagaatagcctgctcaaaccttaaagtattaagtactgtatgatgcacagttctcacatttgaatgaacaattagtcactcatgagaccaagaggtgattcgatatctctatatgcatttcttttaagaaaaaaaaagatgaggcggcaaaagggaagcaaatatttggtgtcacttaacagtggaaagacagactcgactccaacaccagctactaatctacgcagtctgaaagttgtattgatcccagcattgcgtcttgctatgacaatgcctttcaacgtagactcgcgccgcttcttctcaggaacttgctgttttttacacacataatcagaacggcagaaatgaccgagcagacaaaataccagtaaactgaggatgcagatgctttaccagtctcatttggagaatacatccaggctgcacatcaggaatctctctttccccaagtaccttgtcagctgcctccatgttcaagatctgaaacacaaaataacaaatatgtcctgcttcttttaagtgctcattttgacacaactgtaagtttcttggatatgtcatttgcacaatactaggcttacattcgtaagagcaaggctaataatacagccaattatttactatataaatttttatagtctatttttttactcactcatatagtgattagctcttcactataagtctactgtctgtctcacagattttattgatttttgtgcctaagccggttgtaaacttacagcctgtttctcatctctttcctctcctctctcatccacctcagcatttagccatcttagagcaagtttaatagtatagcccactactagctccaattcatatatagtcaatctaatagccaattcatacaatagttgcttactatactattaatatatggtcccatctgtcatacacaccgcgtcttagagttcgtgctaaagctggctacagatctgtagcccgctgctcttctatctcatcttttatctcattaaaatatgtttatagctggctaatagtctgctattgtacctgctcttacagttacagctctctattatacttgctctagcgtgcatagccgtcttgtcaggcctcttgagagcaagtttaatagtatagccaactgttggctccaattcatctgtagtcaacttaatggccaattcatacaatagttacctataaacatatactacataattaatatctggtcccacctatcatataacatgcatcttagagtctgtgctgcagctggctataaatctgtagctcgctgcacttctctctcctcttttattttcttaaaatatgtttatagttggcttatagcctactattatacctgctctgaacttaatgcacggaggatggtctgcagaaacctcagcactccccactgtcgatagacccctcattgacatggtattcacgcagaacccaccgggatgaacgctgtcaccggaaatgattggattctgtacgcatcaagaaaccgaagcgacaggcatgaccaaaaattagcaggatcacagacagcggaaaggaaacaaacacaactgatatcccggatgcaaaccacgcaccccgaatggacgaatccagctgcagcagggcctcaggtgttcgatggacagcgcaggttagagcaacaagctcactttctactattaacctatcttgaaaccaacgtatataatatattatctataagattgattatactttttttctcctacctctatctctcacttatacatttaatacatttgtcttgaaacttgtgataagttagctcttatataagagcaagttcaatagtataacctactactaactccaattcagttatagccaatctaatagctaattcatacaatagttgcttactatactattaatatatggtcctatttgttatacacacactgtgttttggagtctatgctgcagctggctacagatctgtagcccgctgctcttctctctcatcttcaatctcattaaaatatgtttatagctggttaatagtgtgctattgtacctgctctaagagccaacacccttaatttttcactacctcttttcttcacctaaatttatagtaagcttatatagctcactattatacttactcttagcgcccgactgcgcgatttcagaggctgcagagctcaacagtttcgcggcggagccatggcttccggcaagatggacacgccgcagcagagattgcatcttccgaaaagcaaggactactgccaagg

SEQ ID NO: 42910 - DNA, 4656 bp, Oryza sativa
  unsure (1)..(4656): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgtactccactttgaactatttatcattatagatgtacggatttgatcaccatttatatatttaatcaatattgtttagtttgaatcagtaatttttatctttgtgtcactttacaccacccttacttttttatccatctacatccaatttatcatatgtcaaacaaatagtctacatacaatttatcatatgtcaatttatccatctaccacccttagctcttttaactatttcgccctcaccgcgtgaacttgcgcggtaacgcgcgatttcgcacttccattatgtaaaaatagtatatttctataattttcttctaaacgtgtatatttatgtaaaaacagtaaaaaaaaagagtatattttttattttttttcctttattggatgggttcagaaaatctgatcttggttaggctcaggccctgttccaaataactaattgagcttaactacttctcattttctgttgatgcgctttttaaacagttaaactttatatttcatgaaaaaagttatatataaaatgttctttaaaaataaataaattaatttttaaaattttaataattaatactcacttagtcatatgctaatcgtatttctcattttatgggtagctaattagtaaaaacttatagacttaaaataacgcggtctttagttttatcggagaaataggaactagggtcccatcactagctactcgaggcacgttcacctccagccacggtccctcacgggctatgctcggggcacttctttcattaatcgcgcccccgtgggttgggctttcacacatccgctctcgggtgcggtccttcatgggctgtgcttggggcacttctctcctctggcgtggccctctatgggctatactcggggcaaccaactctcgcaagcttagagacatctaagacaaaatcaaaaatcacacagcctaccaatgacgtggcaggaatggcggcgcttgtagcgcacgtctccctagagaaaaaagacatgcaacgtggcaccctctcagtatgcattccatgtgccctcctttgccctcgaaggctggcagctaggccagtggacaactcagatgaagaaacctttgacttcttcgctccactcgtcaattgataggtgaaacagtcacctctatcccaatctcacatgtatgtattggcattttggactcccttggtatataaaaggaggatacataccaccaaaaaggggggttcaactagttcgaatagcttagctctcgttgaagcaagttagcttccacccttagactccactcattgtaactcattcccgatcatccatagtccatatacaagaatagggtgttacacatctgtgcccgatcctgtataatcccttatgtttatcactctcgtgatttggatcagggcttgactcgctacttggcccatggctgaatctccaagggcaagtactcacttcttgactagatgagttccgcactccgataagtttgaaacagattattgagctcattgttgctgcagattatctacttgattatatggtatattaaatattttaataaatagacttaacaaatataagaaagtcttttgaaaaagattaatttttccaaacatagaataaatcaacggtctagtaaataatccgaaaagaaccaagtgttccccttttttttaaaaaaaaagaaactaagccttgaaatgttggatagtgaaagcgaagggtaaggaaatgagaagacggagttggttgcatgttcaaactgaaatatcttggtatggacaaaattgaaatatccatttgaaaggtccccaaatgaaatatcagcactgacttcatgatgaaaatgatcggcaccgacgccgacgttactctgttcaatttggatcgacttgaacctgactggacgctagctggaccaaattgatggcgacacactgattttgtccactttgccgtttgatgccacagcccaattaagcgttcggaacgatggcacgtacagtagtactagtagtaaaaaagggaacggttcagatgagcgtctcagataaacttgcgggttttattcatataaaagcagtataactttgttaggtacgcaatcctcttcagagttaaatacctccatgttgatgctgactgtgtggaattctagagtgacgagtttttttttttcttttgggtccatgggaatgtgagatgcatgcaacagcaatgaggtggcactcacgttctctaagctgggatcttctgaaaccgggtggtcagcatgaagctaattagcgagagtaatcacatgaagctaagtcacacatccctcccccccccccttagtacgttgagactacttcatagaatgtttatcatttgtaaataaaattaatttttttagataatgagaatatgaattacctttctgcttgtttgtgaccatgcttgcttgatattccatccttgataacctgggatattaatttaactagcttgtatcacttgtattgacctagctagaattgtgatatgtttagccatgcttaattacctctggcttgtgcagatactccactggtggagaaatgctttttagtcacggttcgcaactccttgtaatcccggttttcaaaccgggactaccaatccgggactaaagatcgcccggttcaaatacccgggactaaaaatatctttattcccggttattaacactaaccgggactaaagagatggttgcggcagtgagatgatcccctttttcttttttttttcttttttattttctctcaaatcaagtggtatacatatcccaaatcaaacccccaatccacaaatcgaagtaacatatcaaatctacatgacaaatcaaagttacttatacacacaaataaatacatcacaatatcctaagaaattactcaaatacatcacagatccaaacaatgaatcacaaatttgtaacttctcagttaaatacactcagtgaatcatcacaaattaaaaaaaaaatgccgctgccgccgtcgatcgccacgaacgacgggcgcggccccgccgcccgccgcccgccgccgccgcggccccgccgcccaccacgcccgccgccgcgcgcggccctgccgccctccgtcgggcgccgtagcgcagggccccgccgccggccggcccgccggatgggaaggggaggccggccgggaaggggaggaggaaggggagagaagggggaggagaggaggaaggggaggagttggagaagagagttagagaggatagatctgaggagagggggtgagattcaatctgttaaattgtaactgtggaggagaggataagggatagggattatatactacgtgtttaattttagtcccggttggtagtaccaaccgtgattaaagtggtgatctttagtcccggttattgacaccaaccgggacaagatcctcgaccccctgacatacctctgacaggggatgaatcgggactaaagatcaaaatttttataaccgggactaaaaataatttttactcccggttctttttgatccgggactattgtggattttactggaccgaccaaagatggtttctccactagtgtctcggatgtcacttgtgtggaactgtgaacgaccagatactctacttacgcattctgttgatcaaagaatttttcctgccggtaaaagccgcaatactcttcctgcttgtgaccctcgatcggaagcagactccggagcgacgtaacaactgaaaataagagcaaatttcgcagccataagatcaccaatacatgcactcactgagttgtactgttatttggcaatcagtaatttgtcctagttcagcattgccgcttctgcactgtcagcaaaaatgcgaacggatgtcaggaccgataatcagtaacagtcagcaattggcaaaaaatgaagggacaaaaagatctccagtggacagaaatgaaaggaggcccatggtcatggatgatgaacttttgtaggggtaggaaaaagtccaatttcacaccctcaaatatagatcggatcgaagcaaaatcgggtagtaaccactactcaaagtattaaaaccgtgaaaaatgactctcaacaatattaatggtggtttcgctgacatgacacgttcacttggtccaaatgtactgacgtggcatctatatgattatataaaaaataactaaatacctacatgacctatatgtcagcaagtacatctcattgtctcggccatatcgtcgtcgtcctctccgacaggagttcagcaccgcttctgctagacactaggcggtggcaccagtgctgaaccggagctcagggaggccgggagtaggatgtaccctgactcctttgcgcgtgcatgagagtagtcatcgggggat

SEQ ID NO: 42911 - DNA, 12922 bp, Oryza sativa
atagtctatagagcaaaaacgagacaatgcatgagagagttatagatactcatgtagccatactattgtggtggtttactattaatctagtctattgctaagatgtatatgttttatagatagcaccttactttaccattgcgggtgctcttaaggtaggagacgacgagcacattcgtgagagcggagaaccccagcctcgccatgggttttgtcgattcgctagccgctcaaactcctccccctagacactgtcgtctccctggtgccgccatgggctcgcatcgccccgacatgaggaaatgatactagagtgtggagaaagcaagagaaaggaaagagagagggagaaaagaagagaggacactaacacatggacccatatgttgactcggtcgattggaccaggtcatgcaatgtaacgttggtgagaaccaccatcaatattgtcgatagagtcatttcgcaccggttttaatagttggagagtcggtacatatggttttgcggttgagagatataaattacatctgatctatataattttgagggagtcaactcagactttttccataagtgtactgaagctgaaaagatgcaagcttttgttgtgcatgaactcgtcgagtcgtcgtcatagtctcgtagatgagcctggattgctggacacagaaggccagcccaatcccagcagcctaaccagtcccgttagtttgttggattattgggcctttggctatcattaaaggaaatgttggattgcgtcaagcccaacagacatgaattgaacaagacgacaacctcttgatcgccaccggataattgaccctaaaacaaaaaaagaaagggacaattgcatctatcccctcactttcaaatctaattattattttatccttattttttagggtttgcagttttacctgggtgtgctaacgggcgatcgatccccacgccccctgtacacacctctccttccttcctcctcttcttctcttcctactacactataaatttaaaaaattaaaaaaataaagttaaaataaatttatgtatatatatatatatgtgtgtgtgtgtgtgtgtgacactcatatgggggcaccatggtgcccgggcaccatggtgcccgggcaccatagtatctaatgcacaaaatcactcaaatttttaaaaatttttaaattatgagtatataccatttcacaatccatgattacatacataactaattatatgtatggatgctatatacctagaatcaaaatctaataaaaacaagttcaaattcagtacaaacatgctttgaactagttagtaaagtagttaatgttaatacctaagtaattgaaaaagtttcatactcatttgaattgggtatatactcaatttcaacaatggtgcccgggtaccatggagcaccaaacaaatttaatatatatatatatatatatatatatatatatatatatgtatatatttgaattcaaattcaaatttgaatcgggtatgtaaacttttggcttataaactttgggtctataaactttaggtatataaactttagatgtatagacatactatatatagaaaatatttgaattcaaattaaaatttgaatcagatataattcaaattcaaatttgaatcaggtatgtaaacttttgacttataaactttagttctataaactttaggtgtataaactttagatgcataaaaatactatatatagaaaatatttgaattcaaattcaaatttgaatcagatataattcaaattcaaatttgaaacgggtatgtaaacttttgacttgtaaactttgggtctataaattttagatgtatagaaatactatatatatatatatataattgaattgaaattcaaatttgaatcagatatataaacttttgacttataaactttgggtctctaacttttagatgtgtaaacttgaggtgtataaactttaggtgtataaattactaaaataagaaagtaatacggtgccaaaaaaaaaaagaaaccaagtggagagagggagagacccgatccgatcgcccctggcgatcaatctcccaataggagcctgctttttaatctgaaccaaccgtctgcccctacttctaacagccggtttaacggtgttagttgtagagaaaaatggtatttatacccttagtggttattgtatttttgcccctatttttttttccagattgtgtgattctgtacctattgactattgtgtgaccgtgactgtgagaggaggaagctaagccagattcgggcgcttcttctatgtgtgcctgtgtggtgagagaggccgaggctcccgatgcaacggcatggctgagaggcggtggatcggaggtcttgctggcagccgccgggatggaggagttgctcttcgtcgccgtccgcatgtcttcacgctgcctcaccagatctggcggcaacacgaaccggcgccaccggatcctctctatgctccaaccatgccatatctgcatggcggcaatacgagggagaggacggagacggcggcgccagaggtcttgccgggggcggtagggatggaggatgcgccgccgctggatccccttctcttttctctcgacatgcgctttggctctttgccaccgcgtgaaagccctgcagccgccgcccccaccgcgtggaagccccgccggagcgccgcgcacgcccgcccgtccttgctgccgctggcgcgcgcgcctacatgtcctcaacggcgctgccgcgccgcgtgcccgccctcgccgccgctgccctgccacgcgccgccgataggttaggatttcaggttgggaggagagggattcaatccctatccattcacttagggtacaagggtaaattaatattttataaaacctttttttaatttttttatttctttaacacaaaacgtgggacccactaaacggctgttagaagtgggggtaaacgacttgttcagatttaaaaagtgtgaataaaactgtaaaccctaaaatttacgggtaaaacagtagttaggtttaaaagtaagggcatagatgtaattgttcaaaaagaaaaatgaaaacgaaaatgaatcaacttgtgatgggccagacacaggtgctacttctacccatgaggccatgacgaaatgacgattgacatgatgaacaacctttggttactccaaggggctactactagatcttccaggaattctaggtagcaatggggtgtgtcccccagccccactacttgagaattgatatttgcaatctggttgttattaaaatcgggattaaaaatcaaactaattggactgtaaatcaacagaattgatcgatgccacgcataattgaagaccacgatgcacggctcgatcctagccattaatgaatatagaaaatgctagaatgacttatattgtaaaacggaggaagtatattatatatatcttccatatcctatagtttcttatttccttcatttcacaatgtaagttattatagcattttttatatttatatttgatgttaatgaatctattctggaacggatggagtactattttgttatactggtacttagcatgctattgggttcaaatatcattccgctagggatctaatcagctactagaacgcatatatatccttttcctaaccattcatatccatcactgcacgccggttatataagctatcagttgctagattactccagatgatgtgcacattatctttttcataactaccactagcaagatatttatattgctagctagaataatctgccaccgataatgataagaacgtacgtgcagtacatccagctagctgaagtggaccaaggccttgaagtggactgaggccgagttttgtttcgaacttttaacttttttatcacatcaaaatttttctacacacataaacttctaacttttttcttcaaactttcaattttaacgtgaaactaaacacaccctaagttttcataaccaaatggaataagtgcgtacacatcacgaattctaggtgcagatggcacgtcgctgtagtacgtatagtatgtcgacatggccggcccgacacgtcggccccgctacgtacgtgggtccccccgagctcccccgcgcggcgccgtatctgaccgctgggcctatatggccagtgtttaggttaggcaatggcaatgttttttctttgcgacaatgttaataggggctgtttagttccaaaaacttttcccaaaaatatcacatcgaatctttgaacatagataaaaaaaaaattaattgtacagtttacagtaaatcgcgagacgaatctcttgagcctaattcgttgtcggtatgtgggtggtgttatattttttccttttttcctggttacgaccctccagggttataatcttagtaattttttcctgctttatcaatagaacttcgtgcgagtcgttaaaaaaattagtctataattagccataagtgctatagtaacccatatgtgctaataacggcttaattaggctcaaaagatttgtctcacggtttccaggcgagttatgaaattagttttttttattcgtatccgaaaacccattccgacatccggtcaaatgttcgatgtgacacccaaaaatttccagtttactaactaaacaggcctaaacagtcttaataatctgcagttaccatttacacgagactctgtcccactgagctagatgtaattttgtgggcttataaacaagttacacgaatattataatgtaattataattaaaattaaaattgatggatttttttataaaatacgatcaaatgatacatagccagtccgactaatctaactagagttcgtatcaagggaagatctaaccctgacagtggcatccactgattgggcaatttggtttgtggagccctaccaaaaagttctaaaaatctttgggtggcactccaaatttgattgggcaaattgctactccgtactacactactacctaagagatggtgttggtaaatattggcaccaatccaaatatctagaaatactattgaaaattggtaagggattagtaagacacaatttggcaccaagttatctttgcaaagatagcctaagaactctcccgagtatgcacgttagtgcgtacgtagtaatgtagcaattttatcggaggattcatgaaggcgtcgacgtttcgacggcgatggctgccgaaaacaacagacagaaatgggtaacatgggtcacttgttcatgtgcaatggccattacgtatttacgtgtgctcggacgtttacctttaatttgcaccatcaaagatgtgtggatcgatcaagacgtacacagactcgtggacgttttctgtgtaacatctgtgcgcatggatggagttttaccgaacagtggcatctggtttaggatagagtgcccaactagctagagaggatggtattcatggatttgctccgtatgcataaaaaatttggtagctctggtttccatgaaaaaaattgtcatgtgtttgattatctgttctatgaaaaaggtaaattacctaacaattaccggacccctgcagctgaagaacggattaatcagggtaacgctcgatcgtgatctagatctaaggaataaaacatggatgggtccaaatccaaacagcacagggtggacctaccagcgcaagatagtcgcgaagtccgtgagtgagatcatctgcaccttagctagccgccattgatgtttatccacaattgattttggtttctagctcccaatcatgtccgtctccttatcacgccaatccaaatggtgagtggtcatggaccactcactcttacctgatcagtattcctcatggtaatttacaaatgaatcacactgttcctcaccccaataaccactagtagctcggagagtctcggacgcaatggctacgactcgatagatagatgatgatgcatcatgtattttgtccgttcacctgactgagtagtatctgacacggacgagggagaggtttcacacattgttaaataataaagcaattaggtttaaaagatttatctcacaatttacatgtaatatatgtaattagtttttttatatttaatactctgtgcatatgtctaaatattcaatgtgattagcatgagaacgatgaggtttcagtccagtacaccaccacaagtttacagcgcggcgcgaggtggttataacggagaggcccgagaagtcgcgggttctggaagctgtcagcttccgtcgaccgaacgaccaagcagccgccgcggctggcggctgccactcgctttgtgacgtgcaagagatttcggcgtgcgtggcggcgatccaccggaccagtccaaacgccaagctagcatacgggcggatatctttgcttgcacttggacgagtacaagtatttggatccttgctagcatacgaccggctcccggtgcgccacacacgtctcaaatacggtaatgcaagagtactctatctccgttttaaaaaaaaaaactctatctcgatatgtttggttgatttccacactaataactactctactagttatacttttcatttaaatggatccacttatcattgattcagttttgtagctaagccaaattcaagcgtggctaacgttttacgagccacaacttaactactactaagtgatggtgtggcaaatttagccatcatttaaacctagtttgctgtgatagaagggaaacaccggtgatgtgccgggaggcacgtgtgctccctcgttgatgggggcaatcggacacgtaatataccactgccggtgtgcactgtggagccgcatcaaccaacgacgggacacaccccagcctagctggaagcaacggattcggtcatattttttcgcaaaccgccactaccccacggttggtaagcccatcaccaccccccgccgcacacagaattagcctcccgtcccgccccccgtcccccggtggtggcccgcgccgtgggcacacccagcgcgcgcgggacgccacacccgcacggtgaatattcaaatatggagcaccgcacaataacgttatccagcctagtacagtcccgcgtgtagctctccccgccctctcgccgcgcgcaggcgcagctaggccgctctctcagcgtgtgcgcgtcgcacgcagcagtggccggttgggactgggcgcgaaagggaatcccgggcaggggggaggggaatgggcagcctgccctgcccgcggggcagcttagcgctcctccactataaaacgggcgccaaggtcaggattacgcagttttgccgccccgtttcttctcttcttccatcttcgtcatcttcctcctcgactcctcgttatattaggtatataaaatagcctttcttttcttatcctttttagttttacggagtaattgatttgcaactcttcacctgaaactctcttgataaatgggattttgatactggcagtactagtaaatggaattgaattctttgttagtactactactggtagtactttgtactgctcgctttgggtaaccgccaattcaatccaccatggattggctggcttgaacgggaagctgaagaattaattcatggcggaatcatgttttgattgctctgcgtttagagaagagatctctgacgttactgaccccaagattaaactcattgattttatgtttatgtacgcatttattgtattcgtaccactaccagcttgcgcctatagaagctctgcgaattcttgatcgaggcctcatcttcttctctttgtcgcagctctcgcagatcagatcggagacgaagaagatggcgtccaactacgtcgacaccaccggcgacgagggcaggttccacggccaccacagcaccaacaccacgccgacgggcgccgcggcgtcgtcgccgaggacgatgcgccggagcttctccaacgcctcctccggcagccacggcggcggcggcggcgccaagtgcgtgtgcgcgccggcgacgcacgccgggtcgttcaagtgccgcctccaccgcaccaactcccagggccacggccacggccacccgcacccctcccctcccacctccccggccgccggcggcgcctccgccgcgccccggccgtcctccgcctcctcccgcaccgtcgaggcccagtgacccctgacctccccggccgcaccaagaaaccaaccaaccaagaagaggaggagaatcagagtgggggagaagagagtaaaaaagagcatcgcgtatcatatcatcggaagggagtttatttttgatttccctcgttgtgatctccatgttcttggaagatttttcttccatttttccttttctttttcttcttcttcttcttccttcttttggctttatgggatctctcctactacatggccaaaccttcctcttcaccatgatgagaaactccaaatcatcccctgctcgaatcagctccactggctagtagctgctacttctcctccctctattattataatctattggatgatgataagctgataaatggaaagataagggttacccttctgctctactatgtaattactagtaccattttaccatcctattgataatccaatccccacctggttgattgagttcttgtctgaattttagtgatgttcttgaaagtactcctaatttgttggttaacagaataccagtgtgggtagattcaagagcggtatctgcaattgtcatcactgcattttttatgttttgggtgaagaggtcgtcagctgtgatttgcaaggaattgtcgcaatctagatagtactagatactatcttcgtttttgtgggtggcgagtagccattggtgatggagaaggacgatcgtgaccgttttggtgcgtttgttgctgggtcatttctagccgaattcccggttcttgcctgggcagatatatatgggtttggggactagggagtgtgtgttgttgtgttcgtcaaccgttatagttttgtgttttttgttgatatttctttctcatccaggtttctcctgggtaaggtaattcaggatgctgacaacagtggccaaaatgagatcagaatcatcagatagatagatagatattcctcagtgggtgaaaaaacttgaaaggtgaagccaaaggcagatctttaccactactacgcggtaaaaacacatgggcacacatgaccggcaacatcctcaattcttgcatcgcaccaccgtgctgtgatgatgatgatgatgatcacgacaaggaccgagggagacggacgtagtggttggcctggctgctggttgccatgccactgccatacataagcataggcatatgacctattctgttgcagtctacttccgttccacacaaaataacctagaagagcacataccctatttagattcgttgtgttaggcgatgtcttatccatttatagataagtttttcttctaggtaagtttttcctagaacggaggaagacagtagtttcgagactacaagaatcagattctctaccttgctactctttgattttaagtgaccgatatatatagacttcacaacttatggataggcatatcaatgacccacgttacacaatagtatgtcaaaggagttttctttgcaaaagatgggtctctatcatcatcaacaacatcggctcatcgtcatgtggcggtggttacgatggggattgatcattggcccgtcttcttttctttgcatcgactcgacaagctgtttgctgctgatcgaatgttgtgtacgcgcggtggcgtttattgagcagatattttgcacctaaccggagatttggacgttgcggtagggccgggtgggtgaactgctcggagcaggatgataattgataagaggaggtacaatagcaggctataaaccagctataaacatattttaaagagataaaaagaagaaagaagagcagtgggcaacagatttgtagccagctacagcacggactccaagacataatgtgtgtatgataggtgggaccagatatctattatattattaaggaaaaagtacgaattacgccctcccccgaactttcgcggtcgtccgaattaccccctcgaaccacaaaaccggatattcttcatccccaactatgcataccggacgaaatacccctctcgactcaatccgcggtggttttggtatacgtggcgtacacgtggcagtccagtcaacattctatttaaaaaaatttgtgggaccctgcatgtcatacactactctctctcacttctcactctcactcttcctctctctctctatcaccgtctcatggcgagagaggcagggggcgagcgagatggaggcggcgcgcgggggcgggcggtgggcggcggcgcgcggaggcgggcggtgagcggcggcgcgagacgaggcgggcggtgggcgacgcgcgagcgaggcggaggcagcgcgcggggcgggcaatggggcgggcggcgcgcgggggatgggtgggcggcgcgcggggagggcgggcgatgggtgggcggcgcaagaggaggcggcggcgcgagcgaggcggcgatgcgagacgaggcggatgcagcgcgcggaggcaggcggtgggcggcggcgcgagacgaggcggatgcggaccggtggaccagcacgacagcgtcggcgactagcgcgacgcgtacactgccgccgacactccgtgtcccccctgcctctccgccgccctgccccgccggagagggaggccgacgccgacgagctccgcgcgcgcgccgagcggctccggcgctgcaaccgccggagagagaggccgacgccgacgccgaagagctccgcgcgcgcgtcgggcggctccggcgctgcaaccgccggagagggaggccgacgccgacgcagacgagctccgcgcgcgcgccgggtggctccggcgctgcaaccgttggagagggaggccgacgtgctgcgcgcgcgccaacgcacacctccgcgccgatgccgccgcccccgcgtcaccgtccgccgctgtcgtcgtcgtcctcctgctgtagcgcgcaggcatgggcatcgtcgttggcggcgatgttggcgcgcacgaggcagccgagctccatcttggcgcggggccggagcgccggggcgtgggtgaccagcacggcggcgccgcagctccgcgccgaggccgccgccctcagccgtcgcccccgcgtcaccgtcccccgcctgccgctgaccagagtgagagagagagaagagagaggaagagtgagagagagagaggaagagtggaggatgagtatgacatgtgggtcccacaaacttttttaaatagaatgctgattggactgccacgtgtacgccacgtacgccaaaaccaccgcggattggattgaggggggtatttcgtccggtatgcacagttgggggtgaaaaatatccggttttgtggttcggggggggggggtaattcggacgaccgcaaaagttcgggggtggggtaattcgtattttttcctattattaaaggaatagaaaaaagagcctctacgttcgctttcatggcctagaaattccgataatgctcttcgtcggtcgaccgacgggggagcaaaaagatcgggcgctcccccgcggccccgcccccgcgcgcagtgatattgttaggccccaccacattacctgcccccacctgcaacaaatcaaacacatattttgtaaaccctctattaagggaatttggtttattttttgttgcaccaaaaatgtttcacctaatgtactcacaatgtttcactatgtatagatctaatgttgcagtgaacgaaacattccattgcaacaaaataacccacatattttggaaccccctattaaggaaatttggtttattttttgttccaccgaaaaatgtttcacctagtgtactcacaatgtttcactatgtatatatctaatgttgtagtgaactgaaatattatttcgctatttgctgaaatattgtttttatataaggtgaaacaacacctgatttaaccgagtgaaacattttcgatctacttagtgaaacaattccggtatacctggtgtaacatcgtgaaacatttaaaaataattcaataataagttaaaaaaaattccgtcagaatatatccatgtgtggtcttgttttgaagatttaattgcaacgaatttaatggtacaatcggatcatgatttggataagtaatttaagagaaaaatcagtttaaaatagttttgcacgtaaatcgggcgctgatgtcatgctgacgtcagcgcctgatttcccctgctctccatcgggcgaccgacgtgtagtcgcgtcctagaaattctcacattaatcggagaaaaagaaaaagcagagtccatatagaaatacaatttagaaatagttgaaattcggaattaaaaataaggaatattagaagaagagactagagtccatatagaaatacaatttagaaataattgaaattgggaattaaaaaataagaaatattagaagagcatactagagtccatatagaaatacaattaggaaataattgaaattcggaattaaaaataaggaataaggaatattagaagtagagtatagagtccatatagaaatacaattaggaaataatagaaattacaattaggaaataatagaaattcggaattaaaaataaggaatattagaagtagattatagagcccatatagaaatacaattatgaaaaaaaatagaaattcggaattaaaaaataatgaatattagaagtatagtatagagtccatataggaatttaaaactaactaaaattcggaataaacataataaaattaaaagtagagtttcgagtccgtataaaaatacaatt

SEQ ID NO: 42912 - DNA, 8300 bp, Oryza sativa
tatagtatttgaagtacaatttatatcttatacattcgtataaaatttttgaataaaacaaatgattatatatgtgtttaaaagtcaatgacatcatatattaataaaacggatctattaataaaacggagggagtattactacagtcaatagagtgagcagtagaatggactggcagcgtgcacaaattgatgacctaaaatcggttcccgccaatctttgctcatctatcggttcccgccaacttttgctcaggtagtcaggtggtggattatttacaggtcgattaacagtttaacaccaacataactcaggtgagttcacgtggaatttggacgctttttcaaggtggttgaacaatctaaggagacaacagaaaaaacacgcacaaattggagtcgttttacgtgacgtgttgatgtgcccaagccataaatacttttttagtttcaataattagtaagtgactttaaaaatctcatttgcacaagtaatatctatgatctacataaattttgaacggatggaagtgtaatggaccttaaaagtactacttttagaacttaaataacattcttgatacaccatttttgtggatatattatactccatttcgctcattatggaatttattactagttcaaaatatttgataaaaaagttcagccttaagccatattgctccgtcaattaacatgtcatcccaaaccactctattagggtggtcaaggatgaaaagttaacggttctatattttacatactcatgacaagccagtaaaaatctcgtgtcagatttaaaaattgagcatgtaatctcaaatgtgactaccactatatccatttcactagtacacggggaaatcagggtctacatcttgtgcccaggactgcaagccaccgattatgtcctttgcagaaagaaaccccttctcccgtagaagctgaacggctatttgcgagtcattgcctcttcggcaaacaacataaagggaaggcggtttgtctgatgaggaggcgtccgtcgtgtccttcaacgaggtctcgagcatctgaagcttctcctccaactcggagagcgggatgttcagagattgagaaacagaagcaatttggaagtgatgtgcaggtcgtacatccaacagaagatggcgttcaccattatcaacaagccttttgtattctttacaagtgacacgggcacttcctggaagtatgtccaaacttggagctgactgcatagaacgcaacagcaagtgaaatggcataaaactttaatgtttttctttctttcagataacttaaaatttatgcactccattccagaacatgaattttagatgttatattgaaattcattcactttttaccccattccaatctcctaattgcataatccgaatcaggctgtagagaggtgttagtggtatccactaaaatggcctcgctccatatttctgtattagactaacgattagctaaattttcctagtagggaaactcactttatttacattacaacatacaatatccaaaggacttgctaaccagacaggtagtatttaagttcagctgttgatcagattagacagacagcattcctttttcaattcagtgatacatacagaatgctaatgataaataatataaattgtgaagtcaatgatctggagacataccttatcagacattggagactgcgtgaagttctcataatcaaacttctgaaaatcatcttgagtaaaagctgaattttctccacaaaccgtgcaaacagtcgagcttcctcgaatcttgacctgcagaaatatgtaagtttcagtaatgaacttcatgaagagagtgaaggaaacagaattaactttgtattttgtgcagaagaaaaacagaaacagagaatataaaaaaagcatagataagttattcccagtaaattggtcctaaagcaaaggtttcaacatcattagtacttaaaatgctgacaaaaatacaaggagttagcaaaattagtaaaactatcttaatgttcataatccatttccgtaacaaaccatctgcactaaccaaaaatccagtttttctatgttataaattgggtacagataacaaaatctgaactgcatgaacacaaccaagacagactattccctgaactgagtgatgctgagaatgatcttgttacaacatataccacagatattacatattattttgaaggccattttcaagattggagtcagagaacacaggttgccatatgaggttaacccacttggtatattgtaattacagctagtagactgctgctaagataaaagatacgagagagactacgtgcgcccattgactgtgatgcactcatgcacagttgctaaaatagctaatacatgcattgacatgtcatgtttaaactatggtatgatgtagcatgatgaatgagcaggcaggtcacagtgcgaggtacattgtcgaatttcatcaagataacatgaagatatgcaatttctcgttaaactgcctaatgtgtgaatatctgttcaagtagcaaccaaatgatgcatggtataatagtgtagtacaggaaatagaaagcaacacaagacatatctggagtcaagtggcatacaattctgatacgagcagatagagcgtcaaagagtagcattcttccacttaggggttcaccaacatcagtagcaacctttatagcctctagagcttgcaggcagccaatcactccgggaactgtaggtcaacaaagagtagttagtttactagtgcaaaattatctacagaaaagatggaatcaagggatgaagtttatgccatcttattcagtacaatgtcttcatactcacagtatgatatgcatattctacctataacagaaacaatatttgtagccagccaacctaggctgtacggagaagtaggttcaggtgcataggtgggaatgaccaaaatttcaatttgtatactatgagcaagtaattcatgtttttacaatttaccaaaggataagaaaatgtatgcacttaagtaaagtttacaaatattctaactgatgtttcacttcctataaagtgattgttcatttgtatggtcagaagcatcagtaactatgaaaacaaagaagcttgtgtatgtggttcaagccttgaacaaaatttaaaataaatattctaacttatgtttccccttctgggaagttattgttatgaccaagaagcactcgttaatattttactcagtacttaccaaccccaagaactccactgtctgagcatctctggcaggctgccactggtggtggatttgggaaaaggcatcgatagcatggacttccattatgatgataaacagtcaactgttagagaagtcagtgcatgaataaaaaaagaataaagtgaactacaagaatgaagattatcaggagtaatgagatttacctgtccttccaaacctaaggctgcaccagatataagaggctgcacataatttattaaaaagatcagtatttcatcaatgaaaccatggtaagtgaaataaacataagttattttagttgttagtacacaacagctcagtatcttgactgaaactcactaaattacatgctaagatgaaaattggtattcccctgatgaacatttgaagtattgactgcattatttacctcggaagcaagaatttaccttattcagcaacacacaacagtcactgatcatgtatcgagtaggaagattgtccgtggcatctacaactatatcatatctgtgattgatccatcagtggaaaaaaaaattcagtaaactctaaaaggcacaatatattgtctcaagacacttaatgtttcgatagcatactttctcacgatttccaaagcattggaaggtttcaaagtatgatggtactccatcacgttgatagacgaattaatcctgaacagaaatagcatattgacattacagaagcagtagcctcaatatgaaagatcttctttgaaccataaatatttcaatggatggactatataacgacaatctgttaaaaatacagatgcttactcacggcaggcgtcagccgctgacttcacctttgatttcccaacaaatgcttctttgtggattatctgagaggacattcaaggggaaaaaaaaaacagagaacgacatgccacgtgaattttcgagaacaaaatgacccactgttgagtgattatgaagttgctagctagaaagtgaatacaaattatgttcctacggttatcaatcagtaatcaaacatcattcaaataattcagaagggaaaataatgaaagtattagagaacagaagatacatggacaaaatacacgccaaattatctgtacctgtcggtgaaggttattaagctcaacatcatctccatcaacaatgcccaagcaacctaggaagacagaaggttgcaagaaagcaatgaattacctactccaagaaagtcaaggaccatcacaagtaatccatctaatcccaccgtcagctagctatacaaacatgattagttcttctcaacaaggagaataattggagcacattgaaattcagaacaatctaactgcttccttataaaactaaaaccaattagccaagaacagcttcagtaacaaccaacaagaagtaacattaccaacaccacaagctgctaggtacagtgccacgggcgagcccaatcctccagcgcccaccaccaaaatcgatgactgcgagagcttacgctggcctgcgacatagctaacaaaaagtcactagagtctccactacgctgaggctacgataacgcgccatgtgtgagcagctgagcttaaccttcgaccccgaagtccgggaggaggaggtggcggctgtaccggtagatcatatcggccgggaggccatcggcggcggcgaacccattcccacggcggcgtatggggcacgcggtggcgccgccaccgccgcctccgcctcctgcccctgtccccgccgcgtcgccctctcccgcgggcgtagggctagccccgagctgcgactctagcaggcgtatgcggctatcgagctcttccctctccgcccgcagcctctccagctcaccggccatcgcctccatcctctccctccgccgccgccgccgccgtcgaggttagtgttggagggatgaatagagtggaagaaatttgcaaatagcaccctgaaatatattcgtatcttggtttgggctgtgggcctatccttgggccttggagagtgcttacttggactctttgggcctgcttagcaactctagtactccaaatcttttacttgtacttgctaatagaattgcacctgtaatttcttgaggtactgcacacaatatcgagcgaaaataaaatgctgctagctccttttttccttcgaaagacagtacaagtgcactcacaacacatatgagcacttctaaaagactgaggaggtatattttgataaagtcgacacatcattgtcgagagatacgccatctaccgctaaaaaataattagccgtaaatagagtatcgatgtcaaatctaaaatttgtaacttggtgggcttgttccatcataaaaaacctaatcagttgacttacattcacttcgtgctgctagctcttttttttcctacaaggaacaaaatcatgttgttttcattgtcaaattgttggttcccgacgtgtatttgatactatatgtttgttccattgtatctaaaaaaaggcacgtaccagagcatgaataatagttcggacaaccttagaaagcgccagtagtgtagtgatgaagtccttggtgctcataaatatcacgtatatgtggatgtttttaataggattgtcagagatgttgctagtcattgtttctttctttaagagtttattaggaggcaatttcgcgactatttaaagttatgtggcatgtacagtgcgcacacatatttttttttgaaaatagtaagaaaagatgtcacataatcttttcatgttatatttagacaatatataatcaactcacacagcaacaatcttctatctccgttgtctctttctctagttaaaagtatcgtgtgatatcttctttcagatgctgacatctgccctaaggtactatacagtagtagtagatttgttgtcacttgggtaagtaattccgtcatgatatagaactaaatattactttcatggtgtgtttcagcatatagcgtaaatggtactttcttgaagtaactttagtgtaaaatatatataccgtactggcaaatgcggactcgttgataatgactttcgatttgaaatcatctttggtcccttatctgagggtcaagtttggatcacattcctcaagtataaaatcaggtataacacattcctctatttccaaaactaggacaaataatctcaaggcaattttggatagcgatttcggcggacgtggcacccaagtggtgcactgacttggtattcatctgatgtggtatctacgtggcataacaattagaaaaaaatatataaaaaatagcaaaacccacaatcagtcccaagaaaagaaataaaaaccagggcccacgtgtcgatctccttctgcagcctcggcttctcctcctcctgccagtctagctagcctcagccttgacctcggttggttggtccagatggtagtgcagtgacgaagagaagtaggcacgctagcggcgagcagctccttacttgtcagggagggtccaaatgcgacccgtcctcctcgccattggcaacctcgatgcagcttcctcctcctccgattcagccgcccctactccgaggcctccactaccaccttccttatcctccacaagcttcgcctggcttcctccttctcaactgcttcctcgtcaacgtgtgcactatcaacagcttgaaacccattatgtggaataagggagcaatcctcgtcaacgcgtcaatgcctcaaggagatggtccacgtcaacagcttgaaaaccatcatgtggaatagcggcaaggagaacattgtcaccacggccgaccgtggcggcttgccatttcaactttgatggcactagccgctagaggagcagcgccatcgagccttcacgatttgaaggaaaggggagaaggatttggggggagacattggagcgtcaacattgatgaggacgcttgctcgcttgagtctagtgcaagcttgacctcggtgacaaggtggcgcaacccgagcttgacgatgaggcggcccaacccgtccctctccctcgcctccaacctatcctcctcaatcgacacggacagccgtggccccctcctcgctggttccctcgccttgaagagctcactggctccctcatctcgcctccaaccgaccaacggagcctcctcctcgccaaccgctcaccgtagccaccgccggccaccaccactgccatgccgccatgcgcgccaaagggagagggaggagttgtgtcgaaggtagtcgatagtgatgacgcttgagctcgacatctgccgctggccacatctgggaagggagagggaagaaaggaaaggtagtgtcaccagctggagcctggaggagagagggggaggtggaggaggtgtggcccactacttttgttctatctttttgtttgactagggcccacatattttgttttatttttttaatgttgcttctagtgccacgtcaatggcacgtgtggcgaggaccaaatcaaatgagccacgtagatgtcatatctaatgaaactgccatccaaattgccttaggatattggttgtactggttttgagagttgagcttcttacctaaaatgaacttgttcgtttcgcatttcggcatgtcctccacccctttattctttatacttcttgtttaattataagacgtttaacgtttccttactgaacaaaagtaaacatgaaatggagaaaagcttatactccatccctttttaatagataataccgttaacttttagaaacacgtttgatcattcgttttatttaaaaattgtatgtatgagatataaattatgtttaaagtacttttgtgataaaacaactcgcaacaaaaaaatgataattaaataattttttagatatgacgagtgatcaaacgtgtattcaaaagttaatgctgctatctattaaaaaaggaaaaggatgtagtaaatgtctacagtgaattttggatttaagttgggttagaacacacagacacagtgccgtaaaataatgaacctttgccatattcaagtccagatactgctacaat

SEQ ID NO: 42913 - DNA, 9174 bp, Oryza sativa
ggcccgacgatgccttatgttttccgtatcaaatcctattccaaatcgcacaaatacctgtttgcggtttggttcagatgctgtgctgctttcatttcgcagcgaagattcctttccggtgtcaatccaagcgtcaactgctgcagacagaaggccatggttctccactcgccatgattcagattttgagcctaacgaaaacggaggacacgcctgattgatccacccgaataataataataattctgcgaggctgccacatcatccatgaccgcatcttaagcattaatcaaagccctaacagcggatggggacaagaaacagcaaacccttgatgctggcaaccggataagatcgagttggatggagagagagagagagagagagagagagagagagagagagagagagagagagaagcagcagtggtagtacttgcttcctgtatcccacaagaaacaaagcatcagattcctgaaagaaaaacatactactactactattacccagtcaatttcatatttttgtggaaaaatttcttcatgacactatggttatgtttagttctacactaaaattgaaagtttgaagaaattggaataatatgacggaaaagttggaagtttgtgtgtgtaaaaaagttcgatttgacggaaaagttaaaaatttaaagaaaaatgttggaatttaaacatggaagttgctataagattcggattttatcttcatttctgttagcatatttttcaaattactagacggtgtgttctgtaaaaaaacattctatatataagttgctttgaaatatcaaatatatctatttatcaaattattataattaaaacttaattaatcatgcgtcaacacctttctcattttacgtgcgcgaacctaacctttctcattctacatgagccaacttaatcatcaacttcatcggtttcaaacaccacggtgtacaaattgcaaattagacacctgatatttgtgagtatgacacgtgggacccaggtccattaaccagtggcacgtgtactgcccattttctccgcatcgctaggtgggtccggtggttcagcatcaatggttaattaactgtcaccgctttcttaccgtcactagctataggacaagtggctaagctaacctaagcacgacaataattaactagatttttcacaatttggagcttttaaaatactttttttttgcaaataaacccctgaaaaaacttgtcctaaaaattgtctatttggacgccagagtcgctggtgccgtcctcttgtcccccacccctcctagaaaaattttaattagtgtagaggagagagatgtacaacttttttttatctttttgatatatttttacacttaggagcacataacaaccaaccatagaaaatagacgaaatatgtaacttgtagaattttttaaagctctgtcgaaaagtttctcgcctcgaaaacacaatcttacaagcggaatttggagattataatttcatcgaacacggatgtaactttttctgtagatgtccgtggttatattattttcctgattctgagtatgaaaaaattgcgcctgttttaagaaatgacacccaaatataactaataaaatacaaaccctaacttttttataggatgtaaaagatgtaaaaaaaaggctcaagagtgttcgaaatctaatctaccttttttttactatatgaaaaaccaaaacgaagagcagggagagagcgcggggagtgggggggggacttttcagcagagctttgtaaaattctacaagtcacatattttatccatttaagtttaatttttctatggttggttcttgtgtgctcctaagtgtgaaaaaaaaatatcaaaagaaaatgagagaaagaaaattggggtgggggaggggggcggcgccaaccacattggcgcgctccccctgccacctcagcgccgccccgccacagtggaaggaggctggcgccagtgactctggcgtcaaaaaatgattattttttggataagtttttttagtgactatttgcgaaataagttttttaaaaggactaaattgtgaaaaatccagcaataattaatggagaaggggtcctatatatttcggtgcagctttgttcaaccctgccctctctgctgtgcttgcctccaaataattttttcccctccgcttttgctgcctcgtcttctctagatcttaattaccacgaaattgcaatgagctagctcgtgtttgcgagtataggtagctaggtagctaggcgtaggggaggttgccggagaggcagggatcgatggaggtgttcatccacgaggagtacgtgcacaagcggagggagcagcggcggcggcggggacggcggccggcggcggtagcgctgcagctgctgcaggtacagtcgtcgtcgacgacgacgaagccggagaagaaggcggcggcggcggcggcggcaggaggaaggcggccgctggctccacttgcaacggagcttcaggatagcccgtgggacctaccggccggcagcggcggcggcgcgtcaccgtccgacgccgctgggtctccggcggcggcggcggcggctaccgtctccttcgcggaccatctcctcggctacctctaggtgaagtacagagatcggttgattaattagctagctatatatgcgtgtttccatcgtctgcctgtaattaagttggatcaggtaataataaatccgttggcatgattttattcttgtccgagctagctagtgtgctagtgtgttcgatttttctgctttttgtaagcatgaaattctctcgtgctgctcaacgtgagagtcccttgtaggaggcaccaatatttttggagttgatcaagtggaattaatagtggattatgctgcgtgattaattaagctaagtagattaagatgggctcgtgacttggttaatcctaaatgcacataggaaatggtaaaatactcaccgcccaaaacaggaatgcacataggaaattgctgaaaatcctaaatgggagaatcagcagatcagaacgacaagatccactttcccgtgatttctgtgtcacagtaatgtcatgatctcacactacaggtttcccagatgcgcctaggaattaacagatgggcaaaatttgaagcaagagagaagagagacatgagaagttgagagctgacgtgcatctcaccaaacaggtccaatttcaaccggaaataaaaatcctctattcaaccagaaataaaaattctaagtgcggtatccaatgcaaataattaaactttaaaagtgtttattccttacagattaaatttttatcgtgttcatgagctaaaactacatgtccgtagtgttgtacatcaaaagctaccatattattattattttttaaacatagtttttgcctgttggactctgaaacagatacatgaaattgacaaaacaagcgatttaaacagccttccatggtcacaaaactgatcttgaaaaaaaaaaggtctattcattcactaggaatgtgtccatttcaatgtttgtcccgacctctttctttgtgacagccttccccacgaggacatgcccccccccccacccccacggggatgcacgcacggaccagaaaattggtgtttcactcaggtaagcgcctgtttacttcgtgaaaagaaaatttttgggtgtcacgtcgaatatttgaccggatatcagaagggtttttcggacatgaatgaaaaaactaatttcataactcgcttggaaaccgcgagacgaatcttttgagcctaattaacccgtcattaacacatgtgggttactgtaacacttatggctaatcatggactaattagactcaaaagattcgtgtcacgatttcctctctaactgtgcaattagttttttcatttacctatatttaatgcttcatgcatgtgtccaaagattcgatgtgatgtttttgggaaaaaaatttggggaactaaacagggcctaaagattactcttatacgttaggccgtgtttagttctaaagtttttttccaaacttccaacttttttatcacatcaaaactttcctacacacataatttttcaacttttccatcacatcgtcccaattttaaccaaatttccaatttcagtgtgaactaaacacagccgttggtttataatttttttctgtaactttttatttttattcttcgaacagcacctttaaaatgtagattaattaaaaaacatactactttctatccaaatggaaaaattactccagatcaccttttactgaaacagtggaaagtatttgaaacatctcaagttcacttcattacaaggatgaaagtatttttttctcgtattttctcttttttttacgattacacggcatatgcacgcgcaacgccacattacactcacatcctcatgactacatcccctagcacacattcaagaaacaaaaatccaacacatcactaatctcattaaaattttgttgaaagctcaccttattttgtccgtgaccttggtaacaataggtggtgtgacaaaagagtgcatcaactttataacattttttaagatgtcagtaaatcatggacaaatagtaacactctcaactatactccatccataaccataaaaaaaaactaataccggatgtgacacatcctagtactgcaaatctaaagcgtctcacccagatttgtagtactaagatgtatcatatcttgtactgggtttgtttttattgaacggagggaaaatgtggcataagtccataataaaatcaaatttcccatgcaatatgggacacaccaaagcaccactacctaatctgcattttcttttccttttatttaagagaaaattccttgtgtgcccttcaaaactcacccaattccttctgtaccctgaaatttactcaatcctttctatgtcctccaattttttttatcccttatgtacccctaccattaggtttccttcaatggactggttagtttgtttgcaaatgttcattgtgccgttgagaatggaggagttgctggaagctgagtgcctggttggcagagaatttgataaagtttgaaatattcatgagtgaatcataggtgtgttttatgagactaaaataatcagtgcgttgaaaatttaaaataattttcttcaaacaaatttaatgcattgaacttttgctatatcatgtactagggcaatggatcctaaaagggtactatgaaaattttaaaaatgactggacattatgatcccatccatagaaaacactgttaatgcataattaacgaattacttcataccatgcgtacaacacattaccatttccatacacaaaagcgcaattaacaaactaaataaacaagataggaactgtttatatcatgagcatcattgccacaacagtagtcaccccaatagcaagcaatcctgggcattacggtgctatggtagcaaaaatcctgagcgggcttttctacgctgaattgttttcttgaagttcccaaattatctcctttattttctacatgcacattttttcaactaccaaacagtgcgtattgtgtaaaaaaaatatacaaaagttactttgattatttttcagaaaaaaaataatacttaattaataatatactaataaatcgttctagctgcgcgtagttcccaacagcaagtatcgaactcagcctctgtggtggtctccattgctctgcctgcacgtgccaattgcagcataccaagttaaagcgaaagccgaaacaagcttggatatgaaacaaatttaggcaccatgcttttaatctggaagctgaaacaaaactttttttatgttgttgacctctttgctctcaggacacataaatttcagtgcttgtcaacttttgtttatatttggaataagttcatctaaggtcccttaacttgtcaacgaatccgattttcgtccctcaaccggaaaaccagatacaacgggtccctcaactatcaaaaccggtgcaaattaggtctctcggcggttttgatggcggttttggctgacgtgacgcctacgtggctaatttgacttggtcttcatctgatgtggcattgatgtggcgcttacgtggcaatttgatccggaaaaataataaacttcgcgggacccacatattagtttcacacataaattaataaagaaatggtggggcccacgtgggcccccctccttcgtcctctttccccacctcccctctcttcatctctcccctctcctcggacatgcgggaggcagcggcggagaccggcaatgccgacggggcgacggcggcacgaagccgacggggcggagtggggcagcggcgggcggacgcgcgcgccaagaggtggtgggcttctcttttgactttattagtgttaggaataagttcatctgcaggtagtaatcctgaccctgcatagatcgatcgtgtgctgatcaattacttctgcttctgatactgtaatcctgcggcggatcaattatttcttctcctgatctgagcaatttgcgccacggatcgtcgtcgtgagcctgtatcgatcgatccattgtgtgcttgtgtagtttttcactgggttatattcgttttagggttggagcgtgcggtgcaagagctgcctgcgccggcttctgtagtcgctgccaaatccgaagctgctcctgaccaagctgacgacgacgatgatgcccaaactgacgacgaggagtagacgtgcggcaggaggacgccggcgcacagcggcgcgaagccagcggagcggggcggtggcggcgcgcgaagccagcggggagagggcaagagatgataaaattcacgaaatttcattaaattcaacgaagcgtgcgtggagggtggtggcgcgctggaagacgacgacgacgaggctggcgctcaccgcttggctccgccgccccgccggcttcgggcgccgccactccgtccgcgcgtccgcccgccgctgcaccactctgccccctcggctgcgccgccgccgcgggcgtagcgccggctgccggacctccccggcgcctggagagaggagaacggagagagatgaagagaggggaggtggagaaagaggcggaaggaggaggccgagaatgacatgtggggcccacgtgggcaccaccatttctttattattttatgtgtgaaactgatatgtgggtcccgcgaagtttattatttttccggatcatattgtcacgtaagcgccacgtcaatgccacatcagatgaagaccaagtcaaattagccacgtagacgccacgtcagccaaaaccgccatcaaaaccgttgagggacctaatctacaccggttttgatagttgagggacccgttatatctggttttccggttgagggacaaaaatcggattcgttgacaagttaagggaccttagatgaacttattcttttatatttacagaaaaagaaaatttcagttcccttccccaaacccaacctgccgagcccacataaggaaaaagtacaccgatggtccctcaacttgtcatcgagttactaaatcgtcatctaactacaaaaccagatatccaacgtcccttaactaatcgaaaccggttacgataggtcattaggtggttttgactctggttttatcctacgtggcagctgagttagcgtgggacccacgtgggccccacctgtcagcgtggccacatcagcctcctctctcttttcccctcttctctctctttctcatctctctcccttctctgccaccgtcgactgtcccaccagcatgaaggacggctggagggcgcaccagcgcgtcgcgtacgacggcgaggccaagaaccttaccgtcgcgctctcctacggcgacgcggcggcggcccgacggatcccgtgctctggtacgccgtcgatctgatggagtacctccccgatgccgtcgccgtcggcttcttcgccgctacgggcgaggccgccgagctgcagcaagtgtagtactgggagttcaccaccagcatcgaccccaaggacgtgtgggtggtgttgggactctacagcttgcttcttgtgctcgtcgccataggggtgctctggttcgtgtcacaatggaggaaagccggagagctcgccgatggtgacatctttgacgagatggtgtacgacgagcttgccgacgaggagttcttcgtggagagcgggccgaggcggttccggtacagcgacgcgcgtccgcatccaacgcgcgcgccggccgccgccaggtcaccgccacaccttcctcctcccccgcgcgccggtcaccgccacaccttcctcctcccctccgtctcgccgccgcccgaaacggcgtcggctggggcacccggcgcccatggtggaggcggctagatccggattcgccgtagcctctcagccatcgacggtggccggcggcggcgcagtgctcgcgctcgtcctcctcctcgtcctcctcgccgcggctgagtggtggcggcggcggagcccgagccctagtggtggtggtggtggcagcggccgcagacctcgccgatggcgaagaggctacggcaaatccgaggcggcggcgccatgctcgcgctcgtcctcctcctcgttctcctcgccgtcgcggcacggcgcgggcgagggccatcggctgccgcctcgggcgcagcaggagtacgacgtcacctccgccaccgccacggggccttgcgacgcctacctcgtgttccgctgctccccaccgctctacgcctccgccatctccatctccaacgtcctcaacatcaccgccaccgccgtcaccgaatccaacgccgtcgacccggtcacccctgtcgccgccgaccccctcgtcctcgcgcccgttgtcggcgacctcatccccacccgccggctagcttgcccgagaggagagggagagagagaggaggaagggagaggaggggaaagagacggagggggatgaagtggcattctgacacgtgggtctcacactgactcagctgtctcatgttgcgtttaggggacgattttgtaactcgatgacaagtagaggacctcggtatactttttcccccacataatgctgggcccttccttagatagcccagggcaagcccggcccataagcccaggccag

SEQ ID NO: 42914 - DNA, 2272 bp, Oryza sativa
cgtgggcggatcaggagcagaggaacggcgggggccgcggcggcggcggcggggaggcgaagcggtcggagatctacacgtacgaggccgggtggcacatctacggcatgaactggagcgtgcggcgcgacaagaagtaccggctcgccatcgccagcctgctcgagcagcacaacaaccacgtccaggtggtccagctcgacgagtcctccggcgacatcgcccccgtcctcaccttcgaccacccctaccctcccaccaagaccatgttcgtcccggacccgcactccgtccgccccgacctcctcgccacctccgccgaccacctccgcatctggcgcatcccctccccggacgaggccgccgccgccgccgccgccagctccaactccggctccgtccgctgcaacggcaccgcctcgcccgacgtcgagctgcgctgcgagctcaacggcaaccgcaacagcgactactgcggcccgctcacctccttcgactggaacgacgccgacccccgccgcatcgggacctcctccatcgacaccacctgcaccatctgggacgtcgagcgggaggccgtcgacacccagctcattgcccatgacaaggaggtctacgacatcgcctggggcggtgccggcgtctttgcatccgtctccgccgacggctccgttcgcgtgtttgatctccgggacaaggagcattccacaattatctacgagtccggttctggcggcagctccaattcggcaggtgcagatggcggcgctgcctcgccaacaccgctggttaggttagggtggaacaagcaggaccctaggtacatggcaaccatcatcatggatagccccaaggtggtcgtgcttgatatccgctacccaacactaccggtggtcgagctccaccgccaccattcgcccgtcaacgccatagcatgggcgccacactcctcttgtcacatttgcacagctggggatgactcgcaggcccttatatgggacctgtcatccatgggcactgggagcaacaatggtggcaatggaaatggcaatgctgcagctgctgcggcagctgagggcggtcttgatcccatattggcgtacactgctggggcagagattgagcagctccaatggtcagcgacccagcctgactgggtcgctattgcattctccactaaactgcagatcctcagggtctgatttctttgttccaaccctgttagtaaggggacatcgacaagaacaaagaaggccagcatggataatgaggttaggtgatcagaggacattgttacttcagtcttatttattttaagttgtgcacagatgatatgcgcgctgagttggttctagtgatataataaattgtttcctacctagaagctggaattggcaatgaactgagctgttagagtaattagctgctctaggtttagtattgatgttaatgtggattgtagttatgtttgttgcttgttctcgaatgtccagctccagtagggcgtaggttcacctcttgacttccatgttgtattttgcactcgccgtatatgcacttataagttataagcttgtgcgtgttattttgtttcagatctacggtgtttctcatgttgtgctgttgaagtagaactaaatgcatgaaacttgacatgctatcaaagccaagtgttctcgctatcaccctggatggcacacttttaagaagatccttgtcatgtggtgaacatattggtactttcaatttagtatgtgcaatcttcagagaccagtagttgcattgttatgtcttccattggttcacttcaattcatatcctatggcctcattgtttgtcgttttattaggtagagttttagccttttagggtccggtactatggtttgctggtgtgggtggtttgataatctactgtagcttgtaacagttattgatgccatgtggtcaaatagaatcggcctttttctggctttctgtaacagttgtagctgcagcaaatgaatagatgccctgagttatccttcaaaacataaaataaaatgaaaccttgtgtcttctgtgaatagtgccacaacaataaggccttggtgcttatgggtgcatctttattaagtatcatctttggctttgttttagttctcttctagtggtgtgtttctacttagttgtattctttcttttgtgaatatgatagttgcacatcttccattggacaagttggaaaacaactgagatgtgtgtgaagtcacttagagacaaaatgtttcccc

SEQ ID NO: 42915 - DNA, 1453 bp, Oryza sativa
acgaatgacagtatagtgcccattccaaagcattgcatattcttgtacttttcctttacaattccttcgaaactttacaattcctttgaaacgaataagccctaaggtctactccctccgtcccaaaaaaaggcaaacagtaggtttccgtgccaatgtttgattgtccgtcttatatgaaaattttttataattagtatttttattgttgttaaatgataaagcatgattaatactttatgcgtggcttatccttttaatttttttcataattttttttaaataagacagacggtcaaacgttggacacggaaactagggtttgtctttttttggacggagggagtaggttgtccagtgtccacccaaataatcacattgaaacaacagccacagcccacaggccatccaattatgcaattagaacatagaacatggtgccatggtggtatgaaaagtcactggaaataaaagccattcacatcttctggctgctgcacaagtagttagcttcgagtttgagaatgaaagggacactggggtaaaagggagtggaggaaggatgcagaatctgtaaaatgaatgaacacgtacagcacctttctacgacagaatccagtagacttgtagccaacccttgcatagaatcatattattgaatctccatcacgcaacgtggtaatctataagatgtcaaaaatgctcttactcttattattacagtatcaagtgtcttgtgatgtgtgcttgaaatctccaagcgcaggaaggagcaaagcaaaatcacaaaatagatgcaagctgatacttgcttgaacctcatttcaaccaaaaacaatcacgcgcacatgcaaagtagaaaagaagtcaattctcaatcccttcttgaacaaacaaatactacatagtggaaagtggaaactttataatggtgcacacgcacacttgcttgattgttgatgctacacaccaaccagatgatattatgcttcagcaatcaacaaattctacagttggtgaaaaatgatatgcaatccaaatacaaataataggctcccaaaaggatatcctatgggggaaacattttgtcactaagtgacttcacacacatctcagttgttttccaacttgtccaatggaagatgtgcaactatcatattcacaaaagaaagaatacaactaagtagaaacacaccactagaagagaactaaaacaaagccaaagatgatacttaataaagatgcacccataagcaccaaggccttattgttgtggcactattcacagaagacacaaggtttcattttattttatgttttgaaggataactcacggcatctattcatttgctgcagctacaactgttacagaaagccagaaaaagccgattctatttgaccacatggcatcaataactgtcacaagctacagtgaatatcaaaccacccacac

SEQ ID NO: 42916 - DNA, 17483 bp, Oryza sativa
tttcgctttttccatgaggagtttacacttacatggaaaggtttaagtacacttcttggttttcacgatacctgtaaaatcgatctcttgaaaggaatttctgggttcgagaaaaataggttttgggaagacatttccggtgctacaatttgcaagaaacctagaacgaatgatatccataatcctacacttaggcttatgcacaaatggattgctatgactttgtttcctagaggtgatattagacccattaggggagatgaattgattattatgtttgccatggttagaaagattaaaattgctcctgtgaaatgtatgataaggcaatggttagaaagtatcaagttctttgctcctgttgagtgcacttctctgattactcggatagcaaaagggctaggagtcgttagtgaccaaattgcttttttctcagttactcgtccgcgtattgatgaggcctatctagtgcaggggcattttttgaaacatggagaagatggatctttgatttactttttctctggttgtacaaatgaaatcctgttgccaaatgcggggtatcatttgtacaactgtcatgaactaaccatacccctgcagaccatagaagaatctcgtgcaggtggagcatacagggagacgcgcaacatgacaagaaatgaacgagaaagttcatcatcctcaacaccgtacagatgtatgagcgaggttgggaaccaactagggatgcacccggatggacccaagctccacgtcacaacatcggagtcttaggctgggcaagtgccagtgaggaccggtggcgtgcacctcatgacatacaatggggggacaaccaaccctccagatcaagcggtttgcctccatctcctggtggatggcgctcaagttcctctcgttgggacttgggtgaaatctctagtagactggacacccttgatatgcagacgggggagagattcagtacaacctctcggaacacatagcacaaacgcaagaatggcaacaatctgctgatgctcagttcgccaacttcaacaacatgatgcagcaacagcacgattaccttcaagcatgcttgagcgaaggctttaggttcccgggcttgacggtcctagttacttgcggcattgccacgtcaggaggctcaaaacctcccggcaaccatccggcactggccatgcctcacccggctatgccaggtgtccctcataccgttggccccacaggtgactggcaaccacctaggggttgagcgatggcttcaggtccttgggcttgacggtccttgttacctgaagcacagccattttcggggacttactacccccaggccaccacccgaccccggtcagacccgaacggctgagccaggtgtccccataccgttggctccgtaaatggtttgcggccatctaggagttgaccgaagacctcggcttcatgggcttgacggtccttgtttccctttgtattgtcacgcaggagacttgtaacctcctgccaccatgcctagcacacatctcgaagccgggcgagatccccaagcacttgggtggcaaggccttcctcacttgtagcatcagggcatcagccgggctcctacatcaatccagctggtaaaggagtctggccaccctccttgaatagtcggcagcatgagaaagctaagtacactgcaaatttaaacgccagcgtatttacaagcttcagtctttgccacacattcccccacatgttctaaccaacaagatagaaaggaaaagtgtttcattataggtcaagatcattgaccaatgcagcagcagcagaggcgacttcttctaatcgccagccgacatcctcctcagagtagtcggccgcatacccttcctcgacagcagccatatcaacccaagggtagtgcgacttcaccattgccagggcatggttggtggcgatcctcgcagccgactcagccatccgacgacaccctgccatcatgaagggatctttgccttcacctcgactcgggaagagcacgcgcagagttgggaccagggccttcaccaagtcttcgcgctgtgccttcaccgagtcaagctcccgctggaaatgctcatactgcgtacgaatgttctcagcgcgcacattgacctcctgatacaaattcgccagattcgtatttgtcttcacgaggtcttcctccagggtcgccttttcgacaagaccatatacggtggtctcttgccaaaactaacaaaaccgtcataactaacctaattaatagatacaattgccttaattgagctctatctctaactggcaatgacggttaaaccaatctaggcccatgccgagcccaagtcacaccatatcggctgtatcggccatcagcattatcaaccttgattattatcaacctctgttttcaaccgatacagtcttcagccaatgcacagtccgactccaaatctaactcgatccaacaccgaatccgctttgatcttcttccttcttctccgaatctgatggcaaattccgttgttaacaacaatatagcagaatttgaaggagttttgctagttatgagaaaggcaaaagcactaggggctcagctcttgataattaaaactgattcaaagttggtagctagtcatttttcgaagacaattgaggcaaaagaagaaacaatggcaaaatacctacaagaagcaaggttgaatgaaaagcactttcttggaataaccgtaaaagccatagcaagagaagaaaacggagaagacaatgagctagcaaaagcagctgctgcaggccaaccattggaatattcattttttgatgttgtaacttactccaagctatgagagaaaagagtttacatgcatacaaaaagtggcaaattggagagaaccaattctgaagtatcttgttagtgaacaacttccagagaaagaagaggaagcaaggagctacaattgatgtccaggaagtacaaagtaatagaaggacagttatacaagagcggagttaccactccactgttaaagtgtgtaacaagagaagaaggcatgagaatagtggtggagatacatgaaggattgtgtggcgctcaccaagcaccatggtcagtagcatcaaaggtgataagacaatgaatatattggctaacaatcatgaaagacacggagaaatacatcaagacatgtaaagcatgccacaaatttggtccaacatcaaaagcactaccgaaagagttgcaacaaattccaccggtttggccattctatagatggtgatttgcttttggtcattatggcaattgagtatatttcaagatagattgaagcagaagctgtagcgaggatcacctctgcggaagtacaaaagtttgtttggaagaacatcatatgccgatttggagttccaagggagatagcatgtgacaatggaaaatagttcgagtcaggaaagttcaaagacatgtgtaaatcactcaatttgcttcagtaggccatccacaaacaaatggaactgaagaaagagcaaatggcaagataatggaagccattaaaaagagggtggaaggatcagctatgggaaaatgggtagaagacctattgtcggtgctttgggcattaagaacgatggtggttcgatcaactggaatgacaactttcattctagtttatggagataaggcaatgaggccaagtgaagttggagcaaattcacctcgagtcatatttcatcagcaagatgaagaagagagattacactagaaatgctagacgagataagagttgaagcattgtacaaaatgacaatgtacacagaaggaaccaaaaactactacaacaaaagggtgaaaacaaggaaaatacaagtaggtgatttggtattgaagttgttgttgggaaacttgagtcaaaatgggaaggaccatttatagtgaagaaaagaatagaaacaagcgcattcaatttgccatatcttgatggagaagaactaaagcacacatggaatgccatttcattgaagaagttatatgttttaaaaaaaacttttcgtgcttatagtatattactcagtttgtaaaatacctgccagcctgtaaagtactcctctccaatcttaatatatataaacatgtcacatcctgatttttgtttcaggatttataaattatttaataaattattattagaatttatattaaatgttcgttaatttacaagtgaagttaaatgtgggaaataaaatttcctaaatataaagcatggatggatttaatttttattaaattctccatggttaattatactctctggaattttctcggatttttcggagctcaattattaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagccgagccgcccgccccctcctctctcaggcgccgacatgtggggcccacatgtcggttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctcttccgtcctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcatcctctatgtgtacatgccctccaattccgcagccggccgctctatctccggcgaggtcgccatcttggttcggccatgggtgatgtcagcatgacgtcatcggtttttctttttctcgtttttctaatagattaaaacttcggaaaatcataactaaataaccgtagatccgtttcaggtggttcaagttgctaaatttttctaaaataaagatctacatattaaaattgtccataaattgaattaaatttatttaattttttttaaatgggctttaaatagatttaatcttgtaaaattcataataaattcatttgaagtcagaatgaggccgttcaagtctcataattcatctaaaattatgatctacatgtttgtttactttatatgtattgtttatttggtttttattagtctttttcttcgttttacgtgttagcttgttgtttccgtcgttgcgaaggttcgtgagtgcaccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatatcctattccttgataccttgggtaataaattgattagcttgaaccttatgtattggtttggttcagctaaatgttagatataattgcttagcaaagcttagaaacattagctcactaataggatgaatcatatatattacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggtaacatgtgtggaatcgtgtcttgtgggtacagtggtacacctctggccagactaaaactattcgaatagccgtgcccgcggttatgggcgggttgagcaatgtttttcgtgattagtctcacacctctcacaataattatggatgttatacctggtaataatttgcttagctcctggtttggagaatagatctgtacagccgggtatggttgttcaggatggttgggcctgtgcagcatgggtgtgttgttcagtgttgattaaaatttctgattaattactccactgttttacttcttttaaatgttttgctaaatgctgcttttgcaaatgagcctatattatgccatcctttggtatccttgtgcacttgcatatttgctgggtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccactgcagttttcttcttggtgaggactaagtgcctcttaagtaagtatttatcggtttagttattatgatggatttgtatattaaattgtcagtttgtgtacctcggctgattcctggacgaggattttatgcacaaatcagttcggaaattactagtaaatttccgggcgtgacaaaacaggatgtagggtttttatccataatggaggcccgaacctgtataaaaaacttgtctttgtgtgtttatgaatgatgatggaaaatactccacatagttcggagaaagtacaactcgatcacaagcatcgataaaatactctgcacggttcggagaaaacacaactcgatcacaagaattgagaaaacattctgcacagcttggagaaaacaaaacgaaactaacatgagctcgaacgctacaatctgtactcgagctcgaaagctaaaaattgcgtgacgcggcaaaacatagttcgacctcgtcactcctttgaaagatgaggatgacggtggttttcgagcaatttttgccttagctaaaaaaacatgcatatcttcagcattactttcattttgttctttgcggataagctcgagctcttcattacttttttccaaaacggtgatttgttctttcaacttatcttcagcatcagctagttggcgagaaacctcttgatgttcaaggacagaccgctcgagagctttttctcgagcatgtaattttttgttctcttcaacgagcacctttttctcctcaataagcccttttatcacgccgctgatttttcgaacaagatcagtgaaggcgttcttctcgttagaaactcgattgagctcacgatgaaggaattcttggtctttcttgagtttagctatatgttcgacggattttttccattgagcgcaaattgcctcaagtgctttcttagcaacatcccgttgaagtcgagcaaggctagcagtctacaaaagcaacaacaaaacaagtaagacgtgagcactcgaaaacttaaaagttcaaaaatatgattactcgacagtgaaagatctcgaagtgtagaaaatacctttgcggcagacacatcgagcgtggcccaagaggacataagatcattttccttgatgaactctttttccaactccaaagggattaaaatcctctcgagctcatcgccaactgggccgagggggttgtggtgcttcaagtcgtccatgcataggttggccctgtgatggctactttcccccatatcgctgaaattgggcaaacccatcaaccaatgcccatcttgagcgcaacgctcgctaaagctgccaagaacttcttttaccagttgaggagatggagttaatataaatgggggagaaggagtccaaacagttttcgaactatcaccaactcgaacatcgccagttatagtgttttttccaatttcgtgccgttggctgatgttgactggagactgagctgtctgagtttctaagtctttgttagctcgagtcgggctactcaagctggtagtctcgacagcatgtgctcgaacactcttctccactactgtggcagtggatgcaagtacatccaaaggagcagtttcgttcactgaaacggcaaggctggcatcagctcaaatggggatgacgttgataacagggaattcgattcgaatttaatcatcatccagttcatcatcactgtcattgacaattttgacgttgatgtttgggggcctgcttgaaacatttttcctcttcaacccgctcgaaacatgatggggaggaggagcgatctttgcagtatcagaggcagttgattcgctcgagctatcgctcgaactgctgctcgagtcatcatcactgcttgaactgtcctcatcctagtcattttccttattttcatcgctgtcttcattttccacattgatatcttcaacatcaacttcgtcttcatcggaggatggggcttttgccttctttttcttttttttttcctagctcgggagcttgctcgggatgaatgcaagcaggaatatcggtgtttagaacagcaaacacatgattttgtcttttcccattttgcagtgtcaagtacttcaagtactcatccttggtaaacggaccaataagcttccgacagggacggacaatgtcctctgggatgacaactgaaacaatagaaaaacatgaataagtcatttaaaaaactggaaaagcgaagaaaacgcaaaagaaaactttcaaacaagatgaaacttacgttcagaagaaacgatgaggggatgaagtagtgaggtggccccatccggaagttcaccaaggctaagggcccaactagttgagagaggtcgaataccaagacagatgaactcctcgaccaagtctcgaacactaaatttcgaaacgagttcttcaactagagatcgaatggcggtaaaatcagaggaaagcgctaccgatggttcgaagacaactttcggggtcttacaagaaaaagtgaaagggcagtctttctcagcatacaactcggcaggaatttggaggtagaaccactttgattgccacttgtttccccacttggttcgactcgcagaaacaataggcccgggatagccgcggttcgagtggggggagaagttgatgcagccaaacttcgaattctgcttggtgtagtgtctggtgtggtgaaagtacgcaaaatcttgagcatgaggaactccaccacaactgtgaatgatccattcgaaaacccctagcctcacgacagcgtttggagtaagttgtgggaactcgagcccatacagcttgagcacatccacaaggaaaggactgcaaggaaacatgaagccgtcatcgaaaaaatcttcaaacatgagtgtgtagccaggcctcggagaggggttcaactcgttgactggtcgaatagtgacatttgacaagaaatcgaaccgtttgtgacaagttcgtccaggtcctagaccagaaggggtcttctccaatttcttggtgttgtcgaagcgaccactgcgtacgtcgaaggacgtggttactcaacagttgttgggaacagtgaagtgtattaattttggaatttttcttgggatcccccttttatatgaccctaggggtctatttataatactatcacaggttcccccagtagggttttggttttacaggggaatttacataattgcccttacaaaagggacatttacatgggtacacagcgtaattgtgatacaagggccaataatgggcgcctccttgaagctggactcgttatggcgaagtcaccctccttcagcatgcacccttcgccatttagtctttgcccaagattcctttggccttgtgggataccagcgcgatccttcgcccttcgccgcctttcttcacagtctttgccatgggggcttcgcccagatgaacttgacaccttgagctcgaatcctcgctggttgcatggtttcggcaggtctggtcgaagggtttcatgacataccactaacaagccccacacgggcaagggtgagataggagcttcgaccgagaccgtgaaaaccatgcggtatggtatgaggttggcggtatgtcatgagacccttctaccagactagctgaaaccatgcaaccagcgaggattcgagctcaaggcatcaagttcatctgggcaaagcacccactgcgaagtctgttaagcaaaaggcagcgaagggtgaaggatcgcgctggtatcccacaaggccaaaggcatcttgggcgaagactaaatggcgaagggtgcatgccgaaggagggtgacttcgccataacgagtccagcttaaaggaggcccaaggggccatcccagccgctcaagcccgttggcccttgggccaacattcgccaattggcccattataggcccatgtatcacaattacgctgtgtacctatgcaaatgtcccttttgtaagggcaaccatgtaaattctcctgtaaaacctaaaccctaatgggggaacctatgataggatcataaatagacccctagggccatgtaaaagggggatcccaagaaaaattccaaaattaatacacttcactgttcccaacaactgttgggtaaccacatccttcgacgtacgcagttgtcgcttcgacaacagctggcgccgaccgtggggatctctgagcgaaaccactgagagcgaatgccacagaagaaggttgcaaaggagaaggttgctaagcgaaaggagagtgaagcaggaggggaaatggccgtcgaagagggagcagagccttcggcgcccgtcgtcgaagctggtgcagcaccatcggcttcggcacctgcgccgcaaccaccaccttcggctcctgccgcttggacggggcaggcgccgaacacggttgatgcggcataggcagctgcggcggcgagggcgctctagaccagggcggagatcctttcgacaagccaactggtggcgccccaagccgcttcgccgcaaccggctacgacttcgaccacgctcgccgctgcacaagtcaaccccaaccttgaggcacaagccgaagcagacatggaggccatgcgccagaaaatgacgcaacttcaagacatgcttcgccaaatgcaagagcagcagcaggcatacgaagcagcaaggcaagccaaggtcgcttcggccccaattctccagtattcagcgggctacattccaccccaagtctacccgcaagcaccgattcaggcccttccgccacaagtcatgcaagcgccagcgtacttcgccgggtagccttcggccgcaacagtacacccgacccctcgtgtatagccacaagttcagccagtcgctgcccaagtacgccccccaccacctggtcaaatgtcacaagcaatggcggagggggcttcggccttgcaggcgcagcttcaagctttccttcagtaactcagccaaccccacaacacttcaggtacaaccccttcggcccaaccggaggggcaaacaagtcagggtgcacccagttggctactgtcgaaccagcctagtccgggggcttcgccatggagtcaaggaccacagttcaacctcagcaatgccattcaagcaccaaccactcgaccacaggtaacgacgctaggctgcggaacaaatcaagcgcagaaccaggtcgctatggcatggacccagcctccgttcgacccatccatggtggcacaccaagtgccaccgttcggagctgggcaaccgaatactgtggtccaacctcatgcgctagtcatgacttcgcccttcgccacgccatatccacaaccaaacgggccttcgcagcaaggtaccgtgagcaaggcggggggcgaaaaggggctaccattgagtgggggaatcaaaatttgtccaatctcaccccagttcaagttcccacccgttctgcggtactcgggcgaaacggacccaaaagagtttctgtccatctacgagtctgcaatcgaagccgctcacggagacgagaacaccaaggcaaaggtaatccatctcgctctagatggcatcgcccgttcttggtactacaatttacaagctaatagcatttactcatgggagcaattgcgcgatgtctttgtccttaactttcgaggcacctatgaggagtcgaagacgcagcaacatctactcggcattcgccagaggctgagggatcgataagggagtgcatgcgttgcttctcgcaatcccgatgccaagttcaggacataaccgaggtgtccgtcatcaacgccgcttcggcggggctgcttgaaggcaaactcacaagaaaaatctccaacaggagccgtagacactcgagcacctgcttcacatcattgacgggtacgcaagggacgaagaggattccaagcgacggcaagcaatccaagccgagtacgataaagccttcatcgccgctgctcaagcccaagtacaagcacaagtcgccgaaccggctcctctcgccattcaccaacctcagccagcgaaccaaggacaaccgccaaggccaagtcaagctcccatgacttggaggaaattcagaaccgaccgcgcgggcaaggccgtgaaggctgtcgaagaagttcaagcctccgcatggagttcgatggccaacaagcaggcagccatcaacagcccattcgcaagaaggtcagaaaatacctctactgcgccttccatggacgctcttcgcacaccaccgagcaatgccgaaacattcggcagcgtggcagcgcacaagatccaaggccacagcaaggagcagctgtcgaagcacctcgcgaagctgctcaagaacaagcacctcgggccgaatagcgccaagatgtgcaacgcaaagtaatccaagtgattacaagggccgatctaccagatcaaccgtcaaaacggcagaagaagatgcagctgcgaatggtgcacaacatcacttcgacaggcgaaggggctccgcggtatttgaaccagcagatctctttcgggccggacgatgccgaaggagtgctgttcccacatcaagaccccctgataatcttggccgagatagttggcttcgaagtccggcgaattttggtcgacggaggaagttcagccgatgtcataatcgccgaagcatatgccaggatggggttgccaaccctagccctcacccaagcaccaacctcgcttcaaggtttcggcggcgaagcagttcaagtcctgggccaagtacaactggcggtggctttcggcacaagcgacaacaggcgcgaagagcaaatactcttcgacgtcgtcgacatcccatacaactacaacaccatcttcggccgcgcaaccttgaacaagttcaaagccatctcccaccacaactatctcaagctcaagatgcctggtctggcaggcgtgatcatggtcaaggggctccaaccttcggctacatcaaagggcgatttggccgcaatcaacagagcagtgcacaatgttgaggccgaaccgcatgtccgggcaaagcacattccgaagcccgcctcccacggcaaggtgatcaaggtgcaggtcgacgatgccgatcccacaagatttgtttcgcttagaggcaacatgggcgaaaaggaagctgagagcatcctagaggtgctcaagaaaaacattgtcatcttcacctagggccccaacgaagtgggaggtgtttcgacagacctcatcatacatcatctggcggtcaaaccggatgccaagccaaggaaaaagaagctgcgcaagatgtccgctgatctccaagaggcagcaaaagccgaagtgtagaagttgctcaaagccgggttgatccaagagatcgaccatcccaagtggttggcgaatccggtactggtgcggaagtcgaacggcaaatggcgcatgtgtgtcgatttcacagacctcaacaaggcatgtccgaaagacgacttcctcctaccgcggatcgaccagctcgtggatttgacagctggctgtgaacttacgagctttttggatgcgtactccggctatcaccagatccacatgaatccagctgacatccccaagacagccttcatcacgccgttcggtactttttgccacctcaggatgcctttcggcctaaggaacgccggagcaaccttcgccagcctggtatacaaggtcctctacaagcagctggggcgaaatgtggagacctatgtcgacgatattgtcgtagaaagccacaaggctttcgaccatgcgtccgacatacaggaaaccttcgacaacatacgctcggcgggtatgttcgcgcgggcaaggttttgggttttcttatttctgaaaggggtatcgaggcaaaccccgagaaaatcgatgccattcagcaaatgaagcccccgtcgagcgtacgcgaagtacaaaagctcgcaggccgaattgcggcgctcagtcaattcctctcaaaggcagccgaatgaggtttgcccttcttcaagaccctccggggcgcgggaaagtttagctggacacctgaatgccaagcaccgttcgacgagctgaagcaatatatgcaaagcccacccgctttggtcagcccagcaccgggaagtgaactgctgctctgtctagcagcttcgccggtggcagtcagtgcagccctcgtccaagagagagtcaggccagaaacccgtgtatttcgtctccaaagctttgcaaggggcgaaattaagatacattgaaatggaaaatcttgcttacgccctagtgatggcttcgagcaagcttaaacactactttcaggcccacaaagtcactgtgccatcacagtatactttggccgaagtgctccggggcaaggaaattactggccggctcaacaagtgggtggcggaattatctcccttcgacctgcattttgtcgcccgcactgccatcaagtcccaagtcctagcagccttcgtggccaaatggacaccggcgttcgcctccgaaaccgagcccatcgaacaaccttgggtaatgtactctgacagctcgtggtcacacaagggggcgggcgccgtggcggtgctcacttcaccagggggcatgctgattcggtatgctgcaagactgcagttcgacacaaccaacaacacggcagagtacaaagctgtactgttgggcctaagaaaggcgaaagcattgggggttcggcgcttgctcatccgaacagactccaaacgggtggcaagccttcttgacaaatcttttgaggcaaaagaagaaggaatgaagaggtatctggaggctattcgatctatggaaaagtgtttcgccggcataacggtcgaacacctacctagaggccagaatgaagaagccgacgccctggcaaaatccgctgccagtggaggcccacattcaccaggcatcctcttcgaagtcttgtacgcaccaagtgtgcccacagagagcctggacatcatggcagtcgaccaggcagaactgggcgaagacccagaggactggcgaacaccgttcgtgaagtacctcaagaacggttggctcccagaggacgaagcagaagcgaagcgcctacagctcaaagccgcacgatacaagcttgtctctgggtagctgtatcgctccggtgtgctccaacccttgcttcgctacatctccttcgccgaaggtgaggatatggcaaaagaaatacaccaggggctgtgcggtgcgcatcaggcagcaagaacggtcgcttccaaagtgtttcgtcagggtgtgtattggcccaccgtgctgaaagtttgtgttgagcaagtcaagaagtgcgaaagctgtcagcagcatggctgaagccaaacagcaccccagtacgaacaacaacctatcgcaccagtctggcctttcgccagatggaggctagatatcattggccctttccccgtggcacgaaatgggtacaagtttgcagttgtagccactgaatacttctcccgttggatcgaggccgaaccactcagcgcgatcacttcggcagcagtacagaagtttgtgtggaagaacattgtttgccgtttcggagtgccaaaagaattcgtcactgacaacggcaagcaattcgattctgacaaattcggagaaatgtgcgaatggctaaacctagaaatcaagttcgcttcggtcacgcacccacagtgaaatggggcggccgaacgttcgaatggtaagatgcttgaagcgctcaggaaaaggcttgagggggagctgttgtcgaagcgacaactacgtacgtcgaaggacgtggttacccaacagttgttgggtacagtgaagtgtattaattttggaatttttcttgggatccccccttttacatggccctaggggtctatttatgatcttatcacaggttcccccattagggtttaggttttacagggaaatttacatggttacccttacgaaagggatatttacatgggtacacagcgtaattgtgatacatgggcctataatgggccaattggcgaacattggcccaagggccaatgggcttgagcggctgggatggcccctagggcctccttgaagctggactcgttatggagaagtcaccctccttcggcatgcacccttcgccatttagttttcgcccaagatgcctttggccttgtgggataccagcgcgatccttcgcccttcgccgcttttgcttcacagtcttcgccatgggggcttcgcccagatgaacttgatgccctgagcttgaatccttgctggttgcatggttttggcaggactggtcgaagggtctcatgacataccgccaacaagcccctcacgggcaagggtgagataagagcttcggccgagaccgtgcaaaccatgtggtatggtatgacgcgcccccttttcgaccgacgctcctgccgaaacctatactggagtcctgcggagaatgtgtgcactatgtgtacatgtgtttctagctttcgccttttgcaaacggcgaaacagtctttatttttctctgggccgaaatgaacagtgatgggcttcccttcgtgggcttatcattgtgtggcccgatcaatgagaatttaccgtttcgcataccct

SEQ ID NO: 42917 - DNA, 11850 bp, Oryza sativa
cggctcataattgtgtgggaaggcgaaccggcgtctgggtgggttatatataccccctttttcactaccgcccccgtcattttcaccgcgagctctctctttctccgccctcttgcttcgcggcgctcttgaatactagacctttcgcctgttcctcttttcgccaccgcacacactttttgccatggctcctcgcaagccgaacccagcctccgcgacaggccctgatcccggcagaatcgatgatgacaccaccgcctttctaggggcttcgcttgtggacgacgacgagttggcaaagctggtcacctccggcgcattggcagagaatcaggccttcgccccggggaaggtagtggtgccgaagcctggcgacaaaaggaaggtggtcttcgccgtgttgttcgaggcgggccttcaatttctgggcaacgtgttgttgccggagatccttcgcctttttcaggtggagctcccccaattgagcccaatggcaaacatccagatcgccatcttcgactgggcgtgccggaccgctgggttcgagccgagcaccgagctcttcgacaccattttttatgccaccgtgaattcaaagacggtggtcactccggcaggaacaaagaagacggcgttcgggagcgtgaacttcaatgttcgccccgagcgctccgatctttggaaggtcaatgccgctatgcctaaatgggatcaccattggatgttgaagtggttctaccacagcatcccctttgaggccgggtttgaggaggcgaaagccctccgatggcggcgcagggcgatcgcgccgaacaggaagcccaaggtcaccgtcgatggcgctatggaggcccgattcgccctgcttcgcaaggtctgctcccgccttagctgccgtgacctggtggaagaattttgtatgcttcgaatcttccccctctcccaatcatggcaagtcgaggtgaaccaagacgaggaggtcgatggcttgccgaagctggtcatgccggagggggcgaacggtatgccccatacattcctgtgctttgcctttttccctgttcggcatctgatatgataacacgtttcgtttttgcagtgttaacccttgcttaggccgacatcgaagcccggaagatgatcggtgatgtgttgatcgctgagttcggccagctgcttgatgcggcaggcggccggccgagcgaatcgggtgtatgacggtgatcttcctccccgagcgaagcccttcaaggccgatggcgatgaggggacatccaggaaacggacacacaggcaagtgaagttggctcctcggaagcgaagggcccctacctccaccgactccgatgcccacgacgaagacactgtcgaagatcatgacggcgaagaggagggggaggatgagggggagacagaggctacggccgaaaaggccgcggacgaggccaccaacaaccgcaccgagatgcgcggctacaccccaactccaagccccgaccatgtcaaaaccggggtagagtcgaacagctccccccaccgccgaaaggatttgaagggggcgaaggcgctggtttcgatcgcagcggccaaggtggcgaaggggtgtttggtcaagaaaacctccaagaagaaagggctcgtcgatgtcgctcgcgttttcagcgacgacgagtctttggacgagacccttacttcgcctgctggtcggagcctaggtatctcgaccattcctggtgctgcggtcgacgcgggcggagcgggtggtagcgttgctgtcgggacttcagcttctgctgatcgggttgtgaaggccgcggccagtctctacggcagccctgtgcgcaaactggtggcttcgccgctcgccatcgagaaggggaagaaaaaggccgccgaaacgtctgcttcagagtactctctagcggtgccccactttgcccctgctgatttcgatactcgggcagaccttgtccccttcgtcgagggggtaagtaatctcgtctctctggttggcagcccgagcctgttcaccgagctgaacgggttcgacgaaggctattctaccatcaagagcttggcagtccgggtatgtcgttcgtttttcttttccttttaatagtcatttttcgacaacttatattaacgatcacccttttcggccccccttttttcttgaactagattctcgcggcccattgttcgacggagagaaccatgcgtgctcatcttgacggcttcaagagccgtcttcgagccaaggacgatgaactgggccgcaagagcctggaaatggaaagcctcgccaacaccctcaaagagacgaaggcaaaaaatgagcggctccaagctgagctggagaaggggagcgaggcgaagaccaagattgagcgtctcaaggccgagctcaaaaaagaacaagatttttctgccgccttgactgagtactacaacctcactgagccaaagatggaggctcttcgccaggaggccctcaaggcgtaggcgaacgctgagaaagaggcgcaacggttcgcgcaggagatggcgaaagccaccgagtccgccaagaccgtgtgccatacgcttcgccttgcccttactgacatgggggcgagagtacgaggactccctggcaaagatgcttccgtcttcgacttcttggagtggactcaacaggccggcggtgcgatctcagattgcgccactgcgtacggcgattattgtgcgcgtgtgtcggcggccttcaccatgggcctgctgcagcagttcaggtgcgagcacatcgtcgagttccccaattttgcgaagggggactgggaggtcagttctcaggacgttttgcccgcacttcgtgcctagcgcaaacagttctagcaaaaggacggccgatctactgccaaggcgcgtctacttgagcacatggcgaaggcagaggcggcggactagggcgaagagcctgtcacaccctgaaaattcaaaatatataaattgttgtttaattggaatttttagaaataattttaaaagtcttgaaaagaaaatctaattttagttaataaatgccaatataaaaagtggccagataaaatttcattaaatactttgcttaattctataattcctagatttttctgggatttatttgagctaaggaagtattttaataaatggaattgcatttaagaaataatctaaattgaaaaaggttttaaaagtcttcttttggctttgggccgaaagtcggcccaaaacctctcttctctctctcttcggcccagccggcccagtccgccgccgcgcgcgcgcgtccgcccgctgacaggtggggcccacctgtcggacccgtcgtcaacctccggccgccgccgcccgaaaccctagtttcgcgccgccgccgttcctttccaaatccggccgttcctttccttctccggccgaattgtttgaggggaaacaatctccgggatctcctctaccttttctcctttggaatcatcggttaaatcgctttggaaagctttggaaatgagttcgattcggatcggttttctttctctccaagccgaggtttccttcgccgttgccgtcgccgtgggcctccgccgtcgcctccgagcccctttaaaaggatccccgtgctcttctcttctcgccgccaccctcgccttcgcctctcgtcgccggaagagacctagcgccgtgcgccctagctttgccgtcgccgccgccgctccagccgtgcgccgccgtcgttccagccgtcgccatcgctcgggaaggccgccgtcgtggtcgccgtcgcatcgccgtcctcgtccgccccttcgccgccgccgaagaccaccggagcatcgtcgccgtcgtcgatccgaagagccccgccgtttcctcctcgtcgccggcgccgtccgttgcttctccgtcgctcttttggtcgtcggtgagttcgccgtgccgcccgcttcgtcccggtgccttccgtttgcgttctcgcgccgccgttcgccggcgagcgtgcgccgcccgagccgtccgctccgccgagccgccgccgccgtcggtgacgtcatcgctgacgccatcggggtcgtccgccgtgaaccgccgtggacccgatcgatctcggccgtccatcttggatcggttagatctcggccgtccgttcgcgtgaaccgccgcccgtgcgcccggtccaccgaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacactaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattacttaattccttgataccttgggttattataatttgactagttgagctttatttatattggttcaactagatattagatataattgcttagccctgcttagaaacattagcacacttatgggataactaatgactcactattatttcatgatggcctattgatagttcacgatgatcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgaacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttccgctgcttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactatacatctattactgtactaatggctcatttaccagcaaaagttttataatactgttttatttaatcttgctgcaataaaataaatttagcatgttgattttataattttctttcatttctttagaaaccagttattcaaaattacaaaatttgtgacctcgtttccaactgttttaacttatctcgcaaagcttggtttactttatttgcttacctttttactctgattttctaactttattcaaattaatccaaaaacttgtgctattaattggataaaggtcttaactctctcctttcacttgtctttacatgccgcgttacaagcctgagtacctgtttggtgttgagggttttgtccaggagttgcgtacgatgtcctttgtcattcgatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgctaccacgaagcatttggttgagatgctgtgggctatggatgaaagtcgtgcggagactgtgttagcagctcaagatcgtgaagaccggaatcgtggtaagatttgcaagttagaagacaaggtggatcgtttagagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaacccaagatgatgaagacgagccgaacgagccttcaattgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttcccccgttttctcttcttgtgccctgtccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccacagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcacttccgcctgaataggattactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgtcgcgtgaaggttgtccctgtccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcctatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccttggggagctccagttatttttgtggaaaagaaagaccatacccaaaggatgtgtgtggactatcgtgcactaaatgatgtgactatcaagaataagtatccgctacccagaattgatgatttgtttgatcagcttaaaggtgccactgtattctccaagatagatcttcgatcagggtatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagtttgtggtggtctttattgatgacattcttatctattctcgaaccaaagaagagcatgaggaacatcttcgccttgcactagagaagctacgagaacatcaattgtatgctaagtttagcaagtgtgaattttggttgactgaagtgaagttccttggtcacgttatctcagcaggaggagttgccgtcgatcctagtaatgtggaatccgtaaccaactggaaacaaccaaagacagtttcagagattcgcagtttcctaggtctcgcaggatattaccggaggtttatagagaatttttccaagattgctaagcccatgacacgactgcttcagaaagatgtaaagtacaagtggtcggaagaatgtgagcggagttttcaagagttgaaaagtcgcttaatatcagctcctattttgattttgcctgatccaaagaagggttttcaagtgtattgcgatgcgtccaaacttgggttaggttgtgttctgatgcaagatgggaaggtggttgcctatgcctctcgacagttacgtccgcatgagaagaactaccctactcatgatattgagttagctgccgtcgttcatgcattgaagatttggcgtcattaccttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagcaaaggctattgcaatgctacagaaggtcgacagttgccattggaattatgcaaggaatttgaaagattaaatttggaaattgtcagtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttctgaaagaagctcatgatactttatactccattcaccctggtagtactaagatgtaccaggatctcaaggaaagattttggtgggcaagtatgaagcgtgaaatcgcagaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgattcttttgggtgatagtcgacagacttacaaaagtagctcatttcattccggtaaagacaacctattccggaagtcgcttggcggaattgtatatggcaaggattgtgtgtttgcatggcgtccctaagaagatagtgtctgatcgaggcagttagtttacttcaaatttttggaagaaacttcaggaagagatgggttctaagctgaactttagcactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggtttttgggacggatatcctaagggaagcagaagaaaaggtgaaaatcattcaagaaagattgcgtgtggctcagtctcgtcataagagttatgccgacaatcgccgcagagatttgagttttgaggaaggagattatgtgtatcttcgtgtcacgcctcttcgaggggttcatcgttttcacaccaaaggaaaattggcaccgcgttttgtgggaccttataagattgtcagtagaagaggagaagttgcttatcagttggagttacctcaatctttggcaggattccataatgtgttccatgtgtcgcaattaaaaaaatgtttaaggatacctaccgaagaagctaatattgagcagatagaagtccaagaggatttgacttatgttgagaaaccaatccgtatcttggaaacaaatgagagaagaaccaggaatcgagttatccgtttctgcaaagttcaatggagtaatcactcggaagaa

SEQ ID NO: 42918 - DNA, 3824 bp, Oryza sativa
atgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattagatgtagccttggtcaagctgcctgtggagtggagccgtctacgccgtttatttattttccgctacttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagagccagcggccggagagggtggaggagatgcccaagatcacccagaggtgtgaggccctccgcccgctctttagatttcgtagttttcttttggcgtttgccatggagggcgaacgatgtgaatttgggcgatggccctctccctttcgtattgtagccgaaaacggcatttttaatatatgaaatagatgacccaagtttagccaactattatgtttgatgcctttggtgcatatgcttgcattgtttcacatacgaaagggtgtttacccttttcgccaactttgtgtgttttgctgagtcttaactttgcgctttgccatttaccctttctatactgtcttagcagggtcttcgccgaaaattttgtgttcggccccccttgggaattggcgaagtaaaaacgagaagttcgtggcggtgaagggtttgccgaaggtccggtgtccgtttcagcctttttaccacgagatgataataaacggcaacagttacaatgttttgaaagttaccggctggatgcgggcgcaccccgggcgaaccctggacgactacgacagtgtccatgtggaacgtctagaggacatggttcgcttttggtgaaaccaccggaggacggatcgtcgggaagcgatcgcccagcgccgttatagtttagtttgtgtttcgcccccttctcctcttagggttgtgtataacattagtagtgatgacgaaccgagttcgccgaatcattccttagggagtggtgggtgttttgggggcgaagatgtaatttttttgtaagctaggctgtaaagcccgttactttctttcacctgtaccatgttgtatggcatgcactctttgatattttttgaagttaataaagatgtatttcatttcctttctgctattgttcgcatagtcacctttcgtgctttcgttaggtcgaaacatgtcggcccccttgcgtatattagcgaaataggtctgctaacatttcagctttcgacttccgctttcgatctgtggtattccgcgccaagagaagcgcttgcgttttttcacatgaatcgaatataacggtgttcggttatttacttcccgaaacaagctgtcgcggtttcaacgtttggcgagcgatgcttcggccgattcgtttcgcccccttagcgttttcgctgatcgggcatttgccttggggtttttccacgaactatcattcacacaagtaaaaaaagcgaaagacacaagaattttatattggttcgggcctccaggatggataatagtctgacatctagtttttttcttttttcattttcctctttttttgcatttttgtgccgaagggcttacataacgagaggtgccgaaagtcctatacaatagtatgtacatttttacaagttaacgaatgaggtgccaccccttctaaacatagaagcgcttaagagaagcagcgttccaggagtggtcgaactcttcgccttccagcgtcgccaagcgataggagcccgtcctggacctgtgcttgatgaggtatggtccttcccactttgattcaagcttcccgaccgccaccgggttcgccttctttcttaggacaaggtggccaggcaatagctctgtcggtcgaacttttttgttgtaagtcaccgaagtgcttgtggcttagttgcgcatgtgttctagcgcttcgactctcaccccttcgaggagttcaagtgacacctcgcgcccatcttcgcctccagagaacatcactcttggcgaattagcccctagctctgttggggtcattgcatcgtcaccatagagaagcatgaacgggctgaacttggttggccttgtgggggtcgtccgaagggcctagagaatagatagcatttcgttaggccatttacccttcgctgccccctcaagcattttcttgagcgcctcaaggatcttaccattcgcacgttcggccgccccatttgactgtgggtgagcgactgaagcgaacctgatttccaggtttagcccctcgcacatttctctgaatttgtcagaatcgaattgcttgccgttgttagtgatgaattcttttggcactctgaaacggcaaacaatgttcttccacacaaacttctatactgttgccgaagtgatcgcgccgagtggttcggcctcgatccaacgggagaagtattcaatggctacaattgcaaacttgtacccatttcatgccacagggaaagggccaatgatgtctagcccccatctggcgaaaggccagacaggtgcgataggttgcagttcgtactagggtgctgtttagcttcggctatgccgctgacagctttcgcacttcttgacttgctcaacacaaactttcagcacggtgggccaatacacaccctgacgaaacactttggaagcgaccgttcttgctgcctgatgtgcaccgcatagctcttggtgtatttcttttgccatatcctcacctttggcgaaggagatgcagcgaagcaagggttggagcacatcgaagcgatacagctgcccagagaccagcttgtatcttgcggctcggagctataggcgtgcttcgcttctgcttcgtcctccaggagccaatcgttcttgaggtacttcatgaacggtgttcgccagttctctgggtcttcgcccagttctgcctggtcgattgccatgatgtccaggctctctttgggcacacttggtgcgtacaagacttcgaagtggatgcctggcgaatgtgggcctccacaggcagcggatttcgccagggcgtcggcttcttcgttctggcctctaggtaggtgtaacgccccgattttcgttagggattaaaaatcattaaataatgcatttgacaaaaaataaataaaaatttaagcaatttaatcaagtgaaatagtgagggaattaaaattttctcccttaaaaatcattggccgaggatattttgtaatattctttgtgccctaaatattccccgaaattttcccgtgaattttcggagctaaagaagtaattttaacatcacaaagttcattgaatcaattaaataaaaagaaaaacaaattaaaaatcggttccccactacctcgtccacctcttcccccacttttccccaattttcggcgccgtttcgtgccccatctccacccacgttgagctccatgtcgccggccgttgccgcccaaattcaccactccccggcctccccgttgctccctcgcgctataaaaagcctccccgtgctttcctctttcgtttccccctcctcgccgagctcctcacgccctctcccatgctccccgcgcaccacctctctccgccgtcgccggcgagctccggccgcctctaaccgccactctcgccgccgccgcgctgcgccgccaccgctgtcggtcg

SEQ ID NO: 42919 - DNA, 3636 bp, Oryza sativa
agccggccgcccgcctcctttcacccggggtcgcagacaggtggggcccagctgtcgggcccgtcgcccacctcacgcccgcgccgccgcgccaacaaccgctgccgcgcccacgtcggccacgcccgtgcatgcgccgcgtctcccgcacccacttccccctctctcccgcccgcgccctccccactccccacgtcggccggcgaatcccgcccctaccggccacatccgagttccccctccccaatttaagctccgccgccaccccccctctctttttccccatctcgccgaactcactcatgctccccatcgctcccgcgccgtgcacccatccgtcgctgccgctcccgctactccagccaccgctagccgtcgctagactcgccgccgcaccgcaccgtcgccgccgtcgggttcgcgtggccaaggtccacaccgtccacacctcctccgtcgaggtccgtcgccggagcccgcatcccctcacactccggtgagcaccacctctaccgccgccttcggacatggtttccgctcgccgtggtccacccctctccctctaatctctctcttttcctctcttagggcatctcggagctcgtccgcccgccgccgttgtcctcccgtggctttccgtcgacgttcgccgtcgtcctcctccgcgccggccactctcggtgaggcattccccctcctctattcccctccctctccctcctagccgcgccgggttgagccgccgccccggtcgtgcgccgccacccttgccatggccggccggcctactttgtgccgagccgagccgagccaggtcgccgccgcaccgtccgatcggccccggcccgatgcgggcagtcgatcccgtggaccggaggtggaccaccagcgtggtcccggtccacggtagaccggccaccccgtgcgcctctgacatgtgggccccgcctgtcggcgccgaccccccctgatgacgtcagccctggggcttgttgttatagtaataaacacagagaatcttctaaaaatcataactaattcatccgagctccgtttaagcccgttcaagtctcagtaaatcaagaaaaatgtgtagaatccattaaaaatggttttgttctctgtttcagtagtcttatagccgatttggattgtttgctttgtatgtcgcttagattccggctctcccggcgctccggtgtacttcgaaatagtcgccgaggttcctccagtagcagagcaaggcaagtcatgcttgtcacttgaacatgttgatcctatattgcaaatgctctattgtttttcttcaaatactgcattggtttataatgttactatgggatgtttacctattgtcatagccatgctatttttgtaccatgttcctttgttagcttgggttataacatgagtagacactgggctagggactcgcttagccatgcttagttcaactagcccacaatgagggaaatcctattaatgtttagactgtaggttctaatggtaatgttggattagtgaccccgcttcggagttggttaactaaaataaatcacatggtggccggtgggagaatggctttgttggtcgcacccatggctattaaggaccggcgcgcgggatgccctgaaagtacttatcgtacttaccacaagccagcatgggcaacggctgggcttgtagtgtagctttcctctagctgacgcatccaggcaagggtgggcgtgatggagtttggatgggccatgcgacggcctatgcggcttccggattcacctaggcacgagagggggctgcccgctgccttgcgaggagtgggggtgaaacctgaggtgtggtgtgcttggttagagggggttatgcgaatggtcctgtcacggcctctttccggtatgttgtggtggcatgtcggtgcacggtaacgtgtcgtggggctgtgtcttgtgggtacagttgtacacctctgattagagtaaaactattcaaatagccgtacccgcggttatgggcggtcaaccagattcaccatgactagtctcaccctagtttagttttatgaagtggattagtgcaggtggatggttgggcctgttgcaacatggtgtagtgttggacagtggatggttaatattgattaattattacaactgttttactgctttcaactattgtttataaaggctcgttttatgcaaatgaatcgctctagctactctttgagtttatcctgcatcataccctccgttccggtatgacttgctgtcacatcctgatttttgtttcaggatttataaattatttaataaattattattagaatttatattaaatgttcattaatttacaaatgaagttaaatgtgggaaataaaatttcctaaatataaagcatggatggatttaatttttattaaattctccatggttaattatactctctggaatattctcggatttttcggagctcaattcctaattttaatcatacaaagagcatttcagtaattacccacatattaaattaatcattaaatggtctgattataattttgctaagtacttttagtgtccaagtattttcaggatttttcttgaaattatttgagcgttggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagccgagccgcccgccccctcctctctcaggcgccgacatgtggggcccacatgtcggttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctctcccgtgacccgtagagccgtcgccgcgtgaaaccatccgccgccgccgccggccgggttgcagccgcgccgagcagccttctccgccgtcgccgccgcttgccgccatcacctttaggtgcgccaagccgtggggaagctcggccgcccgttccccttcgccgccggccaccggagcccctccgccgccggtcaaccgagccgccgccgtcgcccctctcgttgccggtcgtcgtccgacgtcgtttgtcgttgtggtgagtaccgttgggttcgtctcgtcgtcctctacgtgtacatgccctcctttttcccggccgaccaccctagctcctgcgaggtcgccatctgagccggccgccacacatcatcatcttctccttttccagttttttctaatagatgaaatcttcggaaaatcataactaaataaccgtagatccgtttcaggtggttcaagttgctaaatttttctaaaatcaagatct

SEQ ID NO: 42920 - DNA, 3686 bp, Oryza sativa
ctctcgttgccggtcgtcgtccgacgtcgtttgtcgttgtggtgagtaccgttgggttcgtctcgtcgtcctctacgtgtacatgccctcctttttcccggccgaccaccctagctccggcgaggtcgccatctgagccggccgccatggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagcatgaaccttatatattggattggttcagctaaatgctatatgtatgtttgcttagctatgcttagaaacattagctaactaaaggggttaattataaactatattatattattcttattaattatggttatatttaatggtagctcacgatggttaatcatgtgatgttaattaattgataattaaaacctggttaaggtgggttgtgagcatatggttttgaaggtcgtgctcatggcaattaaggaccggttcgcgagctactgttgtgaaacatttaccgtgccaaccacaagccagcatgggcaatggctttatcttttgtatagcatggttcattatagtgtgccagactgtgaagtggcgagaagtccacgggggtcgctggggagtccatgccttgtttataagggggtgattatgatccgggaatggtgcactgttttgagttgtgttgtgcaaagggtattgtcacgatttccccctttgcaatgccgtggtggtattttggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgagtatggttgttcaggatggttgggcctgagcagcatgggtgtgctgttcagtgttgattaaaatttctgattaattactccactgttttacttctcttaaatgttttgctaaatgctgcttttgcaaatgagcctgtattatgccatcctttggtatccttgtgcacttgcatatttgctgtgtgccttgttgagtatgtcatatgctcattcttgcaataatcatcaaacctcagttgaagaaaaaggatccagaaggagaagacgtttagcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggttgattcctggacgaggattttatgcacaaataagttcggaaattactagtgaatttccgggcgtgacaagttggtatcagagccatctcgactgtaggataagccaaatggtcaaaccttaaggacaaatcttccgaaaacataatttgtgaaaatttctcctttcttccttatctagaattctttgcaaattgtttcattgtctactctcctctctcgttcaacttgagtagttctgaaactagttgttgaaactagaagatgttgatgaggtcaacttatggaggccagtaaagtggatcgaggaagaaccgaagtgcaagtggtcaagatggaatgaagtttggatcctatcttagaacctatgccgccaaactgtcctcgaagaatagttagtagggtagaacgtttgttgtttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttatctttagtgtaacccctctcctcctatcttctctaatctgcaacagatggtgaacactcgcgccagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaggccgcctaccttctctagcactaccaacccagtggaagcaggtgattggttgcacgctgttgagaagaagttggaattgctccagtgcacggatcagaagaaagttgttttcgcttcacatcagttgcaaggatctgcttcagaatggtgggatcacatccggatgaacagagcagaaggacaaccaatcacttgggcggagttcactgaggcattcaagaagacacacatacctgcaggtgttgttgctttgaagaaacgtgagtttagggctttgaagcaaaaggatcataccgtggcagagtatcttcatgagttcaatcgtctagctcgctatgctccagaagatgtgcgtactgacgaggaaaggcaggagaagttcttggaaggcttaaaggatgagctgtcagttatgttgatctctcatgactatgaggattttcaggagttggttgacaaagcaattcgactggaagacaagaagaacaggatggacaatcgtaagagaggaaggattgttttccaggaggcacaggatagtagccagaggcagcgtatcaagccactccaaattggtgaatctttttctactggtcaaggacagtcgcaacagttgaacatcggtggtgagatcaaatcagagactaatgaaagcaatgaagttaacatcgagcaagctaatcagccggtgccagttcagcaggatcagtctcaagagaataacagtagtggaagggagcagcaggtatgtttcaactgttacaagccaggtcactttgcaagagagtgtccgaagccgaagcatcagcagccgcaaggtcagatcaacaacattgttgtcacaggagctaatgcagtgccagttgcgtcttcaagagttgcgtcttcaagtgttacagctcagccaccagtttcaaagcagcagtagttttctttaaagccttagaataattatctgagttatggaataataagatagaatgcagtttacctatgcccttttctttctagccgttccgaatctcgggacgagattctttgtaaggggggtagatttgtcacatcctgatttttgtttcaggatttataaattatttaataaattattattagaatttatattaaatgttcattaatttacaaatga

SEQ ID NO: 42921 - DNA, 7219 bp, Oryza sativa
ggttgggagttagatctgtacagccgagtatggttgttcaggatggttgggcctgagcagcatgggtgtgctgttcagtgttgattaaaatttctgattaattactccactgttttacttctcttaaatgttttgctaaatgctgcttttgcaaatgagcctgtattatgccatcctttggtatccttgtgcacttgcatatttgctgtgtgccttgttgagtatgtcatatgctcattcttgcaataatcatcaaacctcagttgaagaaaaaggatccagaaggagaagacgtttggcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggttgattcctggacgaggattttatgcacaaataagttcggaaattactagtgaatttccgggcgtgatacttgctgagtacagtgggtagtactcagtcttgctctattttccccaaaccccagagtttgagtatgcgtcagatggtggtttctccgaggagtaggcttcgtccgtgccgtcgaggatgcctgtggagtggtgttctcgctgcagatcaagtcaaggcttagctccagttatctttcgtttttccgctgcatttatgtaagactttgacaatgtttgtaagacgtggatctgtatgtcaactttgtcgtctgtgtaccccggccggtcctggacggggattttaatgcacattctgcttggaattctattcgggaatttctgggcgtgacagctgcccagcgccgtcgttcggccggttggctttgtgccgtgccgtgccccagccgtgccgcccgtggcattggatcagctttgggccgatccgggccgtcagttcccgtggaccggcggtggaccgtctcggtggtcctggtccacggtggaccgacacccttgtcccgctgacgcgttgggcccgcctgtcggcgccgacgccccttgctgatatcagcgaatgccttttcctttgagaaaataattgataattgcatcataattcgataataattgtagaaatcaattaaaatggctcaaaacttctaaaattcatatctaattcattcgaactccgaattgagccattcaacttgcaaaattcatctaaaattgagcactacatgtttgtttactttttatgtactattttcttggtgtttattagagtttttcctcgttttgcgtgccagcgtgtagaatccgtcgtttcagaagtccgcggtcgcgaggaaaagagttcggaagatcaaagtgaagaagcaaggcaagtcacacattcccccttgagcatgttgatcctaatttacaaatgttttaccgtttgcaaataaacatgcatgtcttgctaattacatgggatccgggtattacctaactgcttgcttgtgctatgtttacttgatatctgtcctttgtcaaccttggataataaatcgactaactcatgttacttatgtgacctagcaagaactatatgcttagccatgcttaattaccacgtgttgtggggctatgtcttgtgggtacagttgtacacctctgatcagagtaaaactattcgaatagccgtgtccgcggttatgggcggtcgaccagattcactgtgattagtctcacacttaataaattgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgcgttccccttgcacgtctgcatcgttggtgtggcttgttgagtacggtgggtgaactcagccttgctattattcccccttttcagaagtgtagtgcttctgagctgaagacgaagttagaaaaccaaggctcagacccccagttgagttttacctttggaatggagctgaagccccgctaggatcgcatttttttccgctgctgtcgtttctttttggtgcgagcactaagagcctcttctgtaagtattgtacgctttatttacgtttggaattgtatattacttgtcgttttgtgtaccctggctggtcctgaacagggatttaatacacaaaatagtctagaaatttgggctaaatttctgggcgtgacagtaggtgttcaaccgttatgccggcgaaatactttttcatagatcaaacagcctctagatacctcttcattccttcgtcttttgcctcaaaagatttgtcaacttggcttgccaccagtttggagtctgttcggatgagcaagcgccgaacccccaatgctttcgcctttcttaggcccaacagtacagctttgtattttgccgtgttgttggttgtgtcgaactgcagtcttgcagcataccgaatcggcacgccccctagcgaagtgagcaccaccgcggcgaccgcccccttgtgtgaccacgagccgtcagagtacatacccaaggttattcgatgggctcggtttcgggggcgaacgccggtgtccattcggccacgaagtcagctaggacttgggacttgatggcagtgcgggcgacaaaatgcaggtcgaagggagataattccgccacccacttgctaagccagccagtaatttccttgccccggagcacttcgcccaaaggatactgtgatggcacagtgactttgtgggcctgaaagtagtgtttaagcttgcgcgaagccatcactagggcgtaagtaaacttttccatttcaatgtatcttaacttcgccccttgcaaagcttcggagatgaaatacacgggtttctggcctgactctgtctcttggacgagggctgcactgactgccaccggcgaagctgctagatagagcagcagttcgcttcccagtgctgggctgaccaaagtgggtgggctttgcggatattgctttacctcgtcgaacgctgcttggcattcgggtgtccagctaaactttcccgcgccccggagggtcttgaagaagggcaaacctctttcggctgcctttgagaggaatcgactgagcgccgcaatttggcctgcgagcttttgtacttcgcgtacgctcgatgggggcttcatttgctgaatggcatcgattttctcggggttcgcctcgatacccctttcagaaacaagaaaacccaacaacttacccgcgcgaacaccaaaaacacacttctcagggtttagtttcatacctgccacgcgtaagttgtcgaaggtttcctgtaagtcggacacatggtcgaaagccttgcggctttttacgacgatatcgtcgacataggcctccacatttcgccccagctgcttgtagaggaccttgtacaccagcctggcgaaggttgctccggcattccttaggccgaaaggcatcctgaggtggcaaaaagtaccgaacggcgtgatgaaggctgtcttcgggatgtgagctggattcatgtggatctggtgatagccggagtacgcatccaaaaagctcataagttcacagccagctgtcgaatccacgagctggtcgatccgcggtagggggaagtcgtctttcggacacgccttattgaggtccgtgaaatcgacacacatgcgccatttgccgttcgacttccgcaccagtaccggattcgccaaccactcgggatggtcgatctcttggatcaccccggttttgagcaacttctgcacttcggcttttgcggcctcttggcgatcaacggacatcttgcgcagcttctgtttccttggcttggcatccggtttgaccgccagataatgcatgatgaggtctgctgaaacacctcccacttcgtcggggccccaggcaaagatgtcaatgtttttcttgagcacctccaggatgttctcagcttccctttcgcccatgtcgcctccaagcgaaacaaatcttgtgggatcggcatcgtcgacctgcaccctgatcaccttgccgtggggggcgggcttcggcatgtgctttgctcggtcatgcggttcggcctcaacattgtgcactgctatgttgattgcggccaaatcgccctttgatgtagtcgaaggttggagccccttgaccatgatcacgcttgccggaccaggcatcttgagcttgagatagttgtggtggaagaagcttcgaacttgttcaaggttgcacggccgaagatggcgttgtagttgtatgggatgttgacaacgtcgaagagtatttgctcttcgtgcctattgtcgcttgtgccgaaagccaccgccagttgtacttggcccaggacttgaactgcttcgccgccgaaacttcgaagcgaggttggtgcttgggtgagagctagggttggcaaccccatcctggcatatgcttcggcgattatgacaacggccgaacttcctccgtcgaccagaattcgccggacttcgaagcagctctctcggccgagattaccagggggtcttcatgtgggaacagcactccttcggcatcgtccggcccgaaagagatctgctggttcaaataccacggagccccttcgcaaaccgaggtgatgttgtgcaccgttcgcaactgcatcttcttctgccgttttgacagttgatctggcggatcggcccttgtaatcacatggattactctgcgctgcacgtcttggtgctattcggccggtggtgcttgttcttgagtagcttcgcgaggttcttcgacagttgttccttgctgtggccttggatcttgtgcgctgccacgctgccgaatgttttggcattgctcggtggtgtgcaaagagcgtccatggaaggcgcagtagaggtcttttctgaccttcctacgaacgggatattgatggctgccagcttgttgggcgtcgaactccttgcggagggcttgaacttcttcgacagccatcacggccttgcctgcgcggtcggttctgaattttctccaagtcatgggagattgacttggccttggcggttgtccttggttcgccggctgagattggcgaatggcgagaggagccggttcggcgacttgtgcttgtacttgggcttgagcagcggcgatgaaggctttatcgtactcggcttggattgcttgccatcgcttgtaatcctcttcgccccttgcgtacccgtcaatgatgcgaagcaggtgctcgagtgtctgtggctcctgttggcgatttttcttgtgagttcgccttcgagcagccccgccgaagcggcgttgatgacgggcgcctcggttatgtcctgaacttgccattgggattacgagaagcgacgtatgtactcccttatcgatccctcggcctctagcgaatgccgagtagatgttgctgcgtcttcgactcctcataggtgcctcgaaagttaaggacaaagacatcacgcaattgctcccatgagtaaatgctattagctggtaaattgaagtaccaagaacgggcgatgccatctagagcgagatggattacctttgccttggtgttctcatcgctatgagcggcttcgattgcggactcgtagatggatagaaactcttttgggtccgtttcgcccgagtaccacggaacagatgggaacttgaactggggtgggattggacgaattttgattcccccactcagcggtagccccttttcgccccccgccttgctcacggtaccttgctgcgaaggcccgtttggctgtggatatgtcgtggcgaagagcgaagtcatggcttgcgtgtgaggttggaccacagtatccggttgcctggctccgaatggtggcgcttggtgtgccgccatggatgggtcgaacggaggctgggtccatgccatagcgacctggttcagcgcttgatttgttccgcagcctggcgtcgttgcctgtggtcgagtggttggtgcttaaatggcgttgctgaggtcgaactgcggtccttgactctatggcgaagctgccggaccaggctggttcgacagtagccaactgggcgcaccctgacttgtgtgcccctccggttgggccgaagaggttgtacctgaagtgttgtggggttggctgagttgctgaaggaaagcttgaagctgcgcctgcaaggccgaagccctctcagctattgcttgtgacatttaaccaggtgatgggggcgtgcttgggtagcgaccggctgaacatgtggctgtacacgaggggtcgggtgtactgttgcggccgaaggctgcccggcgaagtacgctggcgcttgcatgacttgtggcagaagagcttaggggtagacttggggtggaatgtagcccgttgaatactagagaattggggccgaagcgaccttggcttgccttgctgcctcgtatgcctactgctgctcttgcatttgacgaagcatgtcttgaagtcgtgtcatgttctggcgcatggcctccatgtctgcttcggcttgtgcctcaaggttggggttgacttgtgcagcggcgagcgcggtcgaagtcgtagccggttacggcgaagcggcttggggcgccaccagttggcttgtcgaaaggatctccgccctggtctggagcgccctcgccgccacagctgcctttgctgcatcaaccgtgttcggcgcctgccccgtcaaagcggcaggagccgaaggtggtggttgcggcataggtgccgaagccgatggtgccacaccagcttcgacgacgggcgccgaaggctctgctccctcttcggcggccatttcccctcctgcttcactgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataaaataaacggcgcagacggctccactccacaggcagcttgaccaaggctacacctaatcctccactccatcagcctcattgtagaactcttcctctgctgaatgattgcaaggtgagtatatgacatactcagcaagcc

SEQ ID NO: 42922 - DNA, 725 bp, Oryza sativa
ctcgcttcaaagcttcatcatgtctgttcacaaagtagtcattgcacttcatgaacgtaaatgatacaaatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcttcatgcaccaccggtggtgaaccgatggcaatcctggaataggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtacaggcctacaatgcttaaaagcctcaatggaaggaccaaagcaccagaatgcacgcataaaaattttcttggtcactccatcaat

SEQ ID NO: 42923 - DNA, 1246 bp, Oryza sativa
agggcgcgggcgggagagagggggaagtgggtgcgggagacgcggcgcatgcacgggcgtggccgacgtgggcgcggcagcggttgttggcgcggcggcgcgggcgtgaggtgggcgacgggcccgacagctgggccccacctgtcggcgaccccgggtgagaggaggcgggcggccggctcgcgcgggcttagctgggcctcggccttcggccggcccagtgggaggagggggaagaaaaagaagaatgggccggcggcccatttcaaaggaaaaagagaaaagaaaaagaaagaaaaaggaaaaagaaggaaaaaggattttcctgggattaaatattgcttgtggtcatttttaattggttaaaattatttcgagagatctgaaaattccactaaaaatcttgttagcgtatttcgacatgtagaactcaagaaaaattccacatgccaaatccgattaccattcgcattaatttattagggtttactcttgctttacactggtattttcttgagaccatttataacttcaatttaggcttgggaaagaacttcggggtgtgacagcagcgcacagccaccggaggcgcggaacgacggcaagcggccgagaggcggcagctagcaaggaaggggatgggaaaggaagaagggaggagggatcctcaccggaagcggcagctggtatggaggaagacaacggcgacggcgattcgaccgcttccaacgaaggaggaggggaggccgaggggcggctacacctggggaagcgattggagggattagggaaaagggaggaggcgtgagtatggccggccgaagaggaaaaagaaagaagatactcaccggcgacgggaaaacatgttttggcggggttccggcggtgaaaaacagcaaccgaggtgctcctcagcgctacgaagcgagtgacgaaggcggcgcggtgcgcggctggaggctacaggcggtggtggagctcgggttgatgggggaagcagtgctacggcgatgttttggggaaaggaggggttgccggggtggagcgcggcgttgcgaagctagcagcgcaagcggcaggacgcgacggcgacggaagcggcggtggctgtccggctggagtcggcaacggtggtggagagaggtggtgcacgtggtggcagcgtttcggggtgaaagggggaaaaaggagtggaggctggggtggagttcggcacggcgaccgacagcggtggcggcgcagcgcg

SEQ ID NO: 42924 - DNA, 5367 bp, Oryza sativa
atcagtaaaaatccacacaaagaaatattgcattggagtccggccagaggagatgctccatgacatggcttcaccaaggcatgctctgtgccgattacttgtgccagccattgggatcttcttttttttttttaaggaacacgacggcagaagctgtgccggaatttaattagaaggagagaaaagtgcttacagtccagagaaaaacattaacaaaccctcaagggggcctaaaagccgatctacagagatccaggtcttgctttacaatatatgccacttccatctccgagcttgtgttattattgaagattctcttgtttctctttagccaaacattccaccaagtagtaagcagtgctcctctcaccgccttcttttgatccttcaaaccaacacaatcaatttcagaccaccactttgatgttccaactggaggatcgacattgttcagtgtcaaattttgccaggcacagacaaggttccacacttgtctgacaaaagggcattcgctaaacaaatggttagtgtcttcaaaggcgcttgtgcacaaacaacatatccaattgcacggctagtgtcttcgaagtagattttgtgcagtaagtgttttctcatgatgaacgagccaaccaaaaaaatcttgtttttggtttagccggtgccttccaaagcgaggtaaaatctgtggaagcaaaggatccttgaaattggtaaagataggcgcttttgcttgtgtaagtccctgatttgttccagttccatgagatatcatcagggctcagtgagagctggactccctgaagcatactccccaggcgcactagttcatatagcttttccactgtggttatttgtctgaaggagacaatccagttattgtttaggatctccagttgaacacttctttgctttctctttgccagcttaaagcacaatggtgcaatgtcttttgggcagccattttggagccaactatcatgccagaaacttgttttagctcctttacccaactcaattgtcatcgctgcttgaaacaaccttttgtcagattcgtcacagggaacgctcatacctgcctaaggttttccttcatccttcaaactgaaccataaccattgaagacaaagagctctcgaaaatctctctaaatctggaaggtctagacctcccaaagattggggtttgcacaccgtttgccagttgactaaactactgcccgggttagcttagtcaagatcttcacctttccaaaggaaggatctatgaaagcaatcaattctttttatcacccatttaggcgcatgaagagctgtaaggtggtgagcgggcattgagctcaagactgattgaaccagagtcttgcgtccagtcgaggtgaaaaatattcctttccaaccaggtatttgtgatccaatttttccgatcaagggaaggaaatcgatttttcttagctttcagtagtggaggggtaaaccgaggtagcggcaggggaactgttttatcatgcttgggaaattcgcgagaagagaaacgaggtttatttcttcacacctgatcgggtagatctttgttttgctgacatttgtgtgaagacccgagacttgtgcgaaaaagactaagagctgcacaagcatcgataaatcaataggctgaggtttcacgaatactgcaacatcatccgcatacagagagcacctgaacctgtcaaatctcccaccaaccggagagagaaaggatgcattttcagttgctttcagaatccgatggaaaggttccatggttagaataaacaacatgggcgatagcggatcaccttgtcaaagaccccagacatggtttgctgtttgacccggggagccattgagcagcacttgagatgatgaggttgctagcaggttccaaagccaaaatgatgaaggacatcaaggagatatggctagcacacagtgtcaaaggctttagcaatgtcaactttgatgaacagactctgttttttcgttctatgcaagatctgcaccatattttggacatagaggaaattatcgcggatgtcccttttgcggatgaaggcactttgattaggagaaacaagctcgcatagccttggcgctaatctgtttgccattaatttagagattgtcttggagaagctgtgaattagacttatgggatggtaatgttcagctcccgaagcatcttctttcttgaggagacaaatgaaagctgagtttagatcatgtagttgcgaggtgtttaggttaaagaaggatgttactgttgttaggaggtcctccttgattatctcccaggctgccttgaagaacaccccaataaaaccatctggccccagtgccttctcaggtggcatggagaaaacagtcaccttaagctcttcttccgttatatcatcttccagctgtgcaagatccagtgtttccttcatattccaattgattcctgaccttctttgaaaacatgttccaagtctctccttgaggaaacggaacaattccccttctttatcttgggttgaaattgctatcccggaaggtgtatgcagcgattgaatgaagttctttcttctcctggagttgactttaatgtgaaagaattttgagttgacatctccctccttaagccatgtttgcctagagcgctgcctaatctgaattttgtttaggactaagagagccaaaattttgttttgagattagagatcaaaagacgctcttcattggacaaggtcctggtttcctgtgctacctctagttggaatatcacttcggatgcaacagcaagttgtaacttgatatctccaacttgattacggctccatctcttaatgtcgcgggcaagacgtcgtagtttcaagcggaaattggctaggctgtttgtggcgagaattggcctttgccaagaatcctgcacaatccccagaaacctaggaattttaagccatcaggattcaaatctgaaatttggaaatttcgttcttttctcatttccaactaaaaggagaggtgcatggtcagagcacgcagaagacagtggatataagttggacccatcaaacattaaatcccagtcagtggtaacgaaagcatggtcaatcttagtttgtgttggatttgcgccttgtcctgcccaggagaaacggcggccaggaagattcaattccttcacccggattttgtctaagaggccacggaaatgctgcatcattcttctattgaggcggtcatttgtttttatctgaagctttatagatgaggttaaaatcaccaataatcaaccaagccggtttcatggagggttgtaagctttcgagttcagagagaaaggcaattttatcggcttccaattgaggcccatacacaacagtgatggaccactgcagaccctcctctcgcatggtcacagttgcagagacagagaattggcccaggacaacatcagagatacagaaaaagttttcattgcatgcaagaagcacaccgcccctgttggcaaaactcaggatcaaactacacacgaatccctggaaattgacaatgcttgatgttgaacagtggaagagaagaacacacgcgagaagtttttgtgccgccaaacttacgcagcttttctgtgtatttcatcaccatttatacaaagtgaaaacgagatcatgcgatcgtgtagatcatgtctccgactctgtgcactcccacgaactccatttgcgcatgtgccatcccacacggcgaagaacgtgagcgtacgactcgctacactacgcctcatcgtgaacaagcacgattccggctttacaagcgcagctcgatccttaacaaccaagcctcaaaaaacggaaataaaatagactctaacaaacaccttgcatgcaacgaacagtgcacggtgtggtgaggaagaaacagagctccatagcgccagcttatatcatcaagtctaacattctccccctaagcttggcgccttggactgacctcgacgacgccgatacgaggtcgcaattcttgaaaacaaacccgcccgagtgccttggtcagaatgtcagcaaccttcccatcggtgccaatgaactcaacctgagctctcccgtcctccacgcactcatggatgaagtggtagcatgtggcgatgtgtttactccggtcatgaaacactggatttttgctgagggtgattgccgacttattgtcaacgagaagcttgaagctttgtggctcctcttgttcgatttctctcagcagctgcgccagccagattccctgacacgccgccgtcatcgccactatgtactccgcctcacaagacgagagcgcgacaaccttttgcttgatggactgccaactgaccgggttggcgcccaggaagaagacgaccccgctggtgcttttgcgagtgtcgacattgcctgccatgtctgcgtcacagtacccgacaagctcaggtggcatctccatcctattgtagtagcagccgaaatcaaccgtgccggcaacgtaacacaagatgcgtttcaccgccacgtcatgctcggtggttggaacttccatgaagcggctcacgtacccaacaaagaacgcgaggtccagccgcgtgtgaaccagataccgcaggcagccgacgatgctgcggtactgggtggcgtccaccatcgctgctgtgctcgccttggtcaacttgagatgaggctccataggcgtcgagcaggaattacatccctgcatcccggctcgctcaagtatgcattgtgcatacaatttctgcaacagtcgaacgccgtccgccacctgttcgacctcaatccccaagtagaacgagaggggaccaagatcgctcatcttaaacagggacatcatctccgctttgaaacggtcgatctccatcactacgttgccggtgatgatcaagtcgtcgacgtacacgccaaccagcagtcggctgtcgccactgccccgcccgtagaccgtgtgctcgcagtcattgcgccggaagcccagcgacagcaggctcgtgtccagcttcgcgttccatgcgtgccgagcctgccgaagaccgtacaaggccttgtccaagcgaagcacttggtgttcacgtccgtccacaatgaaacccgggaggttgcttgacgtagacctcctcggtgagctccccattgaggaatgccgacttgacgtccatgtggtggacaggccagcctgcctgcgctgcccgcgcgagcagcattctcatcgactccagccgtgccactggagcaaacacctcgtcgaagtccacccccggctactgcatgtatcccttcgccacaagacgagccttgtgcttggtgatcatgccgcgcgcatccttcttgat

SEQ ID NO: 42925 - DNA, 19832 bp, Oryza sativa
  unsure (1)..(19832): unsure at all n locations
gctgacgaatctcggtgacctcgcattgggcagcgaggccgtcggtgacatagcgtcgtgcgcaaccgcgccatgtctcggtgtggccggtgtcggcatggatgactccgcacgttccggctcctgtgtgacaatgtattcaacagagaagtcagacatgggacgggaatgcataccatctgtggcatcccaatcccagctagcgcccttgttgaacacaacgtcacgcgtcacttgaacgcgacccgacttcgggtcgaacaccttgtaggctttagttccctcaacgtagccgaggaagaccatgggcttgccgcgttcctggagcttggtgatgtgtggctgaacgtccttgagtacacgagacacccgaaggtgcgtaggtgaccgacggccggcttgcgacctaaccaagcctcatagggtgtcttgtccaccaggcacttggtcggcgcgtgattgagcaaaaagacaaccgtcatgactgcctccccccaatagcatgccggcactgacttggcccttagcagacactgtgccatcgccaagatcgtttggttgcgacgctcgaccacaccgttttgctggggggaatacggcggggtgagctggcgcttgacaccgctctcggtgcagtagctggcgaactcggcggaggtgaactcacccccgttgtcggggtggaggagcttgagatggcagccggactcagcctcgctgcgggcttgaaagtgcttgattgccgcagccgcctcccccttgttctgtagaagagtgagccacatatagcagcttgcatcgtcgacaagcagcagaaagtgtttcttgccgccgggcgtcgcgggcgagatgggaccgcaaagatcgccatgaatgagctccaagcggtcctcctcccggaacagagactgcccggggaacggcgaacgtcgttgcttggagatgacgcagcagtcgcacagctgctcaacttggtcgatctgtggaaggccgcgaaccatgtcttgttgagtgaggcgccgtagcgcgtcgaagtggaggtggccgaagcgagcatgccacagccacgcggcctcctgcgtgcgtgctgagaggcacacaggccgagcgacggtgatcttgatcaggtacagccgaatacgcgtacaccgcacgcgagcgaggagctgtcgcgcagcgtcgcggatcgtgcagacgccatggaagatgcagatgtcgcagccattttcatccagctgcctgaggctgacgaggttcgcgttgagcttggggatgtagtacacccctatgagcgcccgatgttcactgttcctgcactcaaagatgattttgccttggccctcaatggcgaccaccgagccgtcgccaaaacagaccttgccgcgcaccaccgtgtcgagctcggagaagatgtcatgcacgccagtcatgtggttagtcgcgccggtgtcgagatgccaaacaccagcgtcgacatcgcagtgcaggtgtgtgaacaccttgggctcaacgaggttgagcggttcagttgaaggtgggagcgatggtggaggtggcgccagctcaaccgcgtgagccatcagcagcgccagctcatcatcttcctcctcaccttgtgcgacgtgtgccgcgacttgtttcttgggctggcagcagtccttcgcccagtgaccgaggcggccacagttcttgcacttgtcacgcccttgatcgcgcgtgtaacgcgcaccgcgctcgccatcggcagtgccctcggttttctttcgcccatcgcggtgtcggcggttgttacccgccttcttgcgcgacgatccctcgccggactgccgttccttggcgcgagcggcccattgttcttccgtgatatacagtttgtcgccctcatcgccggacttcttcttgggacggcgctcctcggcgttcctcagacgccccgtcagcttctcgagcgacagggtatcaaggtcgagcagtctcgatggacaaggcaatctgctcaagatgttcaggaacaacatgaagaaatttttcatggacctttgattcctcaagctggatcccaagtacggcaaggttgttgacaagcccactcagccggacggagaattcctccacggactccccttccttgaactcgatcgcattgaactgcttgcgcagctcctgcgctttcgacttgcggacgcggtcgacgccgacgcgcatcgtcttgatggcatcccaggcgtctttcgccgtctccttgacagagagcaccggcagcagatcagcggggaccaccttgaggacggcctccaacgccatcctgtcctcctggaagttgacgtcacccgtgtcgacagcttcccagaggccacgcacctggagcatcgccctcatcaagagggaccaatcactgtagttcgtcttcgtgaggatcgaatagttggctgagccccccacctccttgaccacgcgcctgactggacccaagtgccaggcgtcgccaggccgacgacgaccacggcgcagaggaggcgagcgggattgatgacgcggcgatcgcgagactcgcggcgtcggagccgacatggctctgataccagatgttggcaaaactcaggatcaaactacacacgaacccttggaaatcgacaatgcttgacgatgaacagtggaagagaagaacacacgcgagaagtttttgtgccgccaaacttatgcagcttttccgtgtatttcatcaccatctattctattatatactaaaagtccatgaaacttcctataaacactcctaagtcgccacgtggcatcctagaaacactcctaacccgacacgtggcactctaacaaataaccgttgattttcattaaatttggtggacccattatttacaaccattagatttatcttaaacacccaatcttgggcccacctagcatgtacaaacgtgcgtacgtacgtagatgtcacgtacgactaactattatatatgaaaaaaaatatatatctcagatattattatttttattatgttgtgatatgttatccgtagcgcacatatatcatgtgtctccccttctctctactttctattttatagcaagcaattcaaggtaaacatgatgagtctgatttaatttatagttaagcaaataattttagatcaataaaatccaaacatttctaagtaaaatgcagaacctcatataattgatttacacttaaaccgttgagcctattatttttgacgattagattaggatttttaaactaattaatccttcacggctaatctctgccctaatttaagattaaaaaataaaaaagttgtgaaaaaaagcaaaatatcacaccaacaatttacacttaaatcgatgaacctattatttttaaccattataaatttaactaatcattctgtcctaatctcataggtacttacctaattatgatatttgattcatatttcacccgtcttcctagattaactcttccttctcatatttttatgctttattagttagaaagcaaaatcttctattatatactaaaagtccattatatttcttataaacactcctaaatcaccatgtgacatcatataaatgcttctaaaccgccacatggcgttctaataaaccggtggacccactatttgtttaataaatcgttagatccactattttcaactattatatttatctttataaaataagaacaaaacaataaagatgacaatatatattataaagtaaatttcacacacctacatagatatatctatctattacatactaaaagcactcttgaactgccacgtgatattcctagaaacgctcctaagatgacatagaacgctctaattaattcctagaaaagctatgtaaaaaaggagaacatctaactattggttttatttaatctggtgaatctaatttttttaccatcaaataccgttagatttatctttaggaaaaaaaactaaacatcaatctggcggtacgagtccgcccaacgcacgtacgtgcttccatccacacatatgagaagagtatgcgtgctttttccttgctcacttccctttttttctctaaggtaattaagttagcttaagggtatctaatatcttatatattagtaacttaatttcatcacactccaaagactgcatgcacttgcaaatatagacatagataatatccctcatacatattgatcttgcgatgttttataaataaataaaaaaattcttcaatagctgtaaattttaaattatatattcaatttatgatctgtttgaaccattgtattttttagttaatcaatagtttaaaatctataccaactatatttaattgctaataaaattattgtattatggacccacatccatatgaaaaaaatcctaagagttctcattaaaaatcaaaatatccacctttttctgataaaatcaatggacccatacctataaaccattaaccttaattatagcatcaatggaccttttgactctcaaccaacttaattatatctctcaacatgaacgttcgcgatgcttttataaagatatgatattctttaacatgtatgtggaggctatttacttaatcgcgatgcttttataaagatatgatattcttttaaggataaatgcacgagatgttgtgctgtgttcggtgtcgagtgttggaaaaccttaatcccttggtagtcggacattaactcatagcccaaaatacctatatcacagaattatcgggaatgctatctcacgttgctcaaatccaactaatacaccaagaaaagaagaaggggagagggggtctgtagagttgtccttacggatattctactaataaaaattgatttcacatacttatttgtgcttattaaattatctaatcactagaacaaagcaacatactgtccatggagtgaacaaattggagagctagccggtgcatcccggtgtgcatgcatgttgggtgtagaatatttttctcagataaaaagaggggcataagatagttacatgtattatgcatatacatgtagggcatgttttttttttcttcttggtatgatgatgcgagcatgccgccggagggacgaattaacatatccaccgtctgtggtgagggaagacgaataatttggttagttggaccgtgcacaatatgttagatcatatgaatatccaatggttagaaataatggtctaccaaaccaagtaaaagttgagggtatcctgtgcacaatattttattttttctcataacttttactattttatctaatttgtatcactatactggacacatattcttaatttcctatgagtaattatccatagctatgaccaatcgatgtatgccatcaaataataaattaattatcaattttctgttaattatatatgcttatatatgtaatgtctttataacttaagttttctctctttccctatgaaacttcaagagtcatatctcttaggtatcataagttgctaaccctaatctccagtaggtaattttatatataacaattaaattcatcatgcaatactaacgaagaaaattcatgaaaaaaaaaccacaattttgaaacgttgtagaaattatttcgctggtataccgccgttataagtttctcaaatttatcctacgtatggtacatgcccgcgcgaatgcgcgggctacctttctagtttatacaaagcgaaaacgagatcatgcgatcatgtagatcgtgtctccgactctgtgcactcccatgaagtccatttgcgcatgtgccatcccacacggcgaagaacgtgagcgtacgactcgctacactacgcctcatcgtgaacacgcacgattccggctttacaggacgcagctcgatccttaacaaccaagcctcaaaaaacggaaataaaacagactctaacaaacaccttgcatgcaacgaacagtgcacggtatggtgaggaagaaacagagctcctgaaacagtgctccatagcgccagcttatatcatcaagtctaacagcccctagtgccatcagccggcagggcaacatagtgtcgcacaaatctttgacccaaagtgttaagaataatacgattattgatggaagcaatcttagtttcctgaagacagacaagagtggcaccatattgttgcaaaataactttcactgcatcttgcttcgccttggaattcagaacccttacattccagttaaacaagtaaacattgtcttgtgacatgggcacagaagctgctgcaactactactctagttgatggtgaaagtaacaaggcctttcttgaaacacaaccagcaaagctgggagaagcacaggcagaggaagacaaaacatctttgactggaactaacatgcagagatgacagtaggaagacaagctaatttgatgaggggtgggactcttcatggccaatgcagggtacttcttcaggatgcagcgcgctcacaggggcgcgatcgctgccttctttcttgctgccttcaggcggatgctcttgcatcctcccttctccgccagctcagtgattgtcttcaagaaggagggggacaacggtttcttgtagcgctgcaagtaaatctttttgatgttatcatcaaaggaagcatgatcatcaattataccaaacttttttgacatgatctcttgagcaaaagtttcaagttttgctcccgcccgcctcatgccaagcaggcgttcgctatgacattgtgccgaggaaattgcaggtattgtcactttcacgtggcttggatggcgagcatttgcgtccagagcaggcaggagcggcggctgaagcggaatcgagagggtgtcaatgaactcttccacattgttcacctggcttaccagcaatgcagcttgagcttgattgttcacctgtcctgccaccgacgccccatgaacttgagtcacctgttctgcaaaagaggaaaatacgaaaacaggggaaacagcacggagggaatttgtgtccggcgagtagatggagtactgcaccgccgcctcgtgcagcattgggtcaaggtggctctccgggagggtaagaacatcctcctgcccctgcgaacagaagcagttgtcagcttgaagaacagcctggtccgggatggcaaggttgacggagaaggtagcagtggcgtccccgtccgggctcggtttgcggaccgagcttggttgcttgcatggagaggcaagccgattgggagagggtagaagggtgtctgaggcaggattgttctgagaggtgaaggatgaagagagaggtggtctcaccttgcttggctctcgggaacggccgcttctgctacgtggatcagagcgctcccggttgcgcgagcgccccctggccatctctcctttctggctccctgctgtgacttgaggacaggcgcccgagccaatcccacacagagcggctcttgtgacgactcctgcgctgcctgtccctgtccttgtcttcatcatcatctgttggcccctgcatgcttgtgtcttcaaccctcggcgcttgcagaaaattctggactctaatttgcattaaaaactaacaacacgcatgcatgtatataattaatcatcaaaaccatatagttaatagccaaacaactttaaaccatttgttttctattcggctaattactcaattaataaccaaattaaacctatattttagatttggctatcaacccaaacttttaaattatatgaaaaagatttttagtttgcctttttcttaaataaaatgagggtactacaagtacaataccttgggaggtatatatataatccttctggcctttgtaatcttgcagtggaagcaacaaggatagttcgatcgagttgtatcgcgaaacgggaagaaaacaaaagagaagaaggaaaacgaggccagaaccaaattaaaccaatagcaaagcatcaacgtattcacgatgccttgcgaatgaagacacttgtgaacaatatatctgtgctgctttaatttcccatcgagaatttgttcgtttctttcttccttctgcattacgttgattctttcttggcagcaattttaatcctgtcttgccctactaacactagatagtcaaaatctattatccctttttaattttcttcttacaaaacaaaacgtatattcacccatccctcttcccgatcgacactccattcctctgctgcaccaacactccatcccttctctcccttgcttcttccctcttcctcttggaggagtcatggatacttcatcctctcattctcctactcctcttgtatatatattcactctgaggcaacctctgcaggggcaggaaaatatactgcatcctttggctgctgcacagtgagacaacaaggcatcttccacctaggagtgtgtggcaatagtgactagcatgccgtcatcgctgaaatcgctgcttccgggtgggaaaggtgatcatctttatccttttgcacagtgtggtcccatctctctcccctaagacccctctaaaacatatgttgcatacttcttcacagatgacaagaggaggaccctaatgcaccaggtctccacacttggggagagggtgtcggagttggagaacaaaaatgcccagctgcttgacgagaagggtaaagtggagaagcaattggaggagacaaagcaggaagctcaggtcatctcaaggcagaaagaggaggtggagagtagcttgaagggtcaaaatgaaatgcttgggttgaaggttttgaatgtggaggaaaaatataatcatatggtcgagaagctccagatggaattatgtgcattggtgaaggaaaaagaaaaaatgatgatggagtcagaggatcttaagaggaggttggaggaaatccaggcgaagaaggatttgatggagagtgaaaaggatatgcttcggtcggaggctatgattacaaagcaaaaacagatcatgtttgaagcagagattgagaggctcaatatggaattggttgtattgacggaggcgaagaaggctgctgcaaaggcatgtgaagctcaaaatgatgaaatcatgaaggaactggaggatcttaagaggaagtttgaggaactgcaaacaaataaggatttagtgcaagctaaaaatgatgaacttctgtcaaatgttttggcaataaaggagaaatatggccagtcagaagcagaggttaagaagctccagatggaattaagtgcattggtgatggaaaaagaggtagctgttaagacatttgatgacgagaaagacaaaatgatgatggaatcagcggatcttaagaggaggttggaggaaatccaggccaataaggatttggtggagagtgaaaatgataggcttcggtcggaagctctgattacaaagcaaaaacaaatcatgtttgaagcaaagattgagacactcaatatggaattggttgcattgacggaggcgaaggaggctgctgcgaaggcatgtgaagctcaaaatgatgaaatcacaaaggaactagaggatcttaagaggaagtttgaggaactgcaaacaaataaggatttagtggaaggtgaaaatgataagcttcagtcagaggttttggcaatagaggagaaatatggccagtctgaagcaaaagttaagtggcttaatcagatattgagagtagtggtggaggcgaaggatgcagctgcaaaggcatgtgaagctgagaaggtagaaatcttgaaggaatcaggaaatcttaagaggagggtagaggaaattctggttaacaaggatttggttgagagtgaaaatgacgtgcttcggtcagatattctgacattgaagcagaaatacaatcaatttgaagtagaggttaagagcctcaagaatgaattggaagcattcgaggaggagaaggaggttactgcaaaggcgtttaatgttgagaagacagaaatcctaaaggaattggaggatctaaagatgaaggtactggaaatccaggccaagaaggatttggtggagagtgaaaataacgtgcttcagttagatattgtgacaacgaagcagaaatataatcaatttgaagtagagattaagagcctgaagaatgaattgaaagcattagaggaggaaaaggaggttactgcaaaggcgtttaatgttgagaaggcagaaatcttaaaggaattggaggatcttaagaggaaggtgcaggaaatccaggccaacaagtatttagtggagggtgaaaatgataaacttcggttggatgtttctactgcagaacagaaagaaagcatatctgaagcagaggttaagcgtctctggaagatattggatgctttgatggaggcaaaggaggtgactacgaaggcatttgatgctgagaaagaaaaaatcatgaaggaattggaggatcttaagaggaaggtggaggaaatccaggctagcaaggatttggcggaaagtgaaaaggataagcttcggatggtagaggaaatccaagttggcaagaaagcggctgagaaagccgtgcatgacaaggatgctgaggcccataggctaagagacgagttggtgaagatccgtgtttctttatcagagttgcaagcatcatacaatgaacttgatgccaagtatccgtgcctgaatgatgagaagaattcagtctaggaagctctagatgcagagaaggttgaagcatggaagctgaagtcaaacgttcaggaacttgagaattacaatcctgaaaaggatggtgagactgagaattacaatgcagcataggaggaaaagaagagtgagattgatgccctcatcagggacaacgagctgctgcactatgcagttgctgaggcataagagaagaataagggtagcattttatcatgcctgtcactacacggcttgaagtaattatgttggcaatgtgtcgctttactaatgtaatggtgatcagttggtactcaacaataaaataaaactttcacttcctttgtgatatgtgatgtatccgtgttctatttagtcatttactttttgtgacacttctgcattgttaacactttggtaaaatgccacgttaactataattacacaacaaagggatggtccttttagcaatctatctatcaatctatctatctatctatctatctatctatctatacctctatacctatactaattgggcacttcctacgagttctcatgttaattagaaagttatggccgttgattaggtcgagcgtatcatcgtcaccatcgatcatgtaattaaatagcttttaagtaatagatcgattcatcgacgttgtgggccaggttaagcccatctaatacgcctcatttacctaaccaccgtacgtatctcacgtacaatgtaacaagtactccagtaggagacctatcccaaaactaagacggcggccaagatgaactccttcatagcctctggtgtgacgtgtccatcaggatcggcggcgattatgtagttaaccggaagaagtacgcacacagaatcagctacacacgtaacacgtacaccttggcatcgatggagcgagctggaggcatggacatgcatggtagcaggttagcagtggcatatatatgctatcaatttaattgaagtttaatttcatgggcttgctgcgcctgctccacgttggagcttcgcgcatctaaacatgtgtgttgtgctgctctgtgaattcaaatgatgagattattggtcgggtcaaacacaaattttatgatttgccaaccagtaaatctactattacgttcaccaaagtacgtatagtttcaattaaaattaagccattgattaacccatatgtacttcatgtctgttttttttttcaattcgttatatagactgattcatgcaaatctaaatcgaaatatggagatcaagtaaggctccggtcagtagtgcgtcaatgaagatgaagtacaggcatgcaaaacaaaaaaaccattagtgcataattacttgatttttaattatttttaacttgaacaatagatttatgtatcttttatattgtaaagtatacttctatataaacacttttcgcacgaatgcatcgttagtagtttaaaaagcggaaacctagctaacatctgtgattagaaacgaacggattttaaatcttatctctgtgcacctaggatttctttaattttgacagtgttacaatggatgtttattcgtatgcttatatactctgagttcagcaaacttatatttgtcatctaaattacaattattatttgtatcagttcgtaatcgttaggaataatacacaaataaatgatgaattaataagactggattcacactaggtatacgtaatattttaacccatctttctacaatgatggcattttgaacaaaacttatatgattggaaagttttgctctcaacaccatacagtttagctgcaagttataatatgtcttgctatttataaatgtagcccatgcagatatgataaccgtagataagtagccagaatatgtgtcacataagacatcaaattaaatataacacggacccttagatttttaattgtttaaaattaaataatgccaaatcaaaattaataaatacgaagtcacaccaatcttaatttgatcagtattttgctaattttatttttaaatttgaaacaataatagaaaattaaaaccatcataggtatcttctattatttcaataaaataactatcatatttagcttacggctatttttttatgataacccatgcatcgcgcgggttgccgactagtacttatactaattggccactttctacgagctcccgcattaacttgtaaaatctgatcgttaattttgatagatcatataatcttaaccattgattataaactttaatcggcattaacattatgggcctcatgtaaagctcgtccaatcaactgctttaattacaggcctagccaatctatgttttgcccaccacatatatctcaacctttatttgttttgctcatcgtacgtacatttaggagtcgtacagtgtggggaacgcaggagtagatcgatggggagcacagcatcacgagatgtatctaggcacgtacagcaaggtgtagcaggcggcagatcggctgcagtgtgcagaccggtcgaaccacaccacatcggaagctggtaggtattcctcaaagatttaggaacgtaatatgtagcttacatgtgcaatctacatgttaattagctcttgagaagatctcatacaaatgctaggcaagtgcgatctgctcgcaacactcagctcaattatgtgtataaaaattatattcatatgcatgtgttttcaaacacgttcacgtcaatatctctttatatctaccaaattcatgtctcatatggttcaacatttatagcatattttcaatttttttatgaattgtcatgttttggtcgaagtaatttgactttgtcttcaaaatttatattttaaaattatatagttccaatatcttattatattacggcaattgctactattaggtcaaattattaatttgtaattaggttttggaagtattaaatcaatattgtgacctttgattatattaacaataatatcatgaccatagattaattttaaccatggatttttaaagcccaaaactaatctcacgtgtgggtcactgtccagtttagattataggcttcaaagttcatcattgagtacattagaatgcagagagtagatggagagcgacagactccatgtctcttcctgcacgtgacgagacggcgtaacaaatgacgcaccccataactccaccatctgcgcgcgctgagatggcgcctacgtcgatggccaaattcaccctgcacccgataatcaaccgaaagtcctagcgcagtttcactggttagcttctcatcacgatgtaggttttaagtaaacttctttctgttttagtttagattagagtttaattagatctcatcaattttatctgttgtttttatgtttcttggtaaaaattgaacctaggccatgtttataacttatatttcgagtttcacataaaatggaatagaattggtggagttatagtgtttttcgtgcaaggtcgatcagtttgctgttttaccggacatgcacaatgccatagtacgcgcgtgtaccgtagccttcatgtttcggtgctgtacccaaggtttcatactgtgcagggtgtcttggttattagggtgattaatttagggttccagtattattagagtaactttattattatttctttttattttcgttgtatgtttggtttcgtgctttcaaacaatctttcaatccaatctgatcgacgctatcctaatcttttcatcgatgccaaccagacatatgcgcgagtcgtccaacttctgtaaccagtacaaatctgtcacttgtctgcttgatatagtctcgcgtatattctggttccaatctttcccatgctctacaaatttcgtctataggtatagcccgtcgacacatatagcaatataatttagaaataactattagaattgaaaaataagaaatattaaaagaagagtccatctaaaatacaacttgagataaactaaaatttaaaataaaaaaattattgcaatatgaattgcaaaataaactaaatgtataaaaaaattttagaataaaatataataataaaaataaataagtaaaaaatatgtatgaagaaatgcttgccgcgtagcctgcgtaggccatatgctatacttgaacacaaagatatagatagatagatagatagatagcaggacatatagatagataggattatagacgttattgtgaccgaatcagtaaacatccacacaaagaaatattgcattggagtccggccagaggagatgctccgtgacatggcttcaccgaggcatgctctgtgccgattacttgtgcctgctattgggatcttctttgactgcacgctttcgtcttcaaccctcggcgcttgtagaaaattctggactctaatttgcatgcaaaactaacaacacgcatacatatttaacagtgaccaaaccgaaaatccaacaacaattagctttggtaaattacgcttcatgtatataattaatcatcaaaaccgtatagttaacagccaaacaactttaaaccatttgttttccattcagctaattactcaattaataaccgaattaaacctatattttaaatttcgctatcaacccaaattttaaattatatgaaaaatatttttagtttgccttttttttaagaaaaagagggtactactagtacaataccttgcaaggtatataatcctttctgtcctttgaaatattgcagtggaagcaacaagcatagtttgatcgagttgtatcacggaacgggaaaaaaataaaagagaagaaagaagaggaggccagaaccaaattaaaccaatagcaaagcatcaatgcattcgcgattccttgcgaatgaagttgtcacatgctgagttttcctatttttccttagtctcgaattcattaataaatcaaccggagaaattatttaatttaacctggagctaacattaatttaccaatgcagttaataagtggaattgggatggtggaatttttcttgagttcctcaggtttaaatacactcacagaatttttagtggaatttttagagcaaacaaggtaattataatgaatccaaagtaattaacgggattaaatttaattaaaattccttcctctctcacctttggctgtgggccggaaacggcccacacctctcctttcccttcccccgcgcgccccctttgctgggccggcctgaagccgtggcccagctgtgtctgctcccctcgctgggacaccgataggtggggcccacctatcatgcccgtccccgtcctcgcgccgccactgccgcaacagccgccgacgcttccgtgccacgcccagcctcgggaggtactactagtacaataccttgggaggtatataatcctttctgtcctttgaaatcttgcagtggaagcaacaaggatagttcgatcgagttgtatcacggaacgggaagaaaaaaaagagaagaaataaaaggaggccagaaccaaattaaaccaatagcaaagcatcaatgcattcgcgatgccttgcgaatgaagttgtcacatcttgagttttctcatttttccttggctgggccggcctgaggctgtggcctagctgcgtccgctcccctcgctgggacattgataggtggggcccacctgtcaggcccatccccgacctcgcgccaccaccgccgtaacagccaccgccgctcccatgccgcttccggcctcgcccctcgcacgcggcatccttatccatcccgtcgcaaccgccaccgcccttatccccttcaaaatcggcagaaatcgtgcccttatcctgccgccgccctaattccgtcgccacgctagccgccaccagcctccactgagcccaccgccaccttaaaaagccccctcaggacctcctccacctttttccctatttttgccaccattcctgagccctattccgctgccgcgccgtgtcctagccgccgctgccacatctccacctccggccgctgctagtcgccgcccggctgcaccaatgccactgttgctttcaccctctccttctgcaccgtggctaccgtttggttgctaccatttcccatcggagcgccaccaccgctgcttgccggtgagtcctcccatctcctccatctttggccagcgaagcttgccgccatggtcatcttcccctaccctgatccatcttgtttttgcccactagacgccgccgctgccgtccgttgctccgaccaccaggtcgcgtttgccacctccccttccgctccggccgccgtcgctcaccagtaaggaccccactttgtttttctctctcgtcgttcaatgccgctcgtgaacgtgcgccgccgctcatcgttgttgcgccttgcaccgtcgccgtgtgccgccgcttagccgcactgccaccgtgctcgccatggctggccgagccgatctcgagcccgacaacgctagtgcgccgtccaatcggcccttatggcagatctgggccgtcggttttgtggaccggcggtggaccacccacgtggtccaggtccatggtacgccggcaccccgtgccgctgacatgtgggacccacctgtcggcaccgaacgcccccccctgatgacgtcagccctcaggctttaatgcgcaataaatcattaaggaattttttgtttatagtcagaacacagtaaaacttctaaaattcgtatctaatttatccatgctctatattaacccatcaagtctcaataaatttataaaaatatctaaaatccattaaaaatggttttgcttcatgtttcaatagacttatagcatgttttgcttgtttgctttgtttggcttatagaatccagcagttccgacgctcccgtttactacaaagtggttgcagaagttcctccagcgccagagcaaggcaagtcatacacaaagcattgatcatattgtacctaatttataaatccctcgctttctacttaaattgcattattttataatatcatgagggatggatacctattgtactcatcctttgttatcccgaatcattgatagcttggggtataatttgatgatatgattggtttaggtgatgcttagtgttggtatcttttaacattacaaataaaatccgtaagcgcacggatataccaatgtagcacttcacccggaagtattccaaggtatcaatttccacagggaacgtgtgtgctcaggtgttctccagattcatccaaggacacaaagcaaagataggcaaagggtagagagtatttcctagtgagaagtagtgtctaaggaaagcttaattttaatcctaacacgatacttcaggcactggtaacccgctgttctcatatgtcgctctactacatactcgtacagggaggacttaagtgctcttgagggctgtcaccgcctcaatagtcacctctaacgtactgtgggatacgcagcaaccactgaaaattaattacccacacactgcgtatacgcaattaataactactctagtgctagctaaacactaaaacaatcactatatatttaatggactatagtgaaaaatgatcccatatgctgattaggaactaaccaagaataattcccactaagtaaatcttaatttctcataaagataattctattaaaccagagtaactaacaaggtacaaaaagtgccgccgctctcgccggccgtcgccccacccgtcgaagaagacgagagaagagaagaaagggggaaaaagaagggatgtggggcccgcatcgttttctctcacttacatgtggacccacgtactttatttatttattttcgctgactaggatgccacgtcagtgaaaccactcacgtatactgccataggaccttttgtgcacggtttgtgaaagtttacgggtgcatatttctggttttgtggttaagggacctcaaaaaatctcgctgttaagttgagggacctctggtgaacttattccgtttgggggggggggatgggccgaaatccccgtgtgccatcccggccgggtctaattttcttccatggcccatatgcacgttcgcctgggccggggtggaggcaattctccgcccgatccacgccaaacccccgggtacagaaaaatcgtctcggagacggttgttttcttcccgagcaaatacggcgcttgtcttcctcgactcctcacggcgctagggtttggatgcggcgcgaggtccgggaggtggctctagctagggtggagatccgggagcagcatatttccagccgccgccgctctccatcccgccctcggtcgccgccggtctccatcccgcttcagccggtgctgctctccttcctgctctccatcccgcccagtcaccgctgctcgccatctctccttcctcgcttcgaattcaccggttgcgggagagggcaaggtcgagggcaacagcctggacatcaagaagcatgtatgattcttgatctcctcttttccaacagcgggagcatctcgctgaatttctcccggctacacacagaacagccaaaacagataaatacatattctgtagaggaatgataagtgtattgcgaaaacaaatgagcagatgctcatgaatatcagcatcaaacagaatcttgcgttcttgctatagtggttcccagatccattttattatggttacatgttacattttgttttgcagtcaaaatgttgttacttgagtacttcatctgtaatttgtcacaaaagtgcctcggatccaagcttctatcctctcccaacaattaatctttagtaatttttgggtgaaagtgcttctgaactaccagattaattggctacttgagtacttgagtggtgaatatcttcgcaatgcataagccattaagccttgatggacagaaacagaattgcgctaaaacagtgaaaatctgaccaaacaagcaacaagaagtaaaatatctgaacacagaacaccaattaggcatttgttgtctgatgtattgtcaagaaaaatgtaatcatatcttttattggaatacctattttactcttagcaatcaatttagcatatttatctattctgaactgctactatgttcataactagtttcaggaaactgggtgttcagatattttactagaggtcatannnnnnnnnnnnnnnnnnnnnnnnnnnnnnnnnnnnnnnnnnn

SEQ ID NO: 42926 - DNA, 19936 bp, Oryza sativa
caacaattaatctttagtaatttttgggtgaaagtgcttctgaactaccagattaattggctacttgagtacttgagtggtgaatatcttcgcaatgcataagccattaagccttgatggacagaaacagaattgcgctaaaacagtgaaaatctgaccaaacaagcaacaagaagtaaaatatctgaacacagaacaccaattaggcatttgttgtctgatgtattgtcaagaaaaatgtaatcatatcttttattggaatacctattttactcttagcaatcaatttagcatatttatctattctgaactgctactatgttcataactagtttcaggaaactgggtgttcagatattttactagaggtcataccatacaaagctatataaatggctattgaatgacaaaaatataatctgttgtgctcaattaaattttcaggagaggcactggcgtgtgaggttggcaaaaggaaagctgaaggagttgatattactcaaggtatttgagaaaaaactacatacagttgtacttatatttacctgatacgaagcatttaatcttacccctgcatatttactagagtagcagaagtaatttgaattggcacacaaatatactgacctctgaatctaagatttgtacctctgctacgtgaggttttagcaaaactaagtacacatatctgaatctgagaactgtaccttggctatctctgaggtttaatatatatatcggatttgctaacttgagtataagtaaccatctttcgcatatttatctgatttgattcaagttcattttacctgttgtttggtttacatattaacaatcaccattgtctaatgtctaagactggtttctttttggttgtgtagttacagggtcccatggcccatttgctagctacgcccattggaaggaatcttttgcaagatagttctcagagaccgcttgaattatgaaatgcgatggatggacaacaatttttcctaactgcttcttaattcatgtagctatgatggttgcaggaaccaattttttctacaaaattaacactttgatcagacagagatatattaccttccaagaaccaattttgtagcttgctttgcacaatggcaattggatgttttactgcttgtagaatttaatctatccaaaattatgattttaatattctggactatttttagaattcatctgtggtaaatctacgattttctgtttttacgctttttagaattattttgcacgttgaatttctgttccattttcatgatctttttttttcttgtcatttctgaattattttgactttcgtgaccttccatttttttaatttatccgaatttttcatgatattttctcactctgaatttgaatggtagtaatcccttctaatcccacctctaatcccaccttctactccaaactgctagggaacaagacataacgtgacagtggaatagagggggattgggaggaaaggtattgggtgtggggagcggggacaacccaaaccccacgtgggttggttttccttcggatcatttcccacggctagcgaaataggcctcaatcaattttggaaacggacgggggagtcgggtggcatcggatgtggatttgggctcggtttcaacaatggcatcgggtgggaggtaggggatgacactgttcataggcccacatgtcagcgagaggaaggggcggagggagtagatgcggactttggccgaaacaggggtgaaggctgcggatggcgtgactgggccgaggaggtgggaagaaaggaatgggccgggtttcggtccaaaggctaggaagaaattttattttattttccaatttaaataattgctgaaatgatctttcattcattaaaaataattacaatgctcaaataattccaggaaaattgtcgaaaatacttgggcaatcaatgtatttaacaaaattttatctagctcagtttgatgttcaaatttttcataaattttattcaaacacttgctttaattattgaataatttctaaaaattcctttttcacaacaatttatattttaatgatttttagggtgtgacaaatccaccacccttacaaaaatctcatcccgagatttgaaacggctagcaagaagttgggtagggcaatccttcgccgaccacttcctttatctggctttcatttttctgtgcttcttccaaaaaaagcctatcttctgtagttgcgttcttgtttgcctttctgaaatcaccatcccctcaaccttggtaggatgttgattaaaagatatctagtttactgtggtatcagatcggaggttcattctggctcatagtttgaacacccctgattctatcaaatccaggaaagtcttgcttagcgctagagccaaattatttccccagttgtcacatctctgagaagaaatgatatctgacattctgtctaattcaatctttcgaggtagaatgatttcctcgtatccaacgaaaacaagtctcttatctattaattagattaaccagatattaaagcaatctcgccatatttggtcctattatggcatcaagtgagttttgccacgagaactacatattttgatacatgctggttaatggaggtttttcaaactaatacatatgcatttcaatccaaagcatctcatttgttacttctttctcttttttaaggaaggtttggaaaagtgaacttttatgtatatgttttctcaaacttggacttgtccaaaaatgttgaattcatggatttcaagtgagagatacattagggtgaacttatgtaaattatattcatgtatctcttgctttcaaaacatgaaagatttcaaattttggatttatagccctttcaaatagcctgtttggtcaaaagtcgaaaatttgtgaagatcttttcaaaattgcttcaatatttgtttgtaacgtttttcaaagctgttggagtaaaaattattttattccaagcaaaatggcttttatccaaaatcttgtttcagcacatttttacttaaacttgcatgcatatggtgggtttagctaatttagctaatgttctttgtggatattggcttctctttacgtctctaactcatccaagattttacaaatgttaaacttcatgaaatctttttttttcgtgatgtttcaatgctctttccaagctcattttgagtttccaaaatctgaaaacctgaatttttcaggtttattaatatttatgagtggttgagatctcagcatggcttgcaaaataaaaacttgtgcgttatttataatccatctcaaagttttgttgtagatttttgagcccatgtttaccacaacctatcaagtgaaggcaattatgagtcaaatcgataaagcctcactcgagacaagagcttgaagctatgatgcatcaatcttcacgaactcatcgcttatctaaacacgtaagataacaaatgcggtcttgtccttaattatgaatgagtttttttctacttcatttgggttttttttccttgtgcttaacatgaaacccaagacaccttcgagtgaaatgcacggtgtgctcaatataagactgagcccaaggttgagaaggtgtgaagtgatgaaaatgaaaaaaatccaagaattaaccgactccaccaacatgtgttcttgaagaaagcaaacgggcatcttaacttagatgctcaaggtatccctaatgaccaagtgctttcaagtagtatcttcttctattgaaatttcaatttatatctttttggaataaggtccttggttattagacaaaccctcatacttaccatgttttcagctaatatttattgaaatcacgataggtgtggtgtgtgatgttgctaatgactcccaaatggagcatgttctctcaattatgctagataatggaaaaaaagagaatacttggggatgtgagacatcaagaagtccatgatgaccaagatggaatacttggtcaaccttcatcaactctagtcaacctctcacaaccgactatgaagaacttgaagtcatgcctccaacataagtgaatgggattgatgccaagggtactcaagagcaaagagacaccatgcaagctcatgtcccctcagtgcaccatccaagaattcactacattgttcaacgagatcacctcatcgataagattcttggtgatatcacaaatggggtaactattctatctcattgtaagttttctaagaattactcttttgttttttctttgaagccaattaggatggaagatacacttggtgatgtagattgggtgatgactacgcaagaagaattgaacaatttcactcgcaatggtgtatggtcattagtgaagagaccaaatataatgtcattggcaccaactgggtcttcctcaactaacaagacgataatggagtagtcacttgcaacaaagtacggtgtctcacccaaggattcatcaaagagtcaacaagatcatccctacaacatcctcaacaacatacataaaggagtaactatccattctcaatttacaaattttgtgaatgtgtaacatcctgaaaattcctgataataaaaatcactaaaaatttgaacctttttaaaacttttacatcatgctggatgttatggctgctattgcttgccaagccataaattgtcacaatgggaaattaaactaaagttgtacaactaagtaataattttaataataagatatttattatgaaccctataaatatttacgcacaagaaagcaaagctagacaaagggaaggttaattactaatttaaattataggtcaaatattaaatacttgaatcatgttgatgagtgtcatgaaatataagtacacatgaaataatggtcaccactataatgaccctatctataagtttcactagaatatttaaaacactttatcaagtctcttagggcacaaaattcactcatataaaataattgttcatgtaaataaatttagctctctatataaaataggcttatgggagtatttgattcaatatttagacagacattgcaccaagtcacacagtggcttcatggaataaaaattaaatagattaaacctatctgtgtaaagtacattcctatacacataaactcggccaatgtgccattgtattaatagggccacatcggaatatttaatccaacgttattctcaatgttgtgaccttaggccacggacaagttcagggataggcgggaaagtacgttttccccacctatcctaaaaatgagctcggacacaaaatgcacggtattagcaagtggtatttctctattaagttatatcttgtcttgatacaggattttggccggcttatatagcccacagccgtacatgtgaggttataatcttgcccctataggctcttgtgagtttaccataatacccttgccatgtcagcaatcctaggggcaatttggaacattttggaggtgtttatggtcttttggtgccagctggcagaggtggttgagtgtggtcccatgcaatcttcttatggtatcttccttgctcaagtagtgttttccctcgagttcctcgattggacgtcttttccatcttgagagttcaaacattccttttcacctgttaggctcttagaatttacctgtcacaagtaaaagtctactcaagcgggataagctgctgaagtatcacaaaatcactcgaatagaactttaccactcaaatggaactttaccagtcgaatagtatttttcccaatcacaagtcttttccgagttggaaacttaggattctcaagacctcctttccctcggtgttttgattgaatgggaaggatgatgtttaccccatacaacaacaagcccctcacgggtaagggtgacatgtgtttttggccaaaacagtgctcgagttaaaagtagggggaaaacggccgtcctcctattcggtcaaaacacactgtttatttcatatatgctgatatgcatattttatttcttactatatatgcgttattattattattttttttgtgtgccacgtgtcaaccttgcattgcactaaccgaccggggggagggggttcgtcgcttcggtgctcgcgcccactcacccactcgcgacccccaccgccccgcgctatataaggggtgggggtcgctttcaaatagccactcctgctcttggccacgttctaaactagctcaaagacactcaagccgtcctcgaaatgtattcgagctagcactgtccaattcaatccaactttttagtgcgagctctctcttcttgagaatgggaaaagacataaagaagttagttggcaaggccaagtccacgaaatccaagtgttggcggtatgtcatcagacccttcaaccagacctgccgaaaccatgcaaccagcgaggattcgagctcaaggcgtcaagttcatctgggcgaagcccccatggcgaagactgtgaagcaaagggggcgaagggcgaaggatcgcgctggtatcccacaagaccaaaggcatcttgggcgaagactaaatggtgaagggtgcatgccgaaggagggtgacttcgccataacgagttcagcttcaaggaggcccaaggggccatcccagccgctcaagcccgttggcccttgggccaacgttcgctaattggcccattatagtcccatgtatcacaattacgctgtgtacccatgtaaatgtccctttcgtaagggcagccatgtaaattcccctgtaaaacctaaaccctaacggggtaacctgtgataggattataaatagaccctagggccatgtaaaagaggggatcccaagaaaaattccaaaattaatacacttcactgttcccaacaactgttgagtagccacgtccttcgatgtacgcagttgttgcttcgacaacagctggcgccgaccgtggggatctctgagcgaaaccattgagagcgaatgccaccgaagaaggtcacaaaggagagggttgctaagcgaaaggagagtgaatgtcacaccctgaaaattcaaattatataaattgttgtttaaatggaatttctagaatttattttaaaagtcttgaaaagaaaatctaagtttaattaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagtcggcccaaaacccgctctctctctctcctcggcccagccggcccagtccgcagccgccgcgcgcgcgcgttcggtcgctgacaggtgggtcccacctgtcagtcgtcgtctaccttcggccgccgccgcccgaaaccctagtttcgcgccgccgccgtttcctttccaaatccggccgttcctttccttctccggccgaattgatagaggggaaatgatctccgggatctcctctaccctttctccgttggaatcttcggctaattcgttttggaattcgtggaatcgagttcgaatcggatcggctttcctctctccaagccgaggtttccttcgccgttgccgtcgccgtgggcctccgccgtcgcctccgagcccctttaaaagcctccccggtgtctcctctacccgtcgccaccctcgccttcgcctctcgtcgtcggaaccgctctagcgccgtgtgccctagcttcgtcttcgccgccgccgctccagccgtgctccgccgtcgctccagccgtcgccgtcgctcgggaaggccgccgtcgtgttcgccatcgcgtcgccgtcctcgtctgccccttcgccgtcgccggagatcgccggagcagcatcgccgtcgtcgacccgaaggtttccgccgtttccttctcgtcgccgtcgtcgtccgctgttcttccgtcgccgttttggtcaccggtgtgttcgccgtgtcgtcctctacgtgctggtgctctctgtttgcgtcctcgcgccgccgttcgccggtgagcgtgcgccgcccgagccgtccgagccgctgagccgccgccgccggggtgacgtcatcgctgacgccatcggggtcgtccgccgtgagccgccgtggacccgatcgatctcggccgtccgatttggattggttcgatctcggccgtccgttcgcgtgaaccgtcgcccgtgcgcccggtccaccgaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgttgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattatttcttttcaactattgcatttattttcgaatgtcattgggtggaattaacctattgtttgttatagcccttttgttcttgattacctcattccttgataccttgggttataataatttgactggttgaactttatttatattggttcaactagatattaggtataattgcttagccctgcttagaaacattagctcactattgggataacttatgattcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgcttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacatctctgatcagagtaaaactattcgaatagccgtgcccgcggttatgggcgggtcgaacaatgtctttcgtgattagtttcacacttctcaccatagtaaatgatgctataattggtaataatgtgattagctcctggtttggaatggttcattcctggtttggagatagaactgtgcagccggggtggttgttcagaatggttgggcctatacaacagggaatgttgtatagcgttggattaatattgttaaatacttaactgttttaaattctcaaatgtttgctaaatgctgcttttgcaaatggagccctattatgccatcctttgttaccctgtgcacttgcatatttgctgcgtggcttgctgagtatgtcatatactcaccttgcaatcattcagcagaggaagagttctacaatgaggctgatggagtggaggattaggtgtagccttggtcaagctgcctgtggagtggagccgtctgcgccgtttattttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgttacaagttggtatcagagccccttgaccctaggttatgccaaatggttacccatagaagccctctaaaaatattgcaaaagtagaactgttctcctccctttctcttttaattaaaccaaactaatggcacatgcacttcataaatctcttttaatggttctcactcaaaatttattccagtgttattagtactgtacatctattactgtactaatggctcatttatcagcaaaagttttacaatgttgtttcatttaatcttgctgcaataaaataaatttagcatattgattttataattttcttttatttcttttgaaaacctgttattcaaaagtacaaaacttgtaaccttgttttcaactatttcaactcatcttgcaagtttggtttactttatttacttaccttttactttgattttctaaactttattcaaattaatccaaaaacttgtgctattaattggataagtgtcttaactctctcctttcacttgtctttagatgccgcgctacaagcctgagtatctgtttggtgttgagggttttgtccaggagttgcgtacaatgtcctttgtcattggatttgggactgcccctttttatgcccagattcgtcatgaagagaagtgccgagtcaaagtcaccttgaacagtaatagtgaagatattccctcagtgatgttcgaagctagaggaagaaactacatccatgcatgtcaggaggtggcaaggatcgccataggagagctccgtgatcgctacagtgatcagttggccgacactgagtatcgctactgtcgcgtcccaaatcgactctaaaattcatcctcaaaattgtgcaaaagaataagtaaaattcgtgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagttaaaaaggttttataaaaagaaaaccctaaaagaagtcttttccccctcctcctcccttcttgggccggctcggcccattccttccctctccctctctctctcttcccccgcggcccatcggctccccgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgctttcgcctctctctctccctcggattcgctcggatttaatcccgcattcatcgccggcgcatctatggcggccgaaatctccgcgaccgattcctccctctccggccgctctttccttcccccggcgctatttaaacgttgcccgagcttcgctcttccgtttccgccgctcgccgctcgctctcgccgtcggtttcgtgctcgcgccgtgctcctctctctccgccatcgccgccgagctccgttccgccgccgccgccgctccggacttcctccttactcggcgacacctccgtccgcttcgccgtgttgccgccgaccccgtccgccgctccgcttcgcccgtcgactgccggagcgccgtcgtcatcgtcatcccgaaccgcgccgccgtcttcctccgctccgtccgtcgtttccgccgccctcgtcgaccggggtgagccgaagaccgttccgttcgcttcccccttccctcctctctctcgggtgccactccgccgcgccgttggtcgccggcggcgaccatcggggcgcgggtgcgcgtcctcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggccccactcccgtggacccggtccgcgcgccccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattactaccttgttcaccctagacaaacaaaacctcaactagtggacactctactcatggtatccctagtatgattttaggtagatgcttcgcaatctaattaggtaaccttaggtggttttacaactatagactttgggaaatattcatatcacctggatactctggaattgttggtttattgtggaattggactcacaccatccccctttattcaaaatccccaaaatggttttaggctgggctcggggtgcatggttttgatagtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcacgtggcaacacgtgaggaagatgtgtcttgtgggtaaagttgtacacctctgatcagagtaaaatctattcgaatagccgagccctcggttatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgcgggttcacggccttgattaataatattgtttagttctaggatcgcgtttacaaagtagctttgagcaactaaatgtctttaaatgctgtttactgcaaccctaaccctttatattataattcccttgtactcccttgcatttattctgcattggtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgtcctttaaaatgttgtttctctttttgtttttgtttgtagatggccggcagcgttacccgtcgtggtttggacatgactggcttcgttttggagctgcggggcatgtgcgtggtcttggggtatccacatggagtggattaccaggccaggccgctcccggagcaggagggtgaggatgcagagccccgcgctggttgggaggtcactgcagtgatcctcgccggctcttctgagcggacttcgctgacagtcaccgcgggtggcgactccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtcgagaacaacatgaagatcctggagctgcgtcaggagaacctgcagctcaagaaggacctcgacgcgttggaggcgcagctgcatcagctcaagatcgcccagggagaggacagccgacccaagcgtcgccgcgtctgccgcagccagaagatcaccgcccgcaagagcacctccaggcctgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgttttttctcgtttgtcttttttgagttgtgtggggcatggttacaccggtgtgtggtgtaactatgtcggagcctgtctttatttgtttgcctaagcaacttgaacattaatgaaccaatttaatagcagtaataaattcaagaattatagtagtcgtgggtggttagttttaatcgtcagctctccttctctgtttgctggttctgtgtggggttttcagatggtgacgaccaggagaaatgttaacaccggtgaaggcaaccaacccgaaggcagcaaccacaaccaccaaggcaatccacctccacctcctcctccgcctccaccaccaccaccagacaccaacgccattctcacccaaatcctcgcccagcaagctaacctgatgaatgctttcctccaccacctccaaaacccgccacaacagaatgctccaccaccacctccccaacactctaaactcgccgagttcctccgcatccgtccacctaccttctccagctccaacaatcccgtagatgctttggattggttgcatgccgtggggaagaagttagacactgtgcagtgcagtgacaaggagaaagtcgtcttcgccgcccaccagctgcaggggcccgcatctctctggtgggaccacttccaggctacgcagccagaggggcagccgatcacttgggctcgcttcaccgccgctttccggaaaacccatgtgcccgccggagtcgtggctctcaagaagagggaattccgagagttgaagcaaggcaaccgctccgtgatggagtacctgcatgagttcaacaatctagcccgttatgccccggaggatgtgcgggaagatgaggagaagcaagagaagttcttggcaggaatggaccccgagctgtctgttcgtctagtctctggagactacccggacttccaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgcctcgacctcaattcgtggtgcgcgtcccacagccgcagcagcagcagaatcaacaagggactcgtgcgccccgtcctcctacgccagctgtgcagcccgttcaaggccgcagggacgctcaaggtcagcagcgtctgtgcttcaactgcttcgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctactcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgaggcgcactgtcactctgtaccgagggccagaacaaccggttgttttctttgcacccccaacctctgccagaagttcagaacttcatcagatagaactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagttaccatcaaaaacaagtaccctcttccccggatcgatgatctgttcgaccagcttaaaggtgccactgtattctccaagattgatcttcgttccggatatcaccaattacgtattcgtgaagaagatattccgaagaccgcattcactacgcgatatggactgtatgaattcacggtgatgtcgttcggcttgaccaatgctcctgccttcttcatgaacttaatgaataaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgatcgccgtcaccgattggaagcaacccaagacagtcactcagattcgcagtttcttgggtttggcaggatattaccggagattcattgagaacttctccaaaatcgctcgacccatgacacagttgttgaaaaaagaagagaaatttgtgtggagcccgcaatgcgagaaggcgtttcaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgacctcatgaaggcaactaccctacacatgacttggagttagcagcggtggttcatgctctaaaaatctggcggcactatctcattgggaaccgctgtgaaatatatactgatcacaagagcttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatggttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtggctcgatttattcctgtgaagaccacttatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtgtcctagatttcgggaagacttggataagagtctcccctatgccgagttctcctacaataacagctatcaagccagcatacaaatggcaccttatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgacgccgtgatctggaattcgcagtggatgattttgtgtatcttcgggtcacgccattgcgaggtgtgcacaggtttcacacaaaagggaagctcgcacctcggtatgtgggtccttttcgtatcactgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaattgaagttcgcgaagatttgacctacgtggagaggccagtgaaaatcctgaacaccatggagcgcaggaccaggaaccgagtaatccgtttttgcaaggtccagtggagcaatcacgccgaaggagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcgtgtgaaagcctccaacaattaaaatgtgcaaagataaaagtcaaatgaggcttggaggatttttgtatatttcctaaaagcctaaaatgcttaaataaattttagtg

SEQ ID NO: 42927 - DNA, 5791 bp, Oryza sativa
aggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacagctaccatcctcgtcaacctcagggaagtgatcgtggcagttaccttgagactgaaggaattgagaatgatgctaccacaagatatttggttgagatgctgtgggctatggatgaaagtcgtgcagagagtgtgctagcagctcaagatcgggaagatcggaatcgtggtaagatttgcaagctcgaagataaggtggatcgtttggagaaggaactagccgcattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccagtcatcatcataagtagtgatgaagaagaagaatccaagcgcaaccattccaagattgagtgggtagcaactcaagatgatgaagacgagccgaatgagccttcaatcgacctccgatgcttggaagaactagagtgacttgttaagtcgttgtcttagatcgttgtgttagtttgcttgctttaagtttggttgtgtgtgtgggtcttgcatgtgatttacatcagtggtgggatgtaagtgcgtgcgtttgtttgcttttgagtgttaggaagttggtgagtttagtggtgtgagagtcttcagtttgtaataataaaactcagttaagatcaataaaagttaaagtaattctctgtcctaagtagttttcccccggtttctcttcttatcctgtccatgccagatggtgaatactcgcagcaacgggaatggtcccaacaaccccaataacaataacaatggagagaatcccactcttgctcaagttcttgctcaacagacacagctaatgaacatgatgatgcaacaatttcagaatcagcagaaccaaggaaataaccatgcacctcctcagaataagttagcagaatttcttcgtgtaaggccgcctgttttctctagtaccactaatcctgttgaagctggtgactggctgcatgccatagagaagaagttggatttgcttcagtgcactgatcaggagaaggtctcatttgcatcataccagttacatggccctgcctctgaatggtgggatcacttccgcctgaataggactactgctgaacctatcacttggcttgaattcactgctgctttccgaaagacgcatataccatcgggagtggtgtctctcaagaagaaggagttcaggtcgcttactcagggatctcgctctgttacggagtatctgcacgagttcaatcgtcttgctcgttatgctccggaagatgtgcgcactgatgaagaacgtcaagagaagttcttggaaggacttaatgatgagctttcttacccactcatgactggagattattctgatttccagaaattggtggataaggctattcgtcaggaggacaagtataatcgcatggagcagaagaaacgccggattgctcacttcaaggcacaacaggggagtaatcagaagccgcgtcttgctttaggaccccagcctatgccacagggaggttcttcgtctgttgttcgtccgcagcgtcagttcttcaacaacaatgctggcaataacatccgcaatcaagctccacgccctgttgcagctccagcacagcaacaacctgccaagagggagcaaggtagcaagcccgtggtgtgtttcaactgtggagacccaggacattatgctgacaagtgtccgaagcctcgacgcgtgaaggttgtccctgctcagagcaactctactgtaccagcatcaaaggcccgtgtcaatcatgttgctgctgcagaagctcaagatgctccagatatgattttgggtacgttccctgttaactcagttcctgcaacagtacttttcgattctggtgctacacattcattcttatctatgagttttgcgggaaatcatgggatggaagtagaagatcttagacgtcctttgatggttagtaccccaggtaatcaagcactttctttgcaacgtagcccctcggtcagaatagaaattaaaggagtaccatttctggccaatcttatcttgttagaatccaaagaccttgatgtcattctagggatggactggttagccagacataaaggtgtgatagactgtgccaacagaaaagtaactctcaccagcaatgatggtcgagttgtaactgttaatgcattgtcttctgagtctttaaggtcaagactgaaccagataactttggaagagattcctatagttcgggagtattccgatgtgttcccagatgatttacctggaatgccgcccaaaagggatatagagttcagaatagatttggtacctggaacaactccgatccataagagaccttatagaatggcagccaatgagttggctgaagtcaagaggcaagtagatgatttgctacagaaaggatacatcagaccgagttcgtcactatggggagctccagttattttttgggaaaagaaagaccatacccagagaatgtgtgtggattatcgtgcattaaatgatgtgactatcaagaataagtacccgctacccagaattgatgatttgtttgatcagcttaaaggtgccactgttttctccaagatagatcttcgatcagggtatcaccagttaagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagtttgtggtggtctttattgatgatattcttatctactctcgaaccaaagaagagcatgaagaacatcttcgccttgcattggagaagctacgagagcatcaattgtatgccaagtttagcaagtgtgaattttggttgtctgaagtgaaattccttggtcacgtcatctcagccggaggagttgccgttgatcctagtaatgtggaatccgtaaccaattggaagcaaccgaagacagtttcagagatccgcagtttcctaggcctcgcaggatattaccggaggtttatagagaatttttctaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcgtcattatcttttcggtactcgtacagaggtgtacaccgatcacaagagtttaaagtatatctttactcagccggatctgaacatgagacaacggagatggttggaattaagtaaggattatgacatgggaattcattatcacccaggaaaggctaatgttgtagccgacgctcttagcaggaaaggctattgcaatgctacagaaggacgacagttgccattggaattatgcaaggaatttgaaagattaaatttgggaattgtcagtagaggttttgttgcagccttagaagcgaagcccactctaattgatcaagttagagaagcccaaattaatgatcctgatattcaagaaatcaagaagaatatgagaagaggaaaagctatcggtttcttggaggatgagcacggaactgtatggttgggtgagagaatctgtgtccctgataacaaagatttaaaagatgcaattctgaaagaagctcatgatactttatactccattcaccctggtagtactaagatgtaccaggatctcaaagaatgattttggtgggcaagtatgaagcgtgaaatcgcggaatacgtagcagtatgtgatgtttgtcagcgagtcaaggcagaacatcagaaacctgccggtttgttgcagcctttgaagattcctgaatggaaatgggaagaaattggtatggattttatcactggtttgcccagaacgtcatcaggccatgactctatttgggtaatagtcgacagacttaccaaagtggctcattttattccggtaaaaacaacctattccggaagtcgcttagcaaaattgtatatggcaaggattgtgtgtttgcatggcgtccctaagaaaatagtgtctgatcgaggcagtcagtttacttcaaatttttggaagaaacttcaggaagagatgggttctaagttgaactttagcactgcttatcatccgcagacagacggacagaccgaaagagtgaatcagattttggaagacatgttgagagcttgtgctttagacttcggtggaagttgggataagaatctaccctatgcagaattctcgtacaacaacagttatcaagctagtctgcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggctcagtctcgacataagagttatgccgacaatcgccgcagagatttgagttttgaagaaggagattatgtgtatcttcgtgtcacgcctcttcgaggtgttcatcgttttcacaccaaaggaaaattggcaccgcgttttgtgggaccttataagattgtcagtagaagaggagaggttgcttatcagttggagttacctcaatccttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacaaatgagagaaaaaccaggaatcgagttatccgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaattatataaattgttgtttaaatggaatttctagaatttattttaaaagtcttgaaaagaaaatctaagtttaattaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagtcggcccaaaaccccctctctctctctcctcggcccagccggccca

SEQ ID NO: 42928 - DNA, 1070 bp, Oryza sativa
tcttaaccacatgcacatgagaatcaatatcacacaaccgctcatgttggatgatggtgcctgacgacaacaggcctcacagagctgtctatatgtccacgccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaagagtctctgtcctgcccgtcacggcatgcccccgtaatgggagggccaagatcatagccacatcctgtagagtgatggtcatctcaccactggggagatggaagctgtgtgtctcaggcctccatctgtccacaagtgctgtcaacgcaggagcgttgaagactggcattcctctgctcacgaccaaggccaccccgagcaacccggcagcctttaggtacgggatgtacctatcgtcgaacactgggggggtatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctgctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctgatgacacaacgagcatctattttgcaccggcgcagcatcaagtt

SEQ ID NO: 42929 - DNA, 1191 bp, Oryza sativa
cccttccaatccttgtcgctgtaatttgttctcttaaaagaacatgtatacattcatcatcactgcacgaagcgatactttttatatcagagattattctgcttgatactaaaatgtgcaaattctacaccgatactgtagatgacatatatgcatatggtattattatggttcgaaactataataatatcacagtatataaaaatcatgatgctgtggctataattaataggtcgaaatatataatgtagttttaagaaactacatacgaatttagatggcttgacaagaaggggattgcaccttgcagctcttttgagtaacattaagttcacacgtaataagaagtggagtacgttactaattaacaattaccgaattgatatatatcatactcctgtcactgctagcatccaagctaagctatagtaggtttataatgcatgtgcgctccttcctcagtaatatatatctgtatatgtttgaatccaattgaccaatattcaacattggcattgcatatagccgctgaagcgggtttaatttgttaattgttatagaatcttttgtccaggaccacggactataccccggcaaaggaaaaaaattaactttcccaaatataggaagcagaagcaatcttatgggtcatctgtttttaaattaaaaaaggttggtcagatcacacttgaatacatcggcactcaatactagctaacaatagatagccatacaatccgtgatgcatgatacggcatgcacctaccagggcatatacacccaatattaaactgttcattaattccactagtttgttctcatatactaacaattgttttctgtttccaggtaagtaatgggtttctctagccttgtaagaaaatgaaactttagttgatttcctgatatgttcagttaagccgcaacaacattgtctcttaactctcaacgccaccagctccaaattaagcacatcaaaccaaaacttgttactagctccgtcccaaaaaaagttcatttttcacccatctcacacatatcaatataaaagaaaacgactagaatacccctactttattatatccccaatgtaattattcatcactttatctatactctcaatatcattattccctacttttcacaaactccgatgcaataattactctaaaaatgaatttattttgtaac

SEQ ID NO: 42930 - DNA, 9502 bp, Oryza sativa
tgtgctttgcttgctctctgctacggctctactctactttctctctactgcaattgatgatctgttcattttactctcttgtttgttgggtgcggctgctgtgaatgcattggattggaggactgatgttgtttgatgtacgtggcttgtgattaatttctcttttctgaaatctacaaagttctcaactctccatgccgtcattgatgtgttcatatgatgttatattgtgtctacccttttgtgctatatgcaagtagttgctcagaaacccctgagcaagtcagccttaagcggcatctaggcgtcgaccatctagcgtttatcgccttcttgaacattgattttaccaaacatgtatttttatgttaataaaatttgctaaagaaagatatctacaacaatattaccagaagtgtgattcatctacaggagtgggttcatctttaaaactcctagtacttcagcataacagaaaagagttatgaagtttgctacaaatgctggcagcctcctgaagcaagtcctttagaatgtagcttcatcacaatgcagttttaaaaagagcataattgggtatatatacactaaaactttacacccactttttaactttttagtactaactatcaataatcacaaacaattttttaattatggcaagagtgctgcctaatgcattaaagtagaggaagaaaaggtatgtttacatgcctctcactttcagaagatgacatgtggcgagtactaaagaaagaaagattaactgagggcatggctatattatgtcatacaagaaataccgtttattgaatgaatgagccaaaaaaaataaaaaaacataaatcaaatgagttaatctcttcaagctagtagtacggaagaaccttattgttaatgagataagaaacctggaatggatcggtggaaaaactttgaaagatacttctatttctctccttccagctattccaccaaatatgaaagattagtctgccatagcttctgccattttttataaaaatctaaattgccattgccagccaccatttgtttgcattcatattatttttatgagcatatctgctcttataagacaaagaggatacggcacgtgggaatttattatttccttttgaatgattgcatctatgtgtaacctaaataaaatattataaccctaccaaaatttgatgtgcacttgaaacacatttcttggttatatttctatttcacccatcaaaattgcattctgaaactatttcagattagcacgttacgtgctcacgctaattactattagcaggccctattgatccacaaggaactgcgaatcacgaaacatccatccgtactcagaaagagaaacaaagggtgcaagtaaaaaataaaaactgcctccagtaaatacctattaaagagtcaaacaacacaaggaatgcgcaacattctagactccaatgggaaccttgaagatgtccagccacgcaacatcctaatatggggaatgtacctattggatataaaagaataaaagaacagatatactgtcaacaatcaatgtagtagcaatctggattattaatttgcagagatgactgcattaaaagatatctgcgaagaagatgaacactggtttcaaagtgctcaactctttcaatgcaatgaggaacttaatatcgatgccaaatcaacaaaatagatatgaaatgtgtagtataatacacttaatttctatcacatatataattcaaaaatatatgagatgtctagtaaagtacacttaatttctatcacatatattatatgcaatacaattcaacaatccgatgctcgttcagttacattttgttcagaccaagtatactgtataccactgaacaattcccagacactacagcaactccaacttttcaaaatagagaatcattgatggtggtttcaatttgccccggactccccttccaatctactgcaatcccttatcgaactaatcgaacagaattcagacaagtagtaggggaaccgatcgctcaccaagtatggctcggagtcggagcggctgctccacgcggcggtgcggcccccgtcagcgatcacgcctcgagtaaccctgcagcttcctctccccccaaccttcggttgcgggagcaatcgatcatcggaaactggaacgattgggacgtcgccaggtaggtcatgggtggagcggcgaattcgagatcgcggcgggtctcgtggacgcaagaggattctggaggaggggagcgagggggtccgtcagggcagaggcggaagcggaggcatggcctcccccgccgcgacgggcatcgccgccgtgagtgcgccggcagccggcggggacgcggggtctcgggaaagagaagggaaaccgatgggattgtgtgcgctcagcgaggccgcatgtctggcccaaaataaaaagcccaggaacgtgtgttcctcattcggcccggcccatttaatcccatctaaatgagcccatctaaccccatctgcgcgaaggagaacgaagcagaggccaaccggagagggcggagacgaatcgccggcccctcctctcgccggcgggcggccgccaggccgggaggtcggccggcgacgcgccacggcgaccaacctggtacgcacccccactgcgacgaacttctcactcttgatgcgaccgttgcaccgacgcctccccgcccacgtgcataggcttccaattaccccaagtcgcgatcggttcagaggcggcggtagaaacgctgtttccgccggcagcgagggaggggcggggcggggctctccccccggatgccgccgtgcggggaatgattccgtagggaaattaaaggggatcgtgttcctccatcccgccttgttccattgctcaagttgcgcgtcctgcctgcatacggggtgatcattatgcttgtggtcttgtgttggtgtgggggaagaggaggaggagggtagccccgcatccagagatagttcaaacaagcaatcaggtgttcttgtggtgttgccatcaatacagatttctctgtctacctgacctggtcccggccgtggcctgacatgtgctgaccttgcgcttggtcggtttgtgccaaattagtagaattgtagccacatggatgctttgcttgcggattgttgtacgaggggcttcttgttttctagtcattgagtccgacgaaattttcttcgtgctaagctattgttctgatagaacatttatgatttgatgcgttgtagtatagaacatttatgatttgatgcgttgtagttggtcagcgtgctaaggcaagttgacggaactggcgtgctaaggcaagttgacggaactgtaggatgaatgcaacttttttttttcgccggatcaatgtaactctttcttgccatgaaaggttgaaagtgggaaaaatgcaagtttcttaaaaaggaagaagaaaaggtgaagaaaacggcacaaagcttcctgcttagtttagcttgcgtataagcctggtagcctacttgatgtaaccaatttttttttagctaagataagatgcatctgttttgatcgatgattttatcgatgtagcttttgacacatatagttgtcgctgatcctgatttcgcacagcgttagtagtttttaataaaacggtttaggggtaccagagcatttccctagcatttcttgtgtataattgtttcagatttttcatctttccgttaaaaaaaatcatcttaaacaataaaaccaactgtttgaagccagggatgatagcttgatcttcaactagttgttctgtcaccccttccgtgaatctggtcggtcaggtgatactattgtatactgcactacacaagaattataacccactagtattgtatctttgtcatggataagacaagtctcaaaatgtatttcatctggttgccatacatctcagtgccatatattttacatgaatgacatatataaatgttaaatgctgctatgccccataatctcaatttggatataatcttccagaagaaatgggattgcggacatgttactgacagacaatgatctgttatgtactgggatgcatttgattgtaagggattcatgatacgtagctggcactgttttgcaatgatcttgtgcagctatactcatttctacttgtccttgttcatgatgtacatctgttgacatccaaaaccatcattttcgaagtgaagagcaagtattttttacagaattagcaggtgccaggttgcattcatgtttttgtttggcctcttgcataggctgcccggaccaaatggtcccgaaatgaactctttattatcctcatgtggtattttttggggaatgcaaggccaaaatcatggtccacggaagcaacatgtcctacatattacccttgcatgtcatcttttgtgaaagttaaaaatagtttcactccatttggataattggatattgatttagaattcctttcatgtcttctgaatcaaatggggagaaacgacaagtaggccgtgagactggtatgaacatccaacttatgtgaacttgattgtttatttctatactctggtttttgttgcttaatgaggttgtactagtatatagttcagagtatcataaaggcctcttgtaagcccagaatttttcctgtgctacaatcacaattcacaggtcacagcgcagaccaaaggtttgagtggagggctataccactatagtacttagttgtatgtttcgtggtgaaactgtagtagaagatagcagctgagcagaggatgatgtgttgatgtgatcgaggaatggtgataatgtatgttctgtcaatagctcctggattcttggatatgtgggacaaaagcaaagtcatgataagaaatgtacagtggttcttgtgcagctcaggaatgttgagctaatggattttatactatatgctatatatattaaatttgttctaatagaacttggtggcttgtgagcaactcacaaacacataatcaaactcaacaattataatgcagtgttatattctcttagagttaagctctgcactttgtactgacatttgcaaatgtagcattcatcgccaatatggagtaatgactatggtagtttactttaaagaacacaatatgtgttctctagtgtagccaaaaattttaacaattgatttcaggtgatcagcatattatagctgatagctagtgtgattaataaatactacctccatattttaatgtatgacgtcattgattttttatccaacgtttgaccattcgtcttattcaaaaaatttatataattatcatttattttattatgacttgattcatcatcaaatgttctttaagcatgacataaatattttcatatttgcataaaaattttgaataaaacgaatggttaaacgttgtttgaaaagtcaacggcgtatatggagggagtacttgacatcattgtgttccacatgctgagatgccttttttttctcattggcaggttactactggagattactacttcatatttgctcattggcatattattagtagatggggactgtttacttcacattgattttgcttgctccatacagaggcagagaatcattatggaggttagtgtattgatgttgtgtttttgtttttgtttttgttttttttttctgctgtgttacgctgaccttgaggtttctagtataggttttagatagtgactcttttatggtccttagaaagtatggagaggtatacatatatcttactgtttaactattttttaaagaagggcaaaagttatgtcatgtacatgtctagattcattaacatctatatgaatgtgggcaatcctaaaaaatctttgtgtttaatcattaagtatgataacaaatcaaagtattttgaagtatgaatctaattgtacaagttttatacactaaatgtacttttatgttaactaattattagtcaaaatctttcacatttgactttctgaaatcaaaatactacttataaaagcagggagtacgttttaaaggctgaggaaaaggcataagggcatcagccccagttccatttttattaaattaagccaacaattcttgtacagtttgagttcgatcagcaccatatctacatttcattaggccatcttaaatagagatcatgtgatctttgtttttttaatcctttggagtatatccctaataaagaacctccatacttagttttggtgcttgatttgaaactactaacgtgtttatgatactttaatttgcacaaaaaggtcttcaatatacggataggcagaatccaaagtactagcataatgcattaaattagaccggcacattatcatcaaacaagcagtaaatgacatttgccatattctggctcgagtggtgctcaagaaagccaggacaggaaagcaagagctgctgaaacatcactgccatgtagtaagcacacagcgacccaactatgtatatatactcctagttgatttagcttatatatatatccatccgtaaggaccctgctacaaaccactaggcgcgcatgcagctccatggctaaaaacactaagcaaacgttcctaacacccagagctaaaactcttgacggctacaaactacatagatcatgagttcatgacagccacgaagctgcattacttggcggccgtcttcttggacttgggcacggccttgtcatggccgtgcgccggcggagccgagttgaggtcggggagggacgcgcggccgccgccggcgggcatgttgccgttgccgttagccttggtcgcggccgccgccgccgccgccgccttcgtcttggcgagccgctgcttgagctcggtgagcaaggcctggttctcctggttcagcagcagcgccttcttgcgcagccgctcgttctccttcatgatgtagcagttctgcaggtacagcttcgcgttcagcctgtccatcttgtgccctgctaccaacaacaacaggataacgaagtttagcagccatgtggcgtcactgtgtggacccctgttttggacttatgttgcggtacgtttttttttaattgctttttcgcatgctcgagtctcatattatatgtactctgctatggctgcagagaggggggaagaaagacgacatcgaagctgaaacagtggactattgtgctcgagatccgataaatattatcctgcatactcagggtgtccctgctttggctacatcctcagaggtactgtaagaagctgctgctatattactttcttattattttcacattgtgaggccaaaacagaatagacactgaagcttctacgtaatcaagaaagtgaattagccaagtagggtcacacttaataatacatatttaacatgctcttccaactactaatggaaaaagaaaacagcttgaacaaaccaaaggtggtactccatattggaggaagcagattgcatgcaaagcagaaacaaacaaaaagcgtgccaagcgcaaaggcgttacgccgagagaaagtggaggagaaggccccattttgacacccccgcgcatgattgtgcatgcatgcaaacaagaagagcaaatcaccatgaaaggaagagagaaaagaaagaaagaaagaaaaaaagcaaaagtgacgggactaatagaacatcacctcctctctgcagggagctgagagctgtgatgaagatgctgctcgctgctggggagttggagacgagaggcgagagaggtcgagcggcgacaccagaggaggcagggtgggcagcgagtgtgaagtgatgcgagaggctgggctactactacctaagctacgagaccggtcgctgtggggcaaggcagcgagaggcaaaaggtgagtaaggaacaacgagaaggagcacgcagtcctgcacctcctgctggtatgtgcgtgcttctcctcctgccttcctgtgcgtgctgtgcttgctagctcgtttctgtggtggggcttatttataggcgcagaaaagcctcccttcccgtccgtccggctcgtcgccgttcgttggtggatacgaagctctttccccctcgctgacgcgcgggccacctaagaattgggcgttgcacgtacgagttagagcaagttcaatagtatagcccactactagctctaattcatctatagccaatttaatagccaattcatacaatagttgtttacaatattttaatatatgatctcacctgtcatatacacattgcctcttaaaatccgtgctgcagctggctacaaatctgtagcccgcagcccgctaaaaatatgtagcccgctgctcttctctcttatcgtttatcttattaaaatatgtttatagctggctaatagcctgctacctgctctcttatggggggattgtcccgtccgctctcatgatcgagcactttgaacgcgagggaacgaggggacggcgtaaatggtggctaatgatgaggttccgtgggggtccggccctcacgtgacggtggctgcgttattctcctcccctccgctgcacaccaccatgccggcaccgtcaccccgcccgctccattgcaccacggcacggctaatctcgccgtctcgtgccgatgtgaaaacatcgttaggccgccgcactcttttccccccttcaacaatccattcctatttattaaacacaaaaaatacgtacgttcttatcaatgcttaagatagttcttctgctccgatatacaaggaattttttttactatgcacctggacgatatttcaaaatataagcattttctatatatctggttagaggaattttacagtacttgaggtacctaaattaggtacataaattttatactaaaatttttagttaccttgagatacttcgtacttagtatctagagatactaaattttacactagaaagtatggtaactctagatactttctcaagaatagtaaaattacccatatgcttaaaaaaaagcttatatattggaacggttgcatagttgaagaatctctctaacagaagtggttatacggctctccatctcaaaaggggttttaatagactatccatatgtgttcccatcccatctaactaactaatccattgctccaaccacgtcttcctctcattcctttcccttcattggatttagacgaagagggtgagatttgcgtttctctctgctatgaatgaatttaattgaccattgaaggcaaaattggttatataacatcgaaagttcacgtttttggttttatagcaccgaaagttaccggttcactttaatagcatccaaagttcaccctgttcccatttttagcacttccgtcaatttttccgtccgtcttgatcgttattgatccagccacacacatgatatgacatttctacccctcattgacatgcattatacttgtacttgtgaggggtagaaacgtcatatcgtgtgtgtggctggatcaagacggacg

SEQ ID NO: 42931 - DNA, 977 bp, Oryza sativa
aatgatggctcatctccgggtcctcgctcatcattccctcctctcccctttttcattttcttccccctcctcttttaccaggattattattacttactgcacccccttcctttaataccaccctcaggtgatcatgatcccctcaccacccaattgaatgccgcacaattgtggcttctccttacactcctctctctctcacacacacacacctccaatttttactgcatgccgtatgactatgacatatccctctcatgtataccttcttttccctccttttccccttggcctatatcacacgcttgttattgatttcaaaagcatcttgatgagtatgatagtgtgattgttacaagtaacagaatctgtgaagaaaaatcctacttgcaatcacaatcctactagcaacttccagcgttcaaaatttgttctagaatatagcaacttttttatcaactttttcatctcaacctatcacaatcacctgccatttaatttcttcacgtactccctcatctttaattaattagaaccatctctgtttaatttcaccttcttagttcctatgaaaaactctaaaaatacttatatttagtaacggagggagtagtagtagtagtatttgacagcaaaaataggattggagctgagaatgggagaggaagaaaaagagaagcgggcaatgatgttggacagcttggagtcctggactctctaggctgcatatataagatagcaatctttgcagctaatacagctccctggcctaaacacaaggcttggccctagcttgcacagggggatccttgtggagacatgcgtggagacagccggattacgcttatgccctttcggaactcacaaatgcaagctggtacttggcatcagatgtgtggtccgtcgaggcacggagaagaggactgcactgcacatactctcaagctccgtttcgtatcagtgaaatttatatggat

SEQ ID NO: 42932 - DNA, 28868 bp, Oryza sativa
gtacatgggcaggggggcagaaagttagatgtgcgtgggcataatgaatgggctttggcaaaaaggcagaacagggccggtcaatgtggcgcatcaattcgccccatggaaaacttttttctcccctcctcccggccaaccataccagctagcacaagaaatccagacacgttggccgtgtcagggggtggtgaaaaattatcatggagcttgcagactcttgagcacccataccccccataaccagcaaaattttcctgcatatacttgcatatgtagctggccaaattccatgctgtgccatgcttgctcacatggtgaaagtgaagagtaggtagcagctatgtagtactactgtgtacactcttgggttgtgttgtgtacgcacgcataatgtgcagtgtagtagcactgtggtaacatagatgggaggagtattttttgttcggtgtagtggcaatgggcatgatggctacactagcctagcaagcggcaagcactcgattaaggtgtggatctctgcgcggcgatacatgcatacacggcgtgcattgctaccttccaaaaactgctgcaaggaaccgaagaatgatgccgtgtttggacgcggaggtttttagacgaattccacgagaaacgacgcaggactacccacatgaacgatcaggaaaattacacgtgttttgatctggacccgctgttgcactcgcagcaaacctgtctggtcagcagatattagtaatccctccgtcccaaaataagtgcagttttacattattcacgttcaacgtttgaccgctcgttttatttgaaaattttttatgattagtatttttattgctattagatgataaaacattaatagtactttatgtgtgactaaatatttttaaattttttacaaattttttaaataagacaggcgatcaaacgttgggcacggatatctacggctgcacttattttgagacggagatagtaactgtgtctttttttattattatttcttgatagagagattaattacaccctccgtttctacaccaatgacggacccaaaaatcttttttgattgcaaatacaacaacaattataaacttcgttaatcactataaattcaagaccttacaatgagcccgaactctgggttgtcgggtcttggatccaccattgaacgaatagcttaattttagaacgaagataaaattatcttgttcttattagggttttacttatcatcgatgaataaccgataaaccttaggtgtgttcggaacatctatctatgataacagcgtaactactagactcaacaagcaaaaaattatactaatggcccctttaaatcgtagggttgaaaaaatagaggaatagaaaaaacataagattctaacaggaaatgaagtgtaaaccagataattgcaaaacacagaaaaaacacaagaatgaggtttgattagaccgcaggaaaaacacaggaatcggatgaaagagatagactcaaaagaaattttccaagagattgaacctcttgctaagtttcctctaaaatccacatgaaatgtgtcattccataggaatttcataggatttggaaagtttcagggccattttgaatcgcaatattgaaaaagtggaagaataggaaaaatacatgattctgatatgaatgcaagtgtaaaacagaggattacaaaacataggaaaaatataggaatcagatgagaaaaatagactcaacgaaaattttctaataggttaggccccctttgattcaaaggaaattcatatgaattttagaggattttatttcaaaggaatttcatagaaattttagaggattttattcctataggaatttttcctatatagccctttgaatcaaaggaatgaatcctatgaaattcctatggaatgtctcttcccatataggttttggaggaaatttaacatgaggtagaacctcatagaaagaatcctttgagggctcctttgaatcgcaggattgagaaaacgtaggaataggaaaaacgtagaattttgataggaatgtaagtgtaaaacagaggattgcaaaacgcaggaaaaacacaggaatgaacgtttgattgaaccgcaggaaaaacacaggaatgaacgtttgattgaaccgcaataaaaacgcaggaattagatgagagagatagactcaaaggaaagttaccaagaggttgaagctcttgctaaattttctccaaaatctctataggattgttcattccataggaatttcaaaggattggattggattcaatcctttgtttcaaagggtttcataggaaattttcttataggattgaaatcctccaaaattcctatgattttcctccaaatcaaaggggccctgagtctttatctctcctcaaattcctgtgttttttctatggctcaatcaaacggtcgttcttatgtttttcctatgttttgcaatcctctgttttagacttgtattcctatcagaatcctatatttttcttattccttcatttttttatttctatgatttaaagggcccgcctctttaaatcgcaggaatagaaaaaacacaggattctgataggaatgcagatgtaaaacagaggattggaaaatacaggaaaaacataagaatgactattcgattgaaccacaggaaaaacgcagaaatcggatgagagagatagactcaaaggaaattttccaagaggttggacctcttgctaactttcctccaaaatctctataggattatacattccataggaattttaaaggatagtatagaattcaatcctttgtttcaaaggctttcataggaattttttttcataggattgaaatcctttaaatttcctacatttttcctacaaatcaaaggggctcttagagtggatgttaaattttctacgtttttcctatagaatcgtaagaacatgaaagttacatatatttttccttttctcatttctacgaatcaaagtcatgaatagtgtaggatttcaattcctttatttttttctccatttttactctaattcaaaggggcctcaatcctttaaaacaaaaggccaaataagaaaatttcctacagaatttaaatcatataaaatttttacataaatcctttaattcaaaaagccctaaagtgctacatcgttgtggctgtgcaggaactgtccagctgaaccgaaccaccccttgtcacagttaggattcgacaaggaaaaccccggttctgacacagcaaattaatgggggtggcaacacaagacgggcacgagcataccctttcaaaaattttcacctgacacatcgaatattcggacacatgcatagagtattaaatatagaaaaaaaaactaattacacatattatgtgtaaattgcgagacgaatcttttaagcctaattgttttatgatctgataatgtagtgctacattaagcatttctaatgacgaattaattaggcttaataaattcgtcttgcaatttatagatggaatctacaatttattttattattagtatatatttaatattttaaatatgtatccgtacatccgatgtgacgtggcaaatctttttatccagacagccatagacggatgcagtccgatagcatcgcattgaagcgcatgcctccccactggttatttggagtcaaacaaagctagagatgctcctccggcccccatcatggcgtggggtggcacggcatgcagccggtcgacacgaagcgagggatcaatgggcatcttgccggcgcgcacgtacgctctcgctacgtgcaactcccgtcccggccatgccatcatcacgccgaatcgccggtcgacgcgcgccagccacgacgatcgacgacgtacgcatcgtgtaaagcgtatcacctcaccaccgtgtcaatgaaacatgtgcaaaccaggtcccactcgtcaaatctcttaaagaaaatgtgtgtacacttcccactactgtctggtagagcaaaaatgcacaatgtagtagtactattacggtcggaagtggattgtttattagtctatgatagattgatagaacagtactcacactcacgatgcacactgctaacgggaggccgacaactgggtcccagtacgaggtgccgcgacttaatattagtaaatgccgcatcactcttcaagtgccgtactggtttcatggtgtggtgcggcacagcacatcgatcgccatcgaccgctctcgcttgctgggctgccgtgcgtgcacgtgagaggtaggagtcacagcacaggacttagctgctgcctgctgcaccggtgcccctgcatccgctggtccgtctcggctaatttgcccgccgcgctacgccctcggccggtctgacacatccccggccgtgttggcgtcgcaacagtgtcgttcatatactactcctcactgcgcagctaaactctagcggtagcagcaaccagtgcgtaggcgtagctagctatagctactcgcgcgctgcgcgccgaatcttctttgagcacgcacggatgacgcatgttctctctgatgtagacgcccccgtgtcagggccgatcgatcgatggatcgtgtcggcaagacgccaaaaggacacgttcttttttttcaactttgctgtacatgcacggcgtagatatggctggagtctggagagcaacccggtcgtgtcaaagccgcactcgatcggcagagccaggagtcggatcgacccggccgcttgtgctcatgcctacccataggtgacatcgctgctactgtagtagtagcagtagcagcgcctaggtcgttcaattgttcaaagttgcacgagctgatcaggaagtatggtaggagtacgtacacagtgatcagtagtactccgtagtagcttagcctgctgcctgccatcgtgacatgatgcacctgagagaaaaaaaggggccaaaatgattggatacgcctttcgctttggtaggggagggaattaattgccggcgacacgtctggtgggtcgcgtcgctcgcacagccggaccgccgatgatggcgcggttgaatataccgctccccgctcgcgcgttgccgacgacgcgcaacgtgcgtgcaaggccggtgtgagacccgatcgcgaccgatctgccgccgctactgatgatgcccgctgctgctgccctgctgcctaattaacatatgcttctcctcccgcgatcgatcgatcgatcgacgccaggacggcgacgacgaaagctggggacaaaacggagcccgggggaaacatccgaacatggcagcacacgtgcatgggcagaggcgaagcgaacggtgcgccgcgcgatcgatcgccatcggacggcccggaccgtgtgcggggaaagtagaggaccgaggttagctggcgatcgagcggcgactgctacctgctccgtttgcagccggccgcagtgcaggacgacgcagcggcagccttcggtttcgcaggatgcatcgccaaagcggggagaaaaaaggcaaaggttttgcagctgcagatcgaacagatggaatgatgatggagagacgaccaaaaactcggaattaagatggccaggagaaaaaggcattgcgactcatgcatatgcatgttcactgtccaggcaggcaggtcaccaatctgatctgatctctgatccgagtccaacccgacaggaccgtggaaggtccgaacaggcgctcgtttggctgtccaggactgtagtagatgccaaggaaaacaagcttggaaaatatcataaacgtgttttgaaatcggttgctcactctgtttcaaaatataaatactttcaatatcaaaggctgttttaacgtaggatttgcgaaaaacaaaaaaaaaatcctaacaataaaacaagctaaaataaagaattacaaaacatataataaatgcataaataatcgtttgagtagaccgtagaaaacacacatagaaatcaaatgagagtgatagatacgaaacaaatttttcaaaagattggagctttactgacttttcttcaaaatctctataggactctctattccatagacattcaaaggaagaaatagtattcaatcttttgtttcaaatgccttcttaaaaatgaatttgctatactacttacgacataaaatttggtggaaaagcaaccaaaattttcaccatggcccgagattcatgcacgggttggagagaaaaaaatcaagggatctgggatttgaaagtgtgatgtgcaaaaccgtcgggcgtttcttcaccaccacacgacggggtcaattttatagttacattataacgggacctaatatatatagcagttatatagtggttacaatattattacagagccaagttacatttgaaatgattttactcaaaagcttgcgaaagcttttaagataagatagtccccttacaaatcctccaaaattttcatatatatactttcttaaaagatgctggtggtggtggcggttctgccactcccatctatctgacaagtgaaggccacaatctatcttgagctcatcattgttgaccaacactgtactagagtgtgaagttctatttgcttcatgtacagtgtacaacacattgtttatcctatcatcgttaatcagagcttgagagtgatgatttagttttaatcagatcatctaatataattagagcccgctacaacgcacggatatttctacaattcaaagggagcctaaaagtaggtttaaactaaaatataatcattgcttgtcatacaaatttgtgagggttacggataaggcataccctctattccaggagttgctagatatacaaatacgatatatcttatgatatacgtaaaggaatatgtaaagtaagaaaatcagtgaaatcgtatgagaaatattcttcacgagtagggccatatacatatcctactcggagaagggaaggactgtattgtatcgtgcggagtctgatatctccgagttctacttggaaaccaagatgaaccatggtataaatacacacccctgagggatacaaggcatcgaatccttagtgcaagacacccaccaccgcaaaagcaatccggagaacttttgaagcctattcgccgatagatcccgtcgagtccctctcgacaaggatctcgtcggtaatcttagagtctatttatcttcttttgtactctgttgttttctttataatcccatataaactgtattagggctattaccttacgagagacctgaactagtataatccttgttttctgtgtgtttgatgccgtatcgtgtagatcatcgtagcaacgtaccccaataccctcataatacggtctacgggcatcccccgtgaacacaattaccttttatttaattttcatctcaccttaccccaatcatccctggttcattaagaacattatactagttcttttctactcaatcttaatctttattaaaacctcaaaagtttttatattttcaaacagacagaatatcactcctctaaaatgaagagtaaaaaacactagaatccttaaaattgtaccgtagtgtcacaatcatcccggtctctaacttttgaaaatgtagatctacgcccctgaactatcaaacatttttcaaaagtgtcatatacctttcggttgttgacatggctggacatgtgatttgtcgccttgactgtctctatgttggagaccaagttacttcatatttatttatttgagtaaatatcagaaaactacaaatacttcaaattatcacaaaagtataactttaaggtgatgtatgacaaaactacagatttaacaataattttataacaaaactatagatttagtaacaaagttatcacaaaactacagattttggagtttaccttcgcactagtgttatatttgagttataaacatctaagttttgggattgaattgacactaaacctatagttttgtgataattttgttactaaatctgtaattttgcgatgctccaccttatatatgtagttctccgagaaatttaatgttaaatctgtagtttttcgatgcattaccttaaatatgtagttttatgataattttatgaaagttcctatagttttgtgaaatttactctatttatctttgaagactaagccaataagtcaagtacgtgttacgtagtcaaaatcgctctcaataatgttaatattgtcgaaaaacttgatttgctctggtgtagaaattggaagttgttctacttagtttgtggagtagttgagcgatataaatgaaactcggtctatagttgagctatataaactcgtcaagtggacttttttccataatttgatctggactctgtagaggatcaatacatcttccaacgaacaatgcaagaacgcgcatcttaaaaaaagaataagttcactttgactctctcaaatataggtccaatcttattcgtattccttaatcatgctggatattttgatccctaactattaaaactgatgtagtttaactacctcgatggttttgagagtgattttcgctgacatggctcgttgataggtataaccgactgagtcagcatatggggcctacatgtcagcgccacctctctctctctcttcttgtccgcaacgtaacgtatcctcgcttactccgctacgcgctttagcgagtccagctggggtagtcggtgacgtcactatcaacgtcttcaacgccgacgagcgtgggcatgggctcaagggcagccacggtgccatcgcccgtctggagcaggaagtagcagcggaggaggcgtcgacgctggggtcaccagaggcaaataggtgctggccttagagaaggtaatgatggcatcgaggagagtggtcgctgcagcaaatccagccgtgccgtcgctccgcctcaggtcaagttggtgcccagctcctagcccactgtgcttcctggtcacgctccccttccccatagcctctggtagaaccactgccacgactactttcccgcccggtgataggatggtacgagagaggggagagaaatcacatccgtcgcaacaagagatggaatgcatcttgcctccctgagcacaagctgcatgggagagggagcttgccggattagggatgagcgggtgagcttgacaggacacgttggtcgccaccgccattgtcttccttcccgcagacaagcgggtgagcttaagctacctcttcgccggagaaggtggccgccatcctgggaagcagctcaagctcgacggtgttgccccgggctggtgcaaagcttagagaggaggaaacactaatatgtgggccctagagaaaatcaccttcaaaacaatttagtgagtcaaattacaccggttttcatagttaaaggatcaaaatattcggatattgcagttgagagatacaaatcatattgaaactgcctatccattttgttaggtgatttctaacaaaaaaaaatcacccagattttttttacccttgcatcgaatggactataaaaaaaataacaaatacatatttacttacataatatttttatcaaaattacagtgcacttacatgtcatatcaactaaatttacaaatgtaattttggttatatatgactgtaattttatattttaaataaaataactaatacatatttacttacacaacatttttatcaaaattacagtgcacttacatgtcatatcaattgaatttacaaatataattttagttatataaggctttaattttatattttattttagttaaaaatgtcttaatttttcaacagttaaagaaatcaatttttatttggaaaagaaagggagagagagcgataaggaagcaggaaaagcaagagcaagaaaaaaaaaagcaagaaacgtcattcgcgctgattcctccactaatcttgacgcacgatcctaccgccaaaaaaaatcaaatatcagagaagaaatcactcgacagatgtttagcaaaatcgaatcatattagacatacataccaatatatgagggtgtcaaagtggactttttattcttaaaaaaacgactgacaggcctacagaggaaggcataatcaatgcggaagtgtttcgagtcatctcatcacatggtacgttgtgttattcggcctataagagcccatttatcccgaataggtccccagaggaaaaaaaagaaaaagtacaccgaaagtccctcaacttgtcatcaagttacaaacgtcccccaaccacaaaatcagatatccgacgtcccttaactaatcaaaaccggtcataatatatgtcctttgatggttttgaccccggttttatcctacgtagaggctgagtcagcatgagacccacgtgggccccacatgttaggccgagtcatcttgctcccccttttctcttcctcggttcatcctccgtgcacgcctcgtcggcgatgctggcatcgaacacctcgatcatccactcctcctgcaccacggtgcgcacccactgcggcatatcgacgtcgtcgatccttggcaccacgttcgtcggcggcttccccgtgagaatctatgacgagccggcgccaacgccatcgccgtagatgaatgccacaccgcgtggggccgccaacgcgatgtgcgcctgcgacgtgaagccgaggcgcacgcggcacacagcgctactgtcgccgtggaggaggaaggagaggactccagcgccgacgaagtacgagacaagaagcttctcgttccctcgcctcctccgccgccgacccggtctcccccatcgccctcgactcgctcccttccccttcacccgccgttcccatccccacccccgctgccgccgccacccacctcgccgtcgtggcctacctcgccgtttccgcgcctgacttcgacgtcgcggtggggccctcttcgcgcgccccagcagccgcgcgcgccgcgcgatcgaggagggtggggccgcctcactcgcctccgacgaggccgatgccgtggcggaccagctcgaagccgtagtggggaaatcattctcaccatcgtggggcgaccgggccgcgacggaggagcagtcctcccgtgtagcccacgacctccctcctctcccgcctcgccccggcggcatcctccccagccgccggccgacttgtccatgtggagaagagaagagtgagagagagagaggaggaagggagagagatgatgtggcaacctgacatgtgggacccacatgggtctcatgctggctcagccgctacgtaggataaaattggggtcaaaaccaccgaaggacttattgtaaccggttttaattagttaagagacgccggatatctaattttatggttgagggatgattttataacttgatgacaagttgagggaccttggtgtactttttccaataaaaaaacgcttgagttcttgttaagagaggaagagaaggagaaagtacatcaaaggtccctcatcttgtcatcgggttacaaaatcatcctccaaccacaaaaccagatcgtcatcctccatcttataaaaccgggtcactttgggtccttaggtggttttgattctggttttgtcccatgtggcagctgagtcaacctgagacccacgtggacccacgtgtcggggtgaccaggtcatcacccctctccctctctttcccttctctcgcttcatcctctctctctgtgttctcatctgggcaggcggcaggccggccgacgggtggggaggagggccggcggggcgaggcgggagaggaggaggtccggcggccggtgacgggcgacgcgccggcggcgacaatgcaggagcaggagggcatcggtggtgggagcacaaaggagcgcgaagggggagcatagggagggccggagccgggccgaagcatgggggtgggtgtggaggcggaggcggggcctgtctgagagcgactaagcttcggctcatcaggcaggaggcgacgggcagggatttgggggaggcgaggtggtggagcagcggcaacactcgcgcggggccaacttggcctactgcccctctactgcgtggcaggagtggagcggcagcggccggcgggagagggcagccgccatggctccttcaattaagcagcatcaaaccactgcccaatccccacttcaaaccatgtagtgctcgccgccgcctccctgcgcccggcccgtggtcgagagtgtcagtcccagccaggcggcgccatccctggggcattcggctcaggccccgccacggtcggtccctgcgcgaccaagcggctcgccacgaccgtccccggtggcgcccctactgcccccgctttgtcggtatccgtggcgacgagcgcgcccgtgctcgccacgacaggcgcctacccggcgataccagcaggatcacagggcacctcagcctgtgcacacgacgatccacccgtccgttgttgggtattttggtggaggagaataaatagagaaaaccgaaaagcagcagaagtttctctgcccaaaaatattcagagaagagtgctctttcttcagttttcacgtttcctgaaattcttcgactactgttgcggtcctgaaatattcagggaagagtgagcgtgggaaactgttttaaacactcgggtggacgttcacccgtttctcgggtggacgttcacccgtttcttgcatgtcatctaaatggttatgaaacattttcaaaaaaaatgacataatatgttaatatgcaatatatcacttcacaaacatacaagttcaaattcgacttctacaagttgtaaaaaaaataacaaatttaactgtgaatatgtgtatactagttagaatttgatttgttatttttgttataacttgtagaagtcgaatttgaacgtgcatgtttgtgaagtgatatattacatattaaactatcttgtgaattttttttggattttttcataatcatttaggtgccatgcaagaaacgggtggatgtccacccgagagattagaatccatcctcgagtgagcgtgagcgttttcagtttgatccttgtgttttgctgacatccgcggtcaccgccggcgtcgccggtcaatacatcatccacgcaattgttttgctcctctgtcctcttccaagaaaaccacgcaagggagctccgcggaaacgtcgccgccaccgatgagatgactacaagacatgacttctgctccatgttcttctttcgcagcagccgcgaccacgtcaatgtccccataagccaccatcctgccgctaacgccctcctgctcccgcgttgcggcagggcgaggcggcgtcggcgagcgagcgcagtgtcggcggcggctgcgacgtgaggcgacgctgcaacgccgggagcgttgtagtaggcgttgaggagcgccgccgtggcctcccgcagcagcgtccgatagatgtctcccctcccgtccagcgcctcccgcagcgtcatgtcggggccgtacctctgcgtggcgacggggccgaacaccatggccacaggcggcgagggtgagcggcgccagatgggcggtaggcggcgaggcctgcggcgccagagtggcgggaaaggggcagctggcgaggacatggggggcggcgcgaggcctctgcttcctgctcttcgcgacgtcgccgccaccgccgccgtactggagcagagctgaatcctcctcgtccttcttcttttgctccggcttctcaaacgtctccgccttgaccggtgagcgccacatgccggtgtcgcgtgagagcatcaggaggccgagcgcgacgtcctcctgctccttctcgaacccgcccagcactggccgcggtggcacgggcgccgacgccgcccatcgaccgccacctccgcctccgcgtgatcacagtcacgtggggaggaaaggagagtgagaggatgacgtgccatcctaacatgtgggcccacgtgggtcccacgctgactcagccgccatgtcagccaaaactggggtcaaaaccgctgagggacctagtttgcactggttttgtaagttgggggatgcgcggttttgcggttaggggactattttgtaactcgatggcaagttgagggaccttcggtatactttttccaggaagagaaaggtccggataatgtgcaaatggaatattgcatcggtatagaattgccttgccatggcccacaggcccagtaggcgatagtccaactagagcccaaaaaaccggagttcagaagttctcgcaaattccgaaggcttagcccaactcaacattttgctgtctcgcgtttccgcggcatatctccatcagctttcagctctctgaccagtgccgcccactacccagcaggcaaaatgcttgaagcgaagtatcaggtgtgtgtcagttgggtctcgtgcggtgaagtccccgctaagcaaaggccaaagggcgagaggatcccgtacgtggagtatgcgaacgccgcatcgctctgcggtctgcaccacacagacacaggtaacaggttgctctcccactcacctttgtgcagcgcgtcaagcgaaagccatctcccattccttgacgccatcggcaacccgcgccgcgcgcacattgccgtagcccaaccccacgctatatggtcccatgcacaacgacgtcgccggtctcgggttgcttccacttgcctagatacgacgcgccaaggaagatgacgcgtcgcgctgatgatctcctggttgccggaacgctcgtcatctccatcgtcttcttcaggtgcgccgctgccgtggcagccaccgagtatgtccggcctccccccgggcgggtcatcttcactgagcacaccaagcccgcctcacatcctcaacaggtatactacgtacacaaatgcgagttcttgaggatgcgttctatattcgtttagggaaatgacgatcgatgattgatccgtttgtatctaggttcatgtgtcgctcgtcggggcgaaccatatgagagtgtcatggatcacggaggacaagcacgtcaagtccgtggtggagtatggcaaggtctccgggaactacacggcgtcggccaccggcgagcacacatcctaccgctacttcctctactcctccggcaagatccaccacgtcaagatcggaccgctggatcccggcacggtgtactactaccggtgcggcatggccggcgacgagttcggcctcaggaccccgccggccgcgctcccagtcgagctcgccgtcgcgggggatcttgggcagaccgagtggacggcgtcgacgctgtcccacgtcggcaggtccgactacgacgtgctgctggttcccggcgacctgtcctacgccgacgcccagcagccgctgtgggactcgttcggccggttcgtgcagaagtacgcgagccggcggccatggatggtcaccgaagggaaccacgaggtggaggccgcgatggcgctcccgggctggccgcggccgttcacggcgtacgccgcgcggtggcggatgccgtacgaggagagcggctcggggaccagcctctactactccttcgacgccgccggcggcgccgtccacgtcgtcatgctcggctcgtacgccgacttcaactcgagctcggagcagtacaggtggctggcccgcgacctcgccgccgtcgaccgcggcgcgacgccctgggtcgtggtgctgctgcacgcgccctggtacaacacgaacgcggcgcacgagggggagggcgaggccatgaggaaggccatggagcgcctcctctacgaggcccgcgtcgacatcgtcttcgccggccatgtccacgcctacgaacgcttcgtgagttcgattttgatcagcgccattgctcgaacggttgatcacacgtacaattctcaactaagcagtgcacgtcttgactttgtcgctgcagacaagggtatataacaacgaggcgaacccgtgtggaccggtgcacatcaccataggcgacggcggcaacagggaaggcctcgcatttgagtaagcactaaacattaacaccggcaaaataacttacaaatcttgatagctaaccatagctcacggctaaatctggttggatatcagctttcggaagaaccacaagctggcgccgctctcgttgatgagggaggcgagcttcgggcacgggcggctgagcgtggtgaacgcgaccgccgcgcgctggacgtggcaccgcaacgacgacgccgactccaccgtgcgcgacgagatctggctggagagcctggctgccaacggcgcgtgccagcagagtagcagcgccgccgccgccgcggactctcagaacgacgagttgtagcattgcacattgcttgatattaattcaacaaattaatttgatagcgctcttaatttgcttgtcacgtgccggtgaacctgggtgcttactttacgggcaaacaatgcatttgtaccatagtgtggttagtggccagtagtgcttaggccggcggcatttgccgtgcctctgatagctagaacgaacaacttctgtgcctgtttgtgggtgtaatcatggttgttaccattccagatttcctgtgtgatgtgctttgcacgctagttctgcctacccttgaactcaataattaaaatgttcgtccatagacacacggtagtcatatatgtgcgcggacgcgctagcttgttaagaatttcgtatattggtgtggttgggcaatgcagttatgactcatcgaagtagtggtttcccaaaccgctggagccagattaccgcgccctgtcggtaagcactgtaaccgcggtaaccgtgacaaaccgtatagtaaaatttattaaaattttaaattattttttaaatttatttgaatttaaggaggttaccacggtttttctcttactgtactctacggtaaccacgcgaaccggcggttttggaaacccttcattgaacttgaaccaatgcataaacagcatatcagatcaatcagagaaaccagaagctagaataacaattagagacagtatgtgacaaaaaagtattggtcaatcttacattgtgtcaaattgtgaacgtctgtgtacactactaaattgtcaacattagtagtacatatgccggcttggcggccatgacacacgacgggacggggtcgccggctcgccgccggggcgcgccgacaccggccacctcgcgcaccgggtggcgcgctcccgcagccacgcacggccggtgcacacaccctgcgcgcgtgcagcctggtgtagcgcctactccccgacgacgaggacgtcgacccggcgtcttcgtcgacgccgcatgagccggcgccggcgcaggaagaggaggaaagcgaggaggccgagcagcagggcgaggcggcggagttggcgtccgcgtcgccgccgctgccgccttctcgtctcgcgtgcatgcgctggcgggagccgaccgcgcagaggctcatcctcgccggtcggccgctgcaatcgctgttgtctcctctccgccggcgaccctccaacctccatcgctgctcctacccttacgccatggccggcaacctcacgaccagagcatgcggcgttatattactgtaactccgctgcgaaagcaagctgtcatcttgcagcgaagcgacgcaaggaatacgactaccaggactggatcgagttaatggctaatggtgatcgcctgatcggtaacgatgctatgtggctcgcgtcgcgccgagaagagggcggagatgatcaaaaggcgtcagcgcgaggccggaccaggaatccagcagggagacaggggtgcgtggcgtttgtttcaaggttcggcaaggaatcccgtcgcgatacaggaccggacttctgaaaaggagaacaggaccagacttcgttgatgagagggcctgcaaagactgaacggatttttgtttgtcacgttgtactgaaccaaagtgcgctggggtcaaccggcaaactgatcaagttggttgcatctccttttttttttccagatagtgaatacaaatgagtcatgacacacataattgtttcaatttcagaatttcttagcagccactacataaatacataagcaaatagagtacgtaacaaattaagcttcagtgttcaacttttattctcaaacacgattacaaaagaggatataggattgcaacgacacgattttgaagtttgaaccgggcaatctcatcctaaatcacggcactgacaagtgagaaacactttgttcccttcccagcgtttgctcgttcgacgacgactaacacgcgacaattatcaccaaatcttttattctttgaactaccactaataaccgtagcagcagctaagcacgtatatattactatattagtttatataggtaattaaacaccgagaaaaaacagctctacgacttcgctttctcacctcacttcttgcagaccaggccggcgctgcccttcccgctgccgcagagcgcgtcggccggcgcgtcgaccatgccaacggacgaggcgagcgcgccgtcctcgccggcgaagcgcgccacctcgcagtccgtggcgaagatgtcggaaacggcgtacttcccggcgctacccatgaccgggatcttggcgcccacgtccacgccggcgctgacgtagtcggggcggtaggtctggcccagcacgccgtgcacgtcggcgctgatggagtagaacttgaacgccacattgaggtgggcgaggctgtcgtcggcggtgaggccgtagccgtggatcctcgagtcctcctccgtgacgggcaccgcgttggcgacgatgcggaaccggccgtcgaggcgcaccaccacgccgttggccgggccggtgcggaagaccgagagcgccggaacggaggctgggctccagctggcggcggggacggcgtccagctcgacgggcgcgccgtcgaaggtgatcacgaggcggtcgacggcggcgtcccacctgacggtcctcctgacgccgaggtagaggcggtggccgccgaagcggatgccgagggcctgcacccaggtgaagtcccgtgccgccgccgcgttgcgcttgccgatgaagtgcgcgttgatgtgcaggttggcgtcggagagcaggcagaagtcggcgtccttgcgcccgtggaacaggaacttgttgccgtcgccgccgacgaaccgcgggtcgtagcactccgtgccggtcagctcacacactgcatgcaccagtcacagtccaaaacccgacatgcaaaaccgatcatcaaaaaccaccccaaacgtaacgcgcctacctactattaccatgcatgatatgcattctgttttgaactttttgatgcgttttcttacggcagacgagcttgcaggtggggcagtgaacgtagcacatgtcgcggcagccgcgcgggcacgcgcgcggctcgaccgtgcagtcggggcccgacgccgtgttgttctggttgtagcagctcgccacggtgggcgacgagccgggggtcatgtagatggggatcacgttggggtccctcaggatggggctgtccgggctcagcggctgggcgcccaccgcgacgacgaggaaagcggtggcggcgagcagcagcgccgccgcggacggccggacgggcaccatctccggtgagagattgatcgagccggtgagatagttgttaggggggtgagatagttgttaggggggtgaacgcacgttagtggttgtgatacgatggaacaggctcgcgcgcttttttataggcggggtctattggtggcatattgagctctgaccaagcgtgtgtcgttggaattaagcatggctttttcgccaatcaagtctggggaagtcaacttctctctcactcgcgcggcgagctccacatgaaacgattccacgcttgacatcccggccaacggaatgcggttgcttgttcttgatcttggtttcgagtacaatcttctctacgttatggcaaccgcaggatccacccttatcagcctgttccaaagttatttatattttccttttctccctaactcacccttatcagcctgttccatagttatttatattttcctttcctccctaacgaaaaataaagtgtttatctgcttgtccatcttgattctaacgcaaaaacgtaaatccaatactcccattcttccaatactcacatccatttttttttttgggggggggttgggttgggggggggggggtacctgaacaatctttccacactagacttaaacgccgagaatatgtcctaacccaagtgagcatggccacaaaggttcaacgaatcttcaggaatgcggttttgagtggaataactgatgaagacacgagtacggtgtaatcttcatcgtgaggcgtaaagcatgacctgggacgcacgtgttattgtccatgaaaacacactagatctcaagttgctatcttgcttcaggatgttgctccaagaaatctaataggctattccggatatctggatcaatgtacttcaacaataccgtactggattgagtgtaccagctaattagtaattactctactgacaacgaaaacaatccaggcaatagtggaaaaattacagatcatttggttggctatggtaagttcacaaggcacagcaagatgtatgagtgtattaggagcaatggctccacggttttgacttcctggatctcacattagactcgcagctatgactgtgtttagttactgaaaaaagttgaaagtttggggaaagttggtagtttggaaaaaaaaaagttaggagtttatgtgtgtaggaaagttttggatgtgatgtgatgtgatggaaagttggaagttgggggtggagcctatgtataaatgcaaattgtactggttagcaggtgcgattgttggtttggagacagcatactgtggaaaggaacgagtgcatgcccatggccaataatataccatatgctacactggtttgcaaatcagaaaacgaaaactaacctaccaaaggaaccacctcttcctgactgcaggagttgtctcttgcactggagaactttggctccctctttttacgattccactgttcagcgcttccaaccttttcctgcaaaaaaaaacaatgtaaaatggaacagcaaaaacacaaattggcatgcaaaatagaataacagagaaaaaacaacttggcatgcaaaatggaataacagagaaaaaacagcttggcatgcaatatgaagaattaagttcatttctgaactcaaataattcaaaagttcaactggagtgaccagaaattttgaatgcaattcctttgtatataatttgttcagtactttatgcttataatggggaaatcatgactggaagacatcccagaaataaaaaggatgaaggatggcacagtgcttgaaaaacaacccttcacaaggctcagcacagacaaccacataaaaggacacccatgcctacacatgggagactagggttgtaacagcttcatttcatctgaagcagatcctccacatcaccaaaaacataatgcattaatgatacttcagatgtaaatttaatctcaactgcacggaaggaaaaaaaatgacaagccttgttttttatatgtatatattgcaattttaatccaccatctggatttgaattaataaattattcaaatgcatacgaatagttaaaaacatggttaatcaccataggcccactagcttcttaatattcaaattccacatttacaaattacaagtgagctctttcgagtttcaactatgacatagatgatcacaacgcatgaccaatacaaagtttaataccttgtgtctccaagctgtccatgtaagctccatctttggcgaaatccttccatgccctcaagtccactagcaagaatcatgcgcctataatagaaatatgaaagcacatacaagcaaaactgatgaaatcgtgtggataaatcattagaaaattcagaaaatccaatgattcattttgtatggtgctgaattatggttacaaggtactcttacaagtgtttggccttattcctggtgatactcatagactcataggtctgtcaagcacaagaacaagtacaactcatcggaacagacaaccgcgtgtggattgtgaggcctaggaagatcctgcctgtagtctatcaggcaggaaccacgtagttctctcatatgccactaaatccccagagcagatgcaggcaattataagtgttacacagagcattaggttaagcactatacaataaccatctaggaatctcaatctgaaattcagtatagtatatataaattatttacgtcgcctttctttatgcagtctaaatggccattttcgtttgatctcatcaaaatatatggccttacgtattaccacaagaaaacaggcgcaaggacatactcttggaatgtctagtacagtatctcttatttaggacctgaacacttcacacgggctcacaacagttgaatgttaatcaggaaactgtataaaacgagctgctaatcacactttgatcattgaatacatgtagggtagaagtgccatgtttggctacctttcaagcagtgtgatttctgattggagttgggtagctctttccttagcttcttccaggggcattgaaaaacccagcttatattcactatcctgcagccgctctcttatttccttgtcctgtaaaaataggagataaagtaacatgttaaacaataagggaaaatttacctgccatttttcaaataattataatacaactgacccttttctcagcacattgtcggtatagtacaatttcatcttggcaaaacggctcaatatcattgatttgcagacctgtaacatataattgctttattatagtacttactacatatggagtaaggaaagcatgatttttatgtcagagaaatcagtaactcacataagaaaagatttttgagtatgccatcacaaatctcaacaccgtcaaggacatgtgaagcaatttcctttggtatgacaggggatggcaacccacgcatgagatcatcaccaacaagaatggtctcttccatcgtttcctgcttatcgactgttgaaaaatatgtatgaaaaactaccatcatttgcacagggccacgaatagaagttacacttgaaatgcacgaacttggaaagtaagatcaggttctctggcatgctggttatactgcatgatactgactagagagttagttcctgactgtgccacagtggtttattaatgctgaattgctgatagcataggtctggttcttgcatgatcagcaaaagtcatcagttttttatgatcgagagaaaaaaaagagagttatttcctcacagttgccattacgaacttcaaaattaactcaagcccaggcaactacaatcgccactaagcttgcattaacaaccaactgcacaacctatgtgctaaaacacaatttgatcctccaaactttttaggcggtttgggcaagagaggatgaccaagttttgttaagatttacttccccaactgacacaaaataaacaaagcttaacgaaatgggaatgggcaacagagccagcgcgtgcgtaccatccatgattgcctagtaaaccttcacctccggagaacaatcagattttggcaactcgaaccgacttcttgcagccaacaatcatggaaaaaaaaacaccagaaaatgtcagcttcgattcgtcttaggggaggcgacggggagcagcgtgggacgaatcacatacagatacaccaaccaaccggagtgtccgcgacgaatcccgcggggaaatagaccggagaagaaccagaaggcggcggcgagcggcgaccgacggcgcgccgcggaggtgaaggggaggaaggagaccggaggaggagagagggtttacggctcaggtttccccaactcctgccgcttgtgggctttctccaacgaagatatgggcctaaacagtggcccatagacttgtcttacggcccatttatcgatagcccagtgcaggcatgaggcatgaggcacacggttcaggtttgcttttctcgagtaccagttcaaatttcaaaacaccgagaaagagtatgctttctactagtactatgtttgatcggctgcttactgctccctccgtcctaaaatataagtatttttagctataaatttaaacacatagctaaatgttgttatattttagggcggaacaacggaggtaatagtaatttctggtgaaccacgttttttctctctattttggattgtgcctgtcatgattgtgttttaccatgttggctccattttcctcgtggttgattcattagcaggctgttttcacaccatgatatttctgaaaaattctgggctgattttcagttgtgagatggagtatgactgtatgagatggcagaaacagcccgatgcctacacgatgcccgctttgctcttgccgtcggagcagcaccgcacgcatccacgtagtcctgagtcctgacaatttgaccgttctgctaacacgcatactacacctgtgagacctcacatctgtctcaagtcttcaggacagaattgtctgttatgtgttcttgcacagcacctggctacaagcttccaactcgcccgtatgaacttctctgaaatggatcgctgcatgaatccccttactccgatccggggggcttcagtgctactaggagtgttgtgagatctgcaaacagtatctacacactggcctcttgttaacaggagctacacatgcttattatcattactcatgagtgggcattttgctttcctttcctgactgtccaacaccaacatctccacttgcaatttgcagactcaaactgtatatgtctgtgtctacctaccactgtataatgttttgtgaaattcaaagaactgataagtaccggcctgttgggacatcatgagaatcgacaggtaggccaagtacattgctgaatgttgattattccacaccgttcttggattctcgatcttatacgaagttttattttatctcaaccagacgatgatacaattctgcaaccaactccatggctccacctccatactcccatacttctactcatagttgataccatgatactatcatatcgtgctttcattgtataccatccaaggataccagcatgtattcaggctactgtacgtacgtcacaggtcatagcagctgtttccttgggtacagccaaaacgactccatcaagcaggagcacagatgcatttgtaaacgccgtacttgtcttctcataaacacaagcagtacacagtacactccttaccatctgcattagtttctcgcctccggttaatttccagcacagtgggcggtgaaatttttggtgatcaatctctttgcacggtctctcgcgccctgtccgacagttctgttttagtggtcaatccaaatccggcccgctcgtatgcatgcaggtaatctctctttgtgttagtatttaacaccgtgaaaggaccacgcaaaaaggcagagtttcgacagaaaaaactctagctggttaatggcgtgtgtgacgcctcacctatgcgtggctgtacacgagaaaattagtgccacccttttcaatctataggtaagctacaagtaacgttaggtgatgtactgatgtgcccgtgttgacctgcgtggcatgaaaatcactgctaacaactggtctaccacatatatagccgaagcgaattatggcctagctagcgagatagatgctgtaagtaattaacaagaaataaaatggattagttagtacctatatagtctagagatattacgacgttggccgtgccaatctcctgtgttactgtgtgcgcccgtccaaacttgcaacgctcgagctgagcagatgatctgctgatgatgatgagagctgatgagctgtagagaagctagaggcaggcacggcgccgtggaacacgtcgatacttctcctcgcggagacgaaggatgcattgcgtccgctgtacacgcccatgcgctgtcccccggtagtagcagcggatcgtgacatcgtgttgaaccggcagaaacatccaaaacgaactgatactactagcagcagctagtactagtattattagacgagagggccccggcaccagtcactgcaggttaagcgcacacggcctcgcgagtctctgtagatatgcacgatccgtcttatctcttctctgctcctgaggccggccgtgagaggtttaacgggattccttcgttggtgtagtagtagacgtgtagtcctgtttgcctcgcggtcgcgggctagccaaaaaaaaaaaaaaaaagccttggatacctccgcggcggcatgtggcacccgccccacctgcgagcgcgcgtgatacgcgtatttgtgtgtcgcgccttgtccgcatccatccgacgatttccgatccgatgcagcgagcgaccgcgcgcgcgctccgccccgcggcccgcgccaacgtgtgcagctgcgtttccgtgcgcccagccccggttgcgctagccgctgttgctgccgtgctacgggcctacggcgtactccttcgtccaaaaaaaaatcaaattctgaatttatgtgtctaactttaaccatccgtcttatatcaaattgttttataatttgtattttcattgttgttagatgatactccctccattccaaattgatctacatatagttttttaagttattcctaaatgatctatatatttgtgtttatttattaagtctattcgttatttgtgcattggagtaaatggacatttatgcatgcatccatgcacacaagtatttataaaccacatgcaatatcttgatttactattggctatgaaatagtagagatggtgcatgcatcgattttgttactagagtaaatatagtatgagagatttattaacttttcttggtcttggtgtacctatgaaatatgtagatcaatttggaatggagggagtaaaacatgattaatattttatgcctgacttgtctttttaatttttttcatattttttttaaataagacggacggtcaaatgttgtacacagaaaccggagtttgtctttttttagacggaggaagtacgtcgtggagagacggacgctcggggtgcgggtggggggggggggggtccccggcacggaaggagatcgttgctgtggccgagagcgatcggtcgcctcgcgcgctttctttgcctcgttgctgtggctgcgagcgacctttccgtacgactaggagaagagaggaagagatactcctcctagtagtagattccactctacgggaggccagccggggcccccgttttgacacacggtgaaggcgaacgatccccctgtttccgcggtacgagtcgtaccgtacgcgcgccgcggtggatgtgagggtgaaacggctagcgaggctatgcaaacgagcaaatcgtggttggctggtacacggttgagccgacacgagctcactgatcagcaagccacatattgggccatttcgatcaggggatgacttgtttgatgagaaaatttaaagttcgcttggactttatacgagccacgctacgctagctttcgccttgtttctctccaagagatgacgtgcatgctactgctcttgtttaacttttcgaacatgatctcttttttgaaagatcaaacgcgatctcaacttgtggctagtccggtagtaccacggagcgtccgttttgaaatgctaaaaaatcgttgataatactccctctgtaccaaaataagtacagttttacactattcacgttcaacgtttgaccgttcatcttattttaaaaatttgtatgattagtatttttattgctattagaagataaaacgtgaatagtactttatgtgtgactaaatatttttaaatttttcataaattttttaaataagatggacggtcaaacgttgaacactgatatctatggctacacttattttggattttggtacggagtggtatatgccaacatgggagtggttacatcttcaggcggcagaagaaaatccagaggattgtgacgatcgaggtcgtgcacagttcaaccaatatactactgcttcgattgtgatttgcgcacacattagtaaacaaataatactgtactgtactagtttggattcgtctaaaaaaattaccagtctacatactatgagccttgttaattttgatgtcatttttaaccttaccaagttttggtaaagttgttaaaaaattatctacatttagtttgctgctaaattttagtaactatataaaaaatactactaaaattttggcaagtgcaataggtttttttttatcaaagtgaacatgccctataataatttaataacatactgtactagtatcaacttgcagttggtagtaccgaacaagtactacaagccatgcttgcttttctagctagtcacctgaattcgcaagcttaaaatttcaaaacaccttaggcaaactgacatatgggcccatggaaagaaaacaagaagaatggcgttttattggttactactaaccataattttttacttaactttaatcgtccgtctaatttaatttttttaaaaaattaaaaacataagccacgtataaagtactacccatattttattatctcataaaaataaaaatattaattataaaaaaatttcaaataagacggaccatgaaagttgaacacggaaactcacggttgcacttataatgagacggaggtagtatccattgtttttagagaacagaacaaaatgaaaactactcaactattgaaaaaaatcattaccgacgtaacactaatttagggttgcgtcacaagt

SEQ ID NO: 42933 - DNA, 2084 bp, Oryza sativa
cgtcgcggatgcacgcgcggtggtggtaggcagccaaagaagtttcttgggtcggggaggaggaggagggagggagggagggagggagggaggagaggtggcatgaaggacttggtgtcgtgcttcagcgagcacgccgtccggatctctgacgtcgcgtgctccggcagcgcgaatgcggcgacggtgtcggcagcgggtgttgctgcggcgggggtcggtgatggtggcggcgcggggagggcggcggtgagcgcggtgacgagcgtgtaccggtcgcggctctcggcgtccgggaaggatttggtcatcgacgtgacatggtcgcgggcgcccgacgggccggcgctgtcggtcgccgtgcacgacgccgcggccgcgtcgaggctccgcggcggcggcggcggggccgcgggcgcggcgccgaggcacctgcacaggaggaaagggagcgggacgttcaccgccggcagctgcgtggtgggcgtgttctgggacttcgcggcggcgcggtacgcggcggggcccgagccggtgtccgggtactacgtcgccgtcgtggccgacgccgagttcgtgctcctgctcggggacatgagccgcgggtacgtggagcggctgcacggcgggataccgatcgccgggtcacggatggcgcggcggcgggagcggttcgtcgggtgcgggtgctggtccacgagggcgcggttcctggagtccggcgccgagcacgacatcgtcgtcgcgctggacggcgacgcggaggcgtgggtgaccgtcgacggccggaaggtggtgcagctccggcggctgcggtggaacttccgcggcagccacacccttttcctcgacggcggcgcgccggtggacatgacgtgggacctccacggctggctcttccacgcggccgacccctcgccggcctcctcctgcgccgccgtcttcacgttccagacgcgcggcgcgtcggagacgaagttctggatagaggacgacggcgacggcgacgacgatctggaacaatctcagccaccggctgcgccgcgcggcccgaaacagaagctgggcggcggcggcggcggcggcgctccgtcggggcagggattctgcttactgatccaaggtttcaggggcgcatccaagatcgcttgatctgtataaatgccatgagagattcgccattctttttcacttcttcttcttgcttgcgttgcttgggattgtagtatcaaaattcgacaatgggtttggtgctaattctcgttgattaatccgatgcatgacacgagtgtgaaatgtaggagtagaaggggaggcttgacatgtacaattggggtggtgtgtttcgttttggtttgcttcgtcgccgtgcagatttgatatacatgactgtaactgtgtcctaatttgcagaaaatacaccaaagattgcaacttcttacatgaaagaaatgatttgattatattcactctgtatgtgttggtgttgcatctgtctgtgattcagatcaggtgcagtcatatctctctggacacgaggaaactgaatcacatagatgaactagcaaaaattgtgaaaaactaatcatggatttgacaagttgagtagagataaggatcaaagcactttctccataatgctgcacgattgttgtcattttcgttcttgaggaaactacacacatgcatagtcatattttttcttaaatccatagctatcattttcacagatgttgatagctcatttggtaagagtacagcttatgctatctcgaaattaaaaaaaaaacaacacctacgttggactcttcaaatagtatattgtagtaaaatcaccacctgttcataacacgcaacaaattcgcattacaaaagcaggctgctgttcttaaaatttgccacgcacttctatcattgccgcttgcaaaagcttaaaaattagacaagtccttgtactaaaataggccggcacaactgaagattgttcaaacatcatcctacctgacgttttctagatcagtggagaaggcttcaaatatattggaatttacaaatgttctttgcatacgtaagcacattttttt

SEQ ID NO: 42934 - DNA, 1718 bp, Oryza sativa
tgagtcttggcatgtcttgctcacgacagctttgctacgtaattgaccagctaataatcctaaacatggctgagacttttcatccaaacctgcttagaaatgctacgttacttgcccttcaggtcaatatgttaggttagtgagaaccagctcaagtattcggctatttatggtcttcaattttttccttttgatgatttgtagagtcgccaattaccattagcagacgaatggaaatgcagaattttggtggataaactcttcaaatgcaaccgcaaaagaataccttcgcaggataaagctgtaactcatctttgcgatatccaaataatcacagaatgcacagaaactaactaatagaaatgcctaacattgtgcttcagttggtgatcaacaaacatactagtaataattctttggaggaaattgttgatataatccctccaaaaagttctatcttcagaattagcccttgcacccattaatggtacgtgtgtcctaggtatttatattagtgatacatgcaggaataaattctaaagttgcaaccttagtgaggacaatgacgatgttgggtctcgtaagccaaacagatagaacaaaaatagatggtacggtgcagtacgtgcagcaaatccaggagattaagtactgagaaataagtaaatcaggatcgcacgactgattaggtacagtgcagtacacgcgacacattcgggagaaaagtaccgagagataagtagtaatcaggatgatgattagtgtcgagggctacaacacattaaagagagtaataacacatgagtcgagtacaggacaggataataatatcaaaggaggtacaatggtgaggagtggaaatgaattttgaaatcaatgaagaaaagtttatcaactatatatggagaacattgtcttaaaaagattgtcaaagcaaattattagagaatcctctttgccaggctacttatcccttagattgtcatgattagttcattacaacaccggcatcatgacgccaagtctacatggaataggatagtaagtgacaaaaagggaaggaagctcataccagctttgagcagaaaaaccgttgttcagctgtaatcccagtattaccagatgcttgtcttaagcagttaaacatgtactccctccgtccaaaaatataagcatttttagcatagtgataagtcaaacatttccaactttaactattaatagtaaaaaaaataaaaaagatcaatcatctaaaattgatgttattagatttataattaaacaaactatcataatatgtaactttttttatttaaaacatcttatttttataaatattgttgatcaaagtagcatttcggagaccgagttagaatccaaaaatgcttatatttttgggacggatggagtaggaaaatggtagtaaacattatcaggcattgtattaaccataaactgatgtgcgaagaatccatatgaatatattggaaagaatcaggcatcacaaaacaccaaggaaaaatggcaagaaacaagaaactacactggaaaactacaaactgtcacctacttgatgtttttgaaagctatggggacagtaaagaacggcacccatacgaaagaacagaaaagtatgttataatgtgtcccacttgatgcttcctcaaagaagcctctgctcagaagaagtgtactgtattgtgcttcaaagaatagct

SEQ ID NO: 42935 - DNA, 4394 bp, Oryza sativa
cattgatatcactgtgagtagaatcatctacctttttaatgtcaaaaatgttcttgtgaggtaacggttgatgatttgttgtaatattagggtgctgcaggaataaaaggtcatgagtttgacattgtatgcaaataaaaactgaacaattataatctacattctagaaattggatactccaccatgtgttcatccatattgctattggcatgtggggcaggtttggtttaaggcataaattaggcttaccaatatttgtcaattttaatagtgtttagtgtctatttggtttgaaaccaaattttggcatgcctaagaaaataggccatttcaatagtgaacttagactattttggcttcaatccaaatacaactttaccttaccaaaattagtcatgccaaaacttactaaaatttggcattgacaaaatttggtaaggcctatctagaccacaaaccaaaccaacctgtgatttgaaaccgtattcacgaggttttcaggttgactggagataaggggcatgctatctcccgttgtgccccttggagtgcaccacgccatgcagaattgctcgacaattgtgacactataccatgatcaaatattccttgtgtgaagtaaacaaaggttcctgatatacaagaataaattgtactactaatttatttaggatgcacaaaacagtgttttattgataactgcaagcaagcaaccctgatttacttgggtggacatgatgacctttcaagcaaaagggcactctgaaggttgcaggggtatgtggttaaagcatgacgtggtttcattcctagtataggaagtcaattgatccgcagacccacacggcccaacggaaagatgcatgagatgagtgggttgaataaaaaaaggtcagtgtgggacaggatatccataatctaaaattttacatacttgtatgtcctatttctcgagggggatgatgaggtatgacactatgaatttgactgcttagagcatccgcaatagtaaagtaaggtgttatctataaagcatgtacatttcagcaatagactagattaatagtaaaccacttcaatggtatgtctacatggatatctatagctctttaatccattgccttatttttctctatagactatctccaggttagtagatagctttgctctctctctttatttaatctcttcaaagtagaaaaatatgctgacatgaatctcttatagagagcctatagataaccattgcgggtgcccttatgaattgggtttctcttttcttctcaagagttccctttggcttcccacccctccttttctactcccttcaagaacattgtgctatacatcattaactacactgaaattctcagcatcattccctttgctgaatggagaagtccgtagaatctgctgatctgctctacatcatcaatttttcaagctcggttttcaaacatctgtaccgcaccgtccgaaatttcacttttggcagcaattgaatggccttttggcagatcctatcatactgcaaaacgagtagggcagaaacgactacgggccgggcctggccgccatctcactaatgggctgagatggaggccgtaggcttctgatgggctgggcctcagctgccgccacgtgcggcaggcttcaaccaggaggaggtgggggcgagtcgtcgtcaacgacgacgacgaggaccacgcagatggacccgtcgtgcccgccgttcccgcagccggaggcgccaccgctgccgctgcagctgcagctgcagccgggtctgcccaggctggagctgccgacgctggacctggagcgcgtcggcggcgaggaccgggcggcgctggtggcggcctgccgggatctgggcgcgttccgcgtggtgaaccacggcgtccccggcgagctccggcggcggctgctggagctggggaagcagctgctgggtcgcgacaccttcgagctgaagaaggcgcggccgggctacttctggggcacggctgcgctgaagtcgctccgcgtcaaggaggtcaactggctggagggactccatgtcgatctcgtccccggctcgtcgtcgtcgtcgtcgcaggtcggcgatggcgatgatgatgatgatgatggctggatgcggatcagggcgctgatggcggagtacggcgaccacatggcgcgcatcgcccgcaagctgttcaacgccctggccgccgagatgggcctggatcatcaccaggcggcgtcctacctcgccgagcgccagggcttcctccgcttgtaccgctacccgccctgcccttcctccgcctcctgcctcgggatggagccccacaccgacagctccgtgctctccatcatcctcggccaggaccacgtcggcggcctgcaggtgatccgcgacggcgcgtggcgcgacgtcgcccccgcgcccggcgagctcctcgtcaacctgggcgacatgatgacggccatcagcggcggctcgtaccagagcgtgcgccacagggtgctcgcgagccgcccctccacggagagggtgtcgtgctgctacttcgccttcccgcaggaggacgccgtcgtcgaggcccccagcggcatcggcggcggcgtctacaggcccttctcctacagggaattccgcgagcaggtgcaggccgacatcaaggccgtcggcaccaaggtcggcctcagccgcttctatgcgacggctaccaggtagtaacaaggtagaagatgtgctgctgcattgtgtaggatattgtagtacaaggtccatggtaccaattggtatttgcaatgattttctggctaattgcttgtctgaataaaaggagtatacatggcatgataataaattttctagccaacattacatgtaaagataaaagggagaaatgattgaaatcaatactcaatactatattttaagatcatcgcatcattttacattaatcgggaaagcatagcatgtagcattgatggtgagtagtatcatttagcatagtattaggagcctaaaatgtaatatacgattcataattgtttagaatgtatcgtcaaagtcgaatgactgttggtagatgattaaaaggtctccatgtgttgtgggggttaagtggatgtcaaacttaactgacaacatgaccaaacaatgtaacaaatggtaaagcttatatctgacaaagaaacaaactcagagatgtgaaacacaatctcccatggtatgaactgaaagaaaaggccaagcttcagactgcttaaggagagtcagatcaataatagaatgcatcagatgattattgtggggggctacatatattgagttcaccagctgattgtgcagtgcagtggggtgcttcttcagggctacctgactgtcggttcaggattgtatagtaaatcctatattgcactgctattctcaggagtcaaagtaaatttcaaagatcgaatgttaatggaaccacctgctagttacatgtcagaacctaccccagaactatatatggtggaaaccccaaatttggtggaaactagcgtaaaccacaataaaatgtcatctaaataaaaaaaaatctcctatgtagatgaggtgattgtggacagccgtgcaaaaagatctattcgaaatttgactttgcattgctgaaggtacatactcatttaacatccttgaacatgctgataacaccagtgaattcttttgggttgttgctcgtagatgctatcatcatgccttttctttgtggctcctaataacaacggattacggattagtagatcaagtagcagctcaatgcaatataaatcacgtaattggaatcgacttcagcgcctgtggcaaatcctgatcaatttcacacaactcaataaccaacagaaagactacccggacaatgtgacgtgttccaagttcagtttacaacctaatttaagagaaccaataaaatggagggacgaacctgaatcattcaagactaactaggcctaaaattgttggccccagttcccttcctatacatgttccagtcacgtttgatcagaatgggcattcaatgtgcacatggagtcagactcaactatgaacaacttaaactacttaacagttgtaataactcacgtcacccgtctctctctacttttctcattgtattagagtatcatactactgatcttgcatcttcaatacataccggctcgaatcatgatgcctgcagcaacataagtacatagcactgccagcacacgggttcagttccatcgaatggacgcctctggagtctggagagtggagagggagagaaaagccaagctagatccggaattcgggagcacaagtacgcatcggcagcgaagcagatggacaaagttgggcacgtacctagctaat

SEQ ID NO: 42936 - DNA, 5986 bp, Oryza sativa
cctgcagccctgctgatggcgatgtgcattagagcaggtacaatagcaagctaatagtctgcttacctaatattttaacatatatgatagagagagggaaagcagagagagcaaagcggacgacaatctagtcgccggctcaagactaggcgctctggccccctgcagctcgggacaaccaatcgaaaattagaacttgaacatgtagaagttaccaacacctgatagaatgccttggttaaagcatggatgtagccaattgctgtatctaccgttgtttagttatctcttaaataatgtggtgaattttggagccggtagttaactctactattgaacttgctcttaggagatagagagagaagacaccaaaccaaattatctagagagggagagacggggaagaaaggaaagaaggtaatgattcggtaatctcaggaggaaggtatctcttaattaggaagcttgacaggcaataggctggtgctcacaaggtaggtataaaaatctcacctttttctctattcctctccatctcatcacatcccagaacttcctgattcttcaaataatcaaatattattatctaaattcaaataattaattataatttctcttccccctctaacagaaccgtttctgtaaataaccctatttcttcaatgaaaatttacgctaggagcatctccactgtttcctataaaaaagatatgtagttgtaaaatttagaatataaactaaaagtgtaaaaccgattctcgcgaattagctactcctacagtgtacttaccggctacttctcagctctttaaattccttaaaagagagcctcagtatctcacctctcaactaagctttgcacttaacgctgtagtcacacctttatagtactatgcttatattccctactacacaatccaagatttaattctccatcaccagtggagcacaaattccattccgttggcgtctccaaagcggatggatggtgcttgcatcatgcctcctattatttttgtttttggttcccaatggcgaaaggaagaatgagagaggggggggggggggggggggaagccaactttgtctcctcctgtaactgccgaggcataaacgcacaagaggaaggaaaaaaaaacagcatctttcctttactgctttcctaaatgcacactgaaacttcccaaacgaaaacggccggcacctgtggcagcaaaaaagtagctggatgtgtgaagggcgcgatggaccgcccgtcaatgagtgaagggaaaaaattaagaaaaaaaacgcagtactagtagtactgtgcagtgaaggcattggatatttggattagaaagtgacatgtgaggatgcacattcagtgaccttgtataactgtaaggttaaatgcaagtctgtttcattacccaattttgttttggcacgactggtatatggactagagcacgtgtatatatagtagtaaaaataacactgcttcttgcccattttcgccgagaattgagttgttagactttactgaattaggaagcctaacagagtagaataactaattaggactttaggagtagtattagtagtacgatgtacggtcgcaaaacatgaaattataaacgtaaataagttacacttttatatttgtttgagcattaagcatctttttaaatatctaaagtttcataaagataaatttgtttgaaaagcattcaagtaatattctaactttaatttacctgatttttacaaacgtgtttaatgggatagaaattcacaaccgaagtttcagctgcattttttttcaaagattgtgtgccatccaaaaacaacatcttttcaaattgaagggggtgctatttcttttaaagaaaacatttactcggtacctaacattcttaaattctaaccccctgaaataacttttaaattacgaatagtgttcatgctatccattttaaatatcctccgaaaacgaagtagtacatctcatagtacgagttttgaacaagttcggtccccggtccggaagaacagaaaacttcccggattcccgctttctgaacatgttattgctaacttgctatgcctacggagtatggactacggtctcatgacgaagtcaggagcgtctgtgtggaccgtcgtacgcttccggtaccaaagtactccaccgagtagtaaaatcgcatgcactggacatagcccacggcccccaaaagcgaaaagtccaaactccccaaagcagccaaagcaaccgcaagccacggtcacacgtcggcacgccgccggtggccccccccctcctatcctatggaagcatcggatcggaggccgctcggcatacgcgccggtacggggccagtccaagtgtgttgccgccgccaccagcttccctcctcctcggcgtcgcgcatccggcgcattgcatgtgcgcggcttaagcccctttgaatcaaaggatttatatagaaattttataagatttaaatcctacagttaatttttagattgaagctttccaaatcctatgaaattcctatggaatagtacattgcatgtggattttgaagaaaatttagcaagagctctaacctcttgaaaaatttcctttgagtctatctctctcatccgattcctgcgtttttcttgcgctccagtcaaacgaccattcctatattttacctgtgttttgcaatcctctgttttatactttaattcctatcatttttttctattcctccgttttttctatcatatgatttaaaggggccctaaaccggcagttgtacgtacgctgtgcagcagcgcaggcctgcagatctcgttgcccccctcgaggcgcgcggcaattaaaaccggggcgcgcggcgctgttgcttgtggcgcagggaacagcgtgctccaatcaatatgcgcgccccgcgcggacgacgctgccacagtgcaaccacgccgagaccacaccccacccccgcgcggactccgcgcgcctctcaccaactttgcggcgcgcgattcggttgggttttttttttcctatcggaaacgtcgaaacgtgcagggcgcgtacctgcgataccaacacacgagtccctttcgttcggggcgcccacggaatgaaagaaattcggtggccgaacgccccaaacttcccctcccccgccggagcgtgcgcgcacgttgatcggtacggtgaggcaaggttgcccgcaacgcgccatcgttgctacctggtactagtagtaaacaaatacggctacgaaacggaccctttttattggcctacgcaggcttgcagcagcaagccaaaaccagcaacacgtacgcgcacacacaaccatgtgattggcccgtttggggctgggctgttagagcacgcaagatcgatgtgtaggtgcagcttattagcattgttgttggcttattgcacaaaggaaaaccaacaaaccaggttaagttaagcacagaatcagcatgtcgcacggcacgacatgcactgtatggaggagcttcctttctcgcttcgcgctgaccgatggatctgccataatcattgactagtgaacagcggtgacaaatctaatacttggtactcccagactcccagtaagtaggcctgctaatgggttggatgagaatgggtttaatggatcggttttcaatttggattgttttggtatgggtgtaaacggggtgagctacctaatggactggggcggtttggatgatgaatagaggtgggttggattggattggtttttggtttccagttttcggcctgaaatgggtggagtccatggattttcattggattggccccaatggactaccggcggcaagaaggacaggaagggcaaggagtacagaggtgatagccagccgccgccgtcgtcgtcaccggcggcggtgcctacgcctgtctgccaagaagaagcggtggtggagctttcgacggccagcggcggcgacgaccaacacgtcgtcgctctgcttctcaggcgtgcacgctgtcatgcagcagcatgaccagctcgtcgtcatggccgcttcgccggcggcaccggaggcggagaggttgactgccgctggcgtcgccaaggaggagttggttgcggcggtcaggattcaggcggcggaggtgatgcgcgtggcggcgccgcgacggggcgaggggcagcacgtgctgctcggcaccgccggcgaaacccgagctgcaccacaaggtctcgccgatgccgtcgacgttgacggactcaagcgcgcggacgatgagcggccgccggccggctcgatgactactccgccgcggcgtccgaggccagtgggcgccaacaccgcgttgcagcggctgcagttgccgccgccaatggcgaccacgaggcgacgagctgacgacgctgcagcagtggatttggaatggactcgaatggtttgaagaagtggattgaatccacaacggggaaatggtttggtttggtttggtttggattgagctgagaaatgggttgggttggtttggatcatgaaagaaggtaagtggattggggtggtttggactattgaatttcactgttgtggtttgaactggaggcggggcgggtcttgcaccattagcaggcctaccagtaagccgccgcattgctcccgtttttatataggaaaacaaataaatgtacgagtataaacttgcttgattggttcaacacttcaactagtggggcaagtacttatactaagcctgtcttattagctggagtactgaattgtcctttgctccggtttctccatttaagatcttattatatcactaatgatctcagcacctgacgcgccgcatgtgcttgccgatcaggattcaggaatcgttcagaaagagatgggaaaaaaaaacagaggatgatactctatttttgtaagaaagtactccaaagtacaagcagagatccaaaaatttattgaagaaccttcctatttacccagtgattggcagcatccaagcatttgatccaggaatactagttgttttatacctatgagcacaacaaccttgttcgtaattggtaaaccaacaacgtgttaagttagtcagattcccatatgattgtacggacagtgttttactggatttgagcacagaaaagaatacgagttttgtctttggcaacgaagaaaagacagtagtaacattgcgacaagttggatctgcccgattgagccgggaggtttgttcccttctcttgctgcaaaatggaagggtgagcaggcatgtgggccaggccgacctagcaaaactggtgtgacggcccatcgtctatggcccatacggtgcagctgccttttctcctcctcctcctcgtcgtccccaccgccggcgaggggagggtttggagctagaagagatataaatctgagcggcgctgttctgattttgggttgatctcgacatagttgtgttgtttgaatcttcttgttgtttgccatatactgtggtattttctttttttcactttggggcctagatgcggacgccgaaaggcggcgatgagccgatgggctcaaatccgaggcggattttgatattgagttagaactaatcaaacattttttcccccttgtaggtatgagtgatgatctggcctcgcccctctttcgcgacgccttgctcagatcgacggcgacgcataagcctacctcgctggttacacccggccgaaacctcatctggatttgggtaaaattaccttgatctgttcctttattttctcttgagcagtggcattacgttgttgcgtctggctgtctgcgtaatgtcttgacataaatactcttcctgttcttgcatgtctagattatcttcagagctggtatgtagtagtctcagagagagaacatggcatatttgcatgtccaaatctgcaatctgcagtatttttactaggtcttttctcagctttaacagcgacatgtgatctcttaaaatcgt

SEQ ID NO: 42937 - DNA, 1793 bp, Oryza sativa
  unsure (1)..(1793): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcttatgagctctgtgcatctgatatgaaaatatatgtcaacatagtaggataatgatattatctaataatcatgagcgtgttggtggatgttcttcaggttatgacagatccagacgtgccagggcctagtgatccgtacctgagggagcacctccactggtaaatatatatcattattttacaagtaattaatccccgctgaggccatagatggctcctattgttaaaacatgaataaacctcatgagtatcaaatatccatgaaaaaatataaaccagaagtgatctgcagatacatggctaaattagctaggtcattgatgctactccttccggtaaaaaaacattatgttttggacatttacacagccttgttaatttgtattacaaaacattgaaaaacaatatgaactcataattttatagaagtacctttttaggacaatctacacacaattaatataattttcatgcatccaatataaatattttaaaaattatatatggatgtccagactcaatttaaagtttgacatgaaacatatctaattaagacaacatattttcatgaccggaggaagtacagtgtagataataattaacttcttacctagcgaaacaccctccggtagacaaccactgcaagttcctacctgaaccaacacaaatggccatcactaatataatatatgctcagctactcataaaatagcgctcaatctgataaagtatgcgctttagtttaacataattaatatattgaccctggcaggatcgtcactgatattcctggcaccactgatgcttcctttggtaagtccttttcacagatatatatatatatacgtacaccttgctttagcttttacaagtttaataattaaaacgagagctctgatgagcccatggctgtgcacaatacacgcatgatgcatgctgattattggcttgtgatcatctttaatttctctgaacaaacttacacgaataacctatatatatatatacatgcatgtatgtatgcgcagggagggaggtggtgagctacgagagcccgaagcccaacattggcatccacaggttcgtcctcgtgctgttcaagcagaagcgccgtcaggcggtgaccccgccatcctccagggactacttcagcacccgccgcttcgccgccgacaacgacctcggcctccccgtcgccgccgtctacttcaacgcgcagcgagagacggccgctcgccgccgctaattaaccaaactgccaaaaaccaaattaagcccctcttgcaggcatgcaatatgcctcctgcaatattaattgcagatgcagctagccttccaaactatatattgcaactaattaagaatggactactacatatataatctagggatcgatcgagctagatcacctagtggcatatatatatcagccactattagcttagccatgtatgaaccaaataagaactcggtgcagcaagcgcgagccactgtttagttcgtcagtgtagttaattggtatatatgcctatatatccgtgtatgccagag

SEQ ID NO: 42938 - DNA, 8186 bp, Oryza sativa
agagagtatatttatgaagagtgccatttatagattgatttattcggttggtatggtttgtttgcacatatgtggattaatttagctttgaatatttgtaaagtagtatatttgatttcataatatatactaagatttttagaaatttctaaggttgtttggatagcatgcaaatgatatggatatttgaactattgagataagtgtaagtgcttattattttacatgtaagaatatatagttggatccataccactacaaatataacattttagataaataccactactattcacaatatcggctatgtaccactggaatttggggaaattggaccagtgccactctatcacgttttcctaaaaaaaatctctgttatccccaactgcatgtgggacctaactgtcagttccgtcttcacctccctcccctctgttctctctccccaccaccatcgttgacaaccaccgttgcagccgccatcatcgaccacctccgcggcaggagaggcctcgagagccactaccgttgctactgtcgtcttcaaccccatccgtggtgggaggactcgggacccgccaccaccatcctcgatgccaaccacggcaggaggctcgggagtcacaatcctcaacccaatctgtgcgggagggctcggaagctattgccgccgtcatcatcgtcgttgtcctcatagcagtagcggggatggagaaagagatgggggaagaaagaagagggaggatgggggaagatggacctcatatgtgggtcccaaatctaggggtctgacggaaaacgtgatggaatggcactgttcttgtttcttcaaattttaatggcacatagccaatatcgaaacagtagtggcatttatctaaaatggcatatttgtagtggcatgatccatttaaccctaataaatatatgggtttaaacattgatttaattgtaaagctagactacaaccattcaaactaagtatagccaaggaaaaatagggccaagtgccctagctagattactaattaaatattttctatcatcaatcagaccatcaactgatcaacctgcttagggcctctaaatataggcttaggcttactagtttcgatttttaagttatatttttagcttatacactagtggatttagagttataagtttaacggtagagtcatacatatttcttacatcagccaaaattttattttccaacctagttttttgatttaatagtataaagagtggcttatggctttaaaagagcaaaaaaaaattgcttgcttgtttaagagtggcttgtttttctcttctaattcgaagatcttttatggatttttggtgtgcatatgtatgcatatagatcatccacaactgtgtggctatctagctagcataaaaatctatgcatgattgcttggacagagttgggcacgtacgggaggcaggcatgcagcagtatgtacggactcatacatacaggggtgaatacgtacgggaggcagggtttaagggattttttttttaagattgctccgatggttgataataataggcccgccaatttaaatgaaaatcaatggttagatttttttaattgccacgtggcagcttgagagcgttttgaggagtgccatgtagcgtcttgagagcgtttctagaaagtttaatggacttttagtatataataatagataatagatagataaggtaataaagtaaacaagtcttaagcccttggaaacggtgacggtaaaagctagggctctcgtgctggcaacttggcaagaactccttatttgtagcatgaaaatgctgtccttagagtgacaagcagagaagtgcacacctataaagagtgacaagcagagaagatatggggtctatggggagagtagactccactctagcaccaattaagccatatatctacgcaacccaacaaacacccctagctgatggcaaggatgagggagaagaaccacattgtcatgcctagccgaccttgtggtaactccactatggtcccgacgtcagtagctcttgagcatcccctatgcccacagctacagttgacgatggcaaagggcagtgtaggggcaagctgttggtgagatcagtcgtgatcaacactaacgaccataaggatgatcaaagaacgaccaaacatgactcgagagctaattctaggaagagaagtataagcaatgatggaaggaagaagagaacagcaacattaatgaactaaagtggaacatacttcccttcggttatgaatatttgacacttaggacgggactcagttaaacttaatttataaattttgataatcaaagtaagtttataaaatccaatagatttttgatattttaagacagatctacattttttttattttataaactaagcatttaagaatttgtgtaaggctttaagaagggcagatgcataaaccactaatcatatttgatggccaaaaatatataagatttgaaggtggattttcattcgaatgttgaataattagcaatcctgattttctaatgtactaactttaaaagtggtatgtatcaaatatcaaatatttacccccggttcgtgtgtgaatagctttcatgcaaatttcctccccaattctatgctcaccatccatgccggcaccatagttaatgcacactgttacatggatctcattgtgtgatgccttgctatactccctataatagtatacttaagtgaaattcacttaatgcacattcatagtggtgtttccgtacatgctagtatttgattgatctaaccattacatgagatcatctcgattacaattaattattttttcactatgcatgagcaatcatttcattattgccagattgtgcggaaaagattttctaataaaggcgtattctaaacagctaatcctatctttctatatagttgcactactggagaatgcatctttgatgggttgagcaaaaacacaatagtcccggttccaataagaaccgagactaaaaatactctttagtcctggtttaaaagtgcaagggggactttatgatctttagtcccgattggtgttatcaactgggactaaagatcatttttagtctcggttcaaaaagttgtcaggcccccactacctttagtctcggttgtttataccaaccaggacaaaatacctatctttagtcccggttgtatataccaaccgggacaaaataccggagctgcacatctcgatcccatcgtccttatctcctccctcacacacgccgatactagtactcctccactccacctcctaactcctcctcctcccctcccctcctcccttcccctctcgatccgttcggctgaggcggcggcggtggcggcgggcagcgagtgctagcagcgcacaaagggggaggcggcgggcggcaggcggcagcgggcaggaggcggcgagcggcgataatgctctcccctcagccggatcctgcggaggagaggaggaaggtagcggcacacgaagggggaggcggcaggcggtgggcagcggcgggcgggaggcgaccgaagctggaggcggtgggcggtggcaggcggcagcgggtgggaggcggccgaagggaggcgggaagcggcggcggtgccctcccctccgccggatccggcggaggagaggaggcaggcggtagcacacaaagggagaggcggcgggcggcggcggcgccctcccctctgccggatccggtgggaggggcgacgacaggcggcgggcatcggcggcgggcggcggtccccagcagtgaagaatttttgtgaatttgtttagattttttttgtgaatttatggtgtcaataatctgtggatttgtgatgtatctgtgaatttgtgatgtcaattatacgtgaatttgtgatgtcaatgttcgatctttgtgatgttgatctttgttatgttggtgagtttggcgtgaaatcaatattcaaagaacaatgaaaaaaaagagaaaaatagggactataaagggtagtgccggccacgtgatgggcattcccgaattcgtggtcccggccggttgcataaccgggattacacggggttacgaactgtgggtgaagaccctttctccagcagtgttggtacccaccaaggggcatttactcttataaagcaagacatgcaagaaaccacatcatcaacaattttaagtcattagatcatattagtacaaagataataaccgttggatcaagaagctacttattcatccaattcaatcatttattaattatccattcacctctctttactccacctcacaatcacacatagcactgttacatattttgtgcataacaccatgttttccgaatacaactcaaattattgtttaatatgtgtcttttgttttattgtgcatgataagataacatataactatttggtatcgttacctgaatctattttcagaaaagaaattaaacttgagtgaaatagagagatgcaaattgtcttactataacaatacccatattgcgcatgaaaataatattcatatattataacaatacgcaattactcttggaaaaataaagcatgaattatatttcaataacataagacatatataaatctacattatcatatattttgtataaacatagagttgcacctaaccatttaaaactttgacaataaaactataaaacccatggcaaagacgtggggagccaactagtgggtgcatggattattcgtaccatgctttttgaagtgtaatattttctaagatatctttttctaatatatttgttagtttatgatattcaattcatccatatgagttatttttctctatcaatattatctattcaatcatgcagttagaaacacgtctttagtcatgtagctacctatatgcagccccttcgaatatgtcctgagattatttgtaccaaagtaatcaggtccggagaagtaaccgacaataaagtaaacattcctcgatcgtaaggagaaaaacttttcttcaagcacccaagttggtaatgtccccgtttgcatagttgccagggagatggagaccaaaggagctactacctctgtcttatagcaagtttagttttagttattatgcatctagatgcatatttaaaattttttattatatttgatgatggatggagtagtgatttccagcgggtgatcgatcgagaaattaaagtggtaaagggccggggcctcgctgcctaaattttacatcactaataactatcctgtcggttttcggcagatgatacagtagtacagtacagcactatgatgcttgttaagagtagctactagctaagcagctagccaccacactgtgctcacgacggtgcggcaccaagaaagccagtgacgtcccgacacactggagagtagcgtacgtagagtgcggcgagtgtgtggccgatctccgcgcgatcgacgcgaaccgcctcattcttcaatgccccaaccacattttgcgcctcagttactccactccctctgccctccccaccaccatataacgcctcgccaatgcttctccaaatctccaaccaacccacaaacgatccatccatcactcgatcgtaacaactttgtagtcacgcgccatgcagccgacgtggctcgccacgatgccggcagcgtcgtcgctggtcgtcggcgtcgcgttcacggccgccgtggccgtggccgtggccgccgccgtggcgaggcgcgcctggaggcacaggggcctccggttgccgcccgggccgccgggttggcccgtcgtcggcaacctcctgcaggtggtgttcgccgggaagccgttcatccactacatccgtgacctgcggcgggagtacgggcccatcgtgaagctgcagatgggggtgcgcacgctggtcgtcatcagcagcgccgagctcgtgcacgaggcgctcgtcgagaagggccgggagttcgcgaccaggccggcggagagccccatccggagcatcttctccagcggcaagttcaccgtcaactcggcggtgtacgggcccgagtggaggtcgctgcggcggaacatggtgtccgggatgctgagcgccgcgcggctcagggagttccgccccgcgaggctgcgcgccatggagcggttcgtggcgcgggtgcgcgccgaggccgcggcgtcgcgcgacggggcgtccgtgtgggtgctccgcaacgtgcggttcgccatgttctgcgtcctcctcgacatgacgttcggcctgctcgacctcgacgaggagctcgtcgtgcgcgtcgacgccgtcatgaagcgcgtggtgctcgccgtggcggcgcgcatcgacgactacctcccgttcctccgccccttcctgtggcggcagcaccgccaggcggtcgcgctccgccgcgagcagatcgacacggtgctcccgctcatcaaccggcgccgcgccatcgtccgcggcatgcgggccggctcgccgcccgaccccgccgtcgcggcgccgtactcgtacctcgactccctgctcgacctccgcgtcgagggccgcgacgccgtgcccaccgacgaggagctggtcacgctctgcgcggagatgatcaacggcgggaccgacaccacggccaccgccatcgagtgggccatggcgcgcgtcatggacaacccgtccatccaggccaggctccacggcgagatcatgcagcgcgtcggcgacgcccggccggtggacgacagggacaccgaaggcatgccgtacctgaaggccttcgtgaaggagctcctccgcaagcacccgccgacgtacttcgcgctgagccacgccgccgtggagcccgggagcaagctcgccggctacgacgtccccgtcgacgcgaacctggacatcttcctcccgaccatctccgaggaccccaagctgtgggagcggccgacggagttcgacccggacaggttcctcgccggcggcgagacggcggacatcaccgggtcggcgggcgtccggatgatcccgttcagcgccgggcggcggatctgccccggggtgggcatgggcacggcgcacatcgcgctcatggtggcgcggatggtgcaggcgttcgagtggcgcgcccacccgtcgcagccgccgctcgacttcgaggacaaggtggagttcaccgtggtgatgaagcggccgctgctcgccatggtcacacctcggaagctctccttctgacgcgtgcatgcatgcacgcacatacaacgtggcagagcacgtaagacactgagccgtggggcctagctcgctctcctgatggattgtctattaggtcagcacgtgagatataatactactactcgtagctacaaattattggaagtttgctatttcgagtcattgttttaagtgaggtatttcccggtggaaggcttatacttacgtacgcagttatactttccctaatagcgagtacttataatgtataagtaacacttctgctcaagattaatgcacatgttcttagtatatatgcatattattattagaaaaagtaggaattaccccttgaaccataaaaccggacatttttcacccctaaatatatataccggacaaattacccccctcgaaccaattcagagcggttttgtccaatgtggcacacacgtggcaatccagtcagcgtttttttaataaaaaattatgggacccacctgccatactcttctcccccctctctctattctctctctctctcgctcttttctctctcgccgctcacgtagcgcgcacgcgaggacggtcggcgagggctgttggcgacggaggaggcagtggcggcggcgaggcgaggcggcggcggaggcagcgagcgccgggaggcgagcggcgacagagtaggcgagcgccggcggggtgcggcggaggaggcagcggcggcagtgaggcaaggcggcggcggaggcagtgagcacggggaggcgagcggcggcgggagctcgcgctgctcgagacgaggcgaggcggcggcggaggaggaggcgagcggcggcggggtgcggcggaggaggcagcggcgaaggaggaggcgagcgccggcggggtgcggcggaggaggcagcggcggcggcgaggcgaggcggcggcggaggcagcgagcgcggagatgggaccaatcgcggggctgcagg

SEQ ID NO: 42939 - DNA, 1660 bp, Oryza sativa
ctcgcgccgcgcgccgtcgccatctcccctcgagccccgcccgcgctgcgcgccgtcgtccgtcgcccgtcgccgccgttgccttgagccccgtccacgcgccgtcaccccgcaccgcctcgcctcctccgccgccgcgctcgcctcctagtccccgcgccctgccacctagtccccgcgcgccgccggacaccgcgcgcccacgacgaggaggaggagcccgcggtggcggcggtgtcccaccacgcggaggaggagcccgccgcccgctgcgcgtccccccgcgcccggtcggcctccacctccgtcgccactctcctccgccgcaccccgccgccgctcgcctccccacgctcggtgcctccgctgccgcctcgcctcgccgccgctgcctcctccgtcgccgaccgccctcgccgaccgtcctcgtgtgcgcgctgcgtgagtggtgagagagaaaagagcaagagagagagacatagtagagagaggggggagaagagtatggcaggtgggtcccacaattttttattaaaaaaacgctgacgggattgccacgtgtgtgccacgttggacaaaaccgctctgaattggttcgaggggggtaatttgtctggtttacatagttgggggtaaagaatatccggttttgtggttcaggggggtaattcggacgatcgcgatagttcgggatgtaattcgtactttttccttattattatgtctatcacatgaatttttagtggaaagtattacattattgtattgtgcaaacatttttcatggcaaagatctagcggtttcgtttaagatacatgacaaattaaaatatttgtaattatgcgcggaccctgaaaggtactccatccgttcttcccaaagacccaaacactatttcaattgtgaccactaaaagaattttaaattgctagactataatgagcaacagcataatgctgatgtttaagatgcaacacacttcaaaataaagcatcttgatactctctccgttttttaatattatgttgttgacagaaaacattagaccgcttaaaatctaataagtcataggctcatagcccgcgaattcttaatgtcatttgacaaaatccatcccttcaaatcttgcgaattctaaaccattagatcgctttaggattcgtgcgctgaacctaaccctaatttcttcttccctctcccctcaatcatgtcgctaccaccacttcgctcccctcccttgggcacgcgctccaccccctcctgcgtcgccaccgccgcccggctcaccggctggcctgaaggcgtcaatggcgctggcgagagatccctggcctcctccccctccccccttccgccctctctccttcctcctcgagccatcgacggcgagatacccccaccaccaacgccggtgccaccactctccttcatcccccatggctccggcgcctcgccacttgcccgttccaccacccaacaccgtgccgccgcttcccatgactatctctctaagcccggcgacctcctccttcttgccccctccccttcccattcctcccaccctcaccccacctagagagacgctaattcgtcagtcctctggtggagtttgggttgttgcaggcaccggagaagaaaaaaaggtcattggagttggaga

SEQ ID NO: 42940 - DNA, 3691 bp, Oryza sativa
tgggatcatatcaaatatatgaaaacttatctcaatgagagagatagaggtatatatctatatatatgagaaagcaataagatgtgatgtcttttttgtcttcattggttatctactgctctctgcattttcatattttaagtcattttgattattttctagttaaactttttaagtttgatcaagtttatagaaaaacttttaagtcaaactgtggatggtgccctccgtgagatgaccctactgtagttttcagaaagaagaaaaagaaaagaccctaccgcatatatcgaccagtttctcgatcgatcccctcataatgaacctccaaatgcagcgttgctttaaaacttgtcggcatagaatacacccaaatataatgctatcgttgtcaacaaatgtagtattaattaggcaatgattgtacaagaagcacagcgcgctaaaaatattattttaacagtgaaatgttttcgaggattattttagagttttgacaatgacacggtcaccaaaatatattcttaactttatcttattataatatatacaataaataaataaataaatgcatgtttactttctttatattactttgaaagacagatgtagatatgctgttttgttcctttaaattaaattttgtatcacaaaggaaaaaagtataacaatcatctcataggtagtgtcatgtcttattttgtatcacagaggaaaaaagtataacaatcgtctcataagtagtgtcatgtctgtagaaacgtgatactccatttccatttccatttatgtaagccatttttctgaccattttatcatttagcctccaccagctagctcggagattcccttctaccttagcatatttcgttgcctcaccaaaaacagtgagccaaaataagcatgttcctcattagatttgcaactctggacccacaatcttgtgtcccatgcctctccaggtagggagggagaggaccggagagaggccagcgacggtgatggccacgtagtgaccaggctggcgccggcgacggggacgtagcgacgcgggggaggaggggaggggagaagcgccgccgtcgtttgggaggatgagaggccgccagcagtgaggaagataggagggggagagggaggcgactgagagggagaggagcacgaggtcgatgccgcaccgctgaggtcaatccggagccaaaaagctcgatccgtagcttggcggcaccgtcgttcgcggctttcggccccgacaaggtggagccccactcagcgccgcttgtgtcgtgcgctgctgttccgcctgtcgccatcgcttgggccgagccaccgctgctctgcttgtcgccgctcccaaccatgacctcaaccgctccactacgtcgagccgcttcaatccgctacatcaccccatccaccctattttgcaccggcggtggccggaggaggaggaggaggggaggcgtggcggatgaaggaagagggggaggcgtggcggaggagaagagaaggggatggcaggtggaggagaagagatggggatggagaggtagaggagctcgaggtcgaggccaatgttgatttggaaccggcgagctcaattcgcagccggcgccgatgccgctcgggccgcccagtgccatcgccgctcgggctaccctagcgcttcgctttttcttgcctcggcttcttttgccagtaaggactgggggaaggaagaaaggagagagaggggggtgatgaaaagtgaaagagattggtattggtgagacccactacaagcaagttgcattgtggagtatgtagcttaacatgttcttggtctgtggcatgtgaagaacgacaaatatcagggacggattgctattgccttaatggcctttacaatgtggtagctgtcatcagccgatctcttcatgtcagcgattcggtgtgaatctttaccatgttcgtaggtaggcccaccaaattaaagcccgcgtgatcttctttggtcacctgttcttggcgtgggtagagaaggctacggatgtgttgggaggatgtggtttcgttccgctttttctatatgcaccgtggatcttgtggcttccaggtcaatcttggtagcgtcttggaccaaggctacgcgtggcccgcattgtaaagtccctaattgcagaagcacttatgattatacaagcatcacaattatttgtttcaaacaaaccatacatattaaccttctcatttcagactaaatcttgtacagttaacttaccagcaacacctacaaattaagtactacaagtaatagtcacctagctaatactaatatatgtacggacgtaacagtagtctggcagcgcacgacgagccaaaaccggatctcgtctgaggcttgcctcttcaccagctagcagcgttggcacgtacacaaactattccacatagagcgtgtttgcgtgtatagttcacgtcaaaatttaaagtttggttaaaattagaacaatgtaacagaaaagttagaagtttatgtgtagaaaagttttcatgtaatggaaaagttgaaaatttaaataaaaagttcagaactaaactcgccaggacattcaaccgatatttaggttagcccttcttcactctaaggctaatctaagcccttatttagttcctaactttttcttagaacttttaactttttcatcacatcaaaatttttctacacgcataaacttttaactttttttaaactttcaattttagtcaaactatcaattttagcgtggaactaaacacaccctaacctgctgttttggtagtgtacggaagactaattctctgcaccgtactgtaattacgcaagtccgtaaagtgcatgatcgcacattaagtactgtggttacgcggttaagcaaagaagaacacgtagcagaatgcaatcagccgtcgccctgtttttctttgcttagtactgatgcataatttccgagttttcaaatagtgcgtatttttctgaaaattcggaaacaattctgtatactccggatccctctggtttttaatatatggtaccgttaacttttgctatatgctttggttattcgttctacttaaaaaattttatagaaatcttaaaaatataaatattgcttaaaagttccttgagtaataaatcaagctacaacaaaatgacatacttaaatttttaagagtaattttcacaaaactacattattttgcacaatttattacaaaactacagatttagtgtctctgtttatcacaaaattacagatttaagaacttgtttcataaaactatagattcagtgtattcgtttatcacagaactacacatttagtctttatttatcacaaaactacagatttagtgtctccattaattatcacaaaactacaggttttaacaatgctaaaacctatggttttatgataatgaaggcacttaacatgtacttatttatcattttgtgacaaatgaaaatattaaatctaaagttttgtgaaataagttcttaaatctgtagttttgtgatatattgtgtaaagtacatgtagttttgtgataaacgaagaaatatgtactttcatgaaacaagttcttaaatatttagttttgtgatatatcgtgcaaagtatctgtagtttttatgaaatttacttattttttaataagaaaagaaccaaac

SEQ ID NO: 42941 - DNA, 2326 bp, Oryza sativa
cataaactgactcaaatccgaagacagcgagcagacccactctgttctgactacagataaatcataaatgtggatgaaatccttccatatcgtagtttctgcaacaggagcagcgcgagaatcctaatgagcaatcgctcgcgtgagagagtggagagcgatccgtcctcgtcacgggctggtgggttctctccccacgttgctttcttcttctttttttcaccgcattactcttctggtttagtaagtttatacatcttaagtttactcatataaagtttatacatctaaattttgtattgttaaagtttatacacataaagtttatacgatgaaaatttatatacccgatttaaatttgaatttgaattcaaatttaaataccttaagtttactcatctaaagtttatacttctaaagtttgtattttaaagtttatacacataaagtttatatagtgaaagtttatatacccgatttaaatttaaattcaaatttaaatatatttaaaatatttatatacatatagtatatatgtacaaagttagcaatgtatatgtttatatataaaaagtctatgtacatgaatagattttagtgtaatatatttttttattctctttctttttttcacacttattttcaaattgattttaaatttatgaaaaacccacatcgaatgtagacagtcacgagcgaggttgagaaaagaaaaaacgtgtagtactccttgatctgttcgcgtgacgtgacccctagcgactaatcgcgtattagacggggacccttcagaaacttggcaaatggttgaactacggctggctatgtgtagcaacattaatcattattcggcaaactatgaaccatttgtgcatgatgtcagctagctatatactccatccgtttcaaaatatttgacaccgttgactttttagcacatgtttaaccgttcgtcttattaaaaaaaatttgtgaagtatgtaaaactatatgtatatatgaaagtatatttaacaataaattaaatgatatgaaaagaataaataattacttaaatttttttgaataagacgaatggtcaaacacatactaaaaagtcaacggtgtcaaacattttgaaacggagggagtatacagtaatacagatcgtacattatttatgttctagcagcagtcgttagggcatgaacaatgcaccgacgatgcgagtagttctaggcttccagctacctaagatttgctccggttcaataaaaaatacatcgagatatcaatatctcatggtaccaaagtgtttttatagttggatctaacaatgtccatcctgctcaactagatccaacgatcgaaaacaatttagcaccgtgaggtactgatattccgaggtacttttcgttagatcggagcaaatctctttattattgggacagagggagtatatagctgctccatacagtacggcatcaatccgaattgtacgcggacacgtcgtcgatcgacctgaaaaatacagatactggcacgcgaacgtgagtatacgtactgatccctgaaccgtgcatgcacatgtgtgcaacacacggctagcgattgattaatgaaacagctgtcagtatcggccatggctacgtacttccgttcattggctttgtttggatctttcgggctattaaatatctctctggaatcttgctatttaagattattaaatatagattactgacaaaactcattccataacccctaggctatttaatatacctcgttagattcgtctcgcaaaatagcctagggattatgaattggttttatcaataatctacgtttaatactccgaaataacaaagattccggaggggatccaaacatacccattatatccttgccagatctagaaagcggctagtgattgatatgttggggggcagactgatggcagtgcatcaatgcacgatgccacgatcgatcaagttcgtccaagcttcagctcattcatgcataaaccatgctcaaaatgctgcttctgtatgttccatgttaatagacgtaaccactacttctatctgtactcgcagtgggtaatcacaaatcatgtcggtcgtacgagagattgggtataaagattgttcacgttattttcaatctaatctcattcctgtctgatttagattattaagcagtttgtcgttacggattatctattttactaaggaatgaatcagatatctattatattattaaaggaatagaaaaaggagcctccacgttcgctctcatggcttggaaattcttacattaatcagagaaagaaaaaacagagtctata

SEQ ID NO: 42942 - DNA, 21205 bp, Oryza sativa
gcaaatagcttaaaacaaatggtttaaacaatgccgcagaagaaaggtttttaagaaaacatatttttcaaagtgtactccctccatcccgaaaaaagaaatctaggactggatgtgacatattctagtacaatgaatctggacagaggtatctccagattcattgtactaggatgtgtcacatccagtactagattagttttttatgggatgaagggagtagagcacttaatattttaagtttaatagtttggtaataagctgaaaggaatgggtctggtcaaaatttcttagccattgaattgctggaattttcacctttgatcgtttagaaaatcctaaaaaagttattctagaaatgatcattttttgcggcacgaacgtcattggcatcgtaatccaacatgatggcgctaatgacgttgatgtagccccatgtggaaactaagtcactaatgtgaatgagacaacattttgctgtccaggaactatttgtatttttttgaaaatgatctatttgtaatgaaaaatatttacaaataggtcctcattgcttgcatcattatcactaaggatctatttgtaatttttttttattacaaatagatccttttctactacgaatagcagccccatcacctcacttattcatggaataagccaaacggaatatttgcgaacgaaaaataatttgtgaataaaaattttatatatgtgtttttagtgatctaaaagcaaggctgaaaaataaacttcaatgatgaaaactcaaaatcggctccaaatttaaagctgaaaaattaaattttgactgataagcataagcataaacgaaaagatgggactctaggtcttttacattttcacaaatagatccttggcgtcaatgatattggtgatttggtaccgtcccctatcacattaggccattcccaacccaataactaggatggtgtacatagcattaaataagctatcacataggatgaaaaatgatgtggcaagtgaataatgaggaaagagaaggaaaccatgtcttgcatgagacatggtttctacacaacgtccaagacattagtgagataagtagcattaaatttaagtatggaatattggtgtttgcattggaagaatagtgtctagtactagtttcttgatgatgtggagtttatgaaaattatgtctaatgttttagattgggaatggccttagcgacttagctttcactagagacgagggggacggcgccaacatcattggtgcaccaatgatattggcgccacgaaaagggtgtattcttggaataagttttttaagatctatttgttaaataagtttttcaaaatgatcaagaagtgaaaaatccatttctcaaaaaaaaaagtgaaaaatacagcattgaattgttcagatcaatctcccgagaacttgcccaccgtagcaaccccagccttcatggcgtattcttcggtgtctctctaacggctactgttgttcattgtcatccaaccatttcttccatccatgacaccctcactacacttaatgaaagccaatcttggagggtctccgtggtttcctcgccgttgtcaagatcgctagagtaggagcgatttgtttcaccttcttcaatggcctttttgtacggtgattaggtgatagtagtccactacccggaagaatggaacagaaagaaacactctcatcgcttgtatcacctttctgtgtgtgtggatgcactagtaattaaccgggtccatgtggcccgtctcattatagtatctatccctctcatcaagagccaaccaaccgcagctagttgttatataagcaaatgctcatcattccctgccttcctggagcgtaattaaatgttattaggactagtatgttgttagccttttgggacttaggactgcaatccatggcccatttcggactccaccaaccaagaattaatagaactactctaatcaacttcatgctagctgaacgccagtgacctaccagccaacatgagctgatcatattagcttggccaataactaggatgtgatcattctggacttctggtgacagcagtacagcactttctgcaagggccattcccagactgcagtgtcctgcaagaaccattcctggagaaacaatgacctgaactgccagaaatgctcccaattgtaaggattcatggaactctggttttcagaaactctgagcctctgaattcagctaggacaacaatggaggtggttggctggtcgcattacattactttgtacagaatgaaaggaagaacaaaagtgagtcgacgtaacatccttcaccttctttttcctagccttgtttccatgatatgttcttgcttaaatacgtcagttttactcgacagtgacaacgcaacaaacacccaagccaattaattaactgagagaagaggcgaaaaaaaaaagagagagaacgaatcactcttgagttacaagcaacatgaacgggtcacgtgaacatttcacaaatccatggcactgagattacagagaggaattatatgcctctaggggataacattatctggcgcctagtagagtgaatcgaccgtcttgttcagctcctcgagcttcttcatacgcatcctctcactttcgctcaccagctgcgtcgaaattataagttttcagtgaccgatttgacgatctgaagatcaaagagatggtgtgacaaacgtttattaattctactcacctcaattagcctgtttacaagcagtgccttctccttgttcttctcgttgtacgcctccaggatttctttgtattccttctcctttataagttttcaattcaagacagacaaatagttgtgtcagcttattcagtcccttggaattaattcatcgtatcacgtcgcaaattgtttcgacagggtattccgactattatgttcaagaagttgtactaaaaaagttagaacctgttgaattgcaaatcaaatctgtgtcatgcgctcatgctattcatgcctaaatatgtatttatgtgcagttctgcacatcaagtctgtgccttcaccttcttgacgcaggttttgccgagaggcttgagctgacggttcaccacgtcgatcctcttcctgatcacctccacctccttcctggttggatccgccatcccttccagttcctatcaaagaacaaacaattcagccacacgcatcatttgcagctgattttttttctctattcatatttaaaatttgggtaattttaccattcttaagaaggtatctagaggtaccaaatttttctctaggtactcagtatctcaaggtactaaaaaaaattttttagtataaaattttgatacctttagatactttcttaagaaccgtaaaatttctcttaaaattttcttgcatcttttctgagctagctgatcatttggtgtgcctttaagcatcatcaacttgtatgcagtacgtgtcctatatcacacgatctctgttacaagtacagataaaaaagaattgttcctttttagggtcctgaaacagcaattgctacttccgtgctgtttctgcagttctttcagacgaaatcaagctgaaatatcataaattataaacctaactaacagctcttaggacatatatgaattgtattttgaaaacgtgacatgaataagctgcagacattccaagtcggaaagtgacctgtcggatgaaggcaaggcgcttggactcctcctcgacgcggccgagctgcgcgaacaccttctccctcacctccatcttcttcctctcgatctgctcctccttggccttgaacaccgacagcgccgacctcgacgacgcctcgccggcctcctcctccccgccgccgccgccgccgcccagcgacgacgggtgcttcacccgcagcaccatctgcatcggctgatccacctccccctgcatatccaactacccaatactgcaatacaccctctgatctgtactgcagtagtctacactggtggatattctttctttctcctcttcctcgcttcccgccatttataccccccgccacgatcctgtccctctctgccccccgtcccggcttcccgccgcggatgctgcatgtctaagcaacgggacgggatggaccgacgtaacatggctcctgccaatccaacctgcgggtgtatcgcacaagcaagagctactccatcgagaaaagaattgaagaaaaaaatggcggaatcatttcattcatttgtctgcgacgacggatgaggagtcgcttctgtcagaaaaacctggcgatgttaggttaggtgagacgagagctagcctcgcgcgagagctgtcattggcagtgcagtgcagtggaggggaagggatcccgatcgagtcgggtgagccggcggctgtcgccggttggtgcgcgcggccgtctccctcctcacgccatttttttttcctaaaagaactttttcgatcgagtgggctagctttcgcgctcgattcgtcccgcggcttagatttttcccgtctcgtcgcattgcaagagtaggcgatagccgatagcttagcttactgctttttttaattagggggaggtagtgagggggacacggcgccggcgaggcgaggcgaggcgaggcttggaagacacaagctgcgccggccgcggcgtcgccgtcagttcgccgtggaaagtgggaaaatgtgggcgacgacgcgtgcaggcttcggcggcgacggggagatgtgaggtggccggtccgatcggtggatgccgagagatgcagccgagctgaggcagagcagtaacgaactgttgctctgcacagcgagagaagcacggttacacgaacacagtggggggtttttttcgctgtcattttcgagatcggatcacaaatggtacggacacttgtgtaaggacaaaaagggatgcacgcgagagcatctcgctttgtgcgactgcaaatctaatgcatgatcactagatgatccatggttgttagctttggctgaaacaatgaggatgttagggctcctttgaatcaaatggaaaacggaggaatagaaaaaacataggattgggataggaaatgtaagtgtaagagaattggaaaatacagaaaaacacaggaatagccgtttgattagatcacatgaaaaacacagaagtcggatgagagagataaactcaaaagaatttttccaagaggttgaacctcttgctaactttcctctaaaatcttaataggattacctattccataagaattttaaaagatatgataggattcaatcatttgttttaaaggttaccataagaatattttccataagattaaaatcctctaaatttcctacacttttcctacttttcctacaaatcaaagggaccattactagttctgatttgatccttctatttagcaaagctctttgttgcgatagtttcagaatcaccgataccgatgtcatctttcataaaaagacaactgaagcggcagaaggaagtcggtggcatcaaatgcaaccaaaaacagaacagattcaaaggggtcatccaggcccaggagacagagtttgcagaagaccactactactaaaaatttgaagccttaaaaatacgaacagcacaatagatcaatttgggctaaggttcaaccgtttgctgaaataagttgtccaataacggagaatcactatataaagcttatacagaacatagtaactgtaagcactgcggttccagctgatatatatcctgttttctaacaagcgaagagggtcgtctgaatcaaatcagcaacatcataactggtggctctcttcactctcctggggcagagacaccttgcttcagtttttccctcttcatcttcttcttcgagactggcttctttttgcgaggaggaagcgtcttctgagcgtacacatagagagcgtagttcccgacaaagaaaagcagcaggaaggtcgcgaccacaatcaggactatcattccagggttcagtcccttgttgacctcctcaatgactacattgttctgaagaccagaaaacaaatctatcaagcactatgcatgacaaaagggcactgcaatttaaatgtatgtgacttctttatcgaaaaaatactatgaggcttgcagggttagaagaagttaacccttccataggagtatatgttacaagttactagacacatagagccagagcagagatatctgtggacatggatgagtctgcacatattgccatgtatagatctccatacacagataattcgaaagctagataacaattatttgtactgtatagtcacccacatctgtagttctgtacagtttgatcacagcacaaaataaagcttattactaaggattgcatgttttcaacactagcaactagcccatccaagagtggccaaaactaaatggaacatgatagataaagtgaagtggtctgcctagaattaccatttgcataagatacacaggatggctattaaacatatgcagtagacatatacaaggttggtagtaatcacatacaaggttgaacagagggaaatgggatggcagtgcataactgcatatatatattcattgaaaacagcagcaatctatgtcaacattcaatttcagcatatttacaggataaaaaatattcaaaatagtgaacaaacaatgtggacttgataactgaacaaaaaatgaactattggaatttggaaagcgcaaagttcgcgatataacttgattcaaaaattaatttaagtttaagaaactaaaagatcaagtgtacatcatggacatcatggtaagtaatactccctaatgaatggccaccgaatgtatgaccatgcaaagactactgcaataatccgacagatctaaccctacccataaaaaaagcaacaagtgcgtgaatccattggcactaccatatcaacggaacaaaagaagtataagaagcccgtaagttccttaccgcagagtccgcgaactgatccgccatggctgaccgggaccaaacacctgcaactctggatccaacgatggatcaaactctggcgaaaaaagaaaaagaaaaagaggagcaattcttaatcgagaaggggttgtatcaatctccaccaaacctcaatccctacctctccttttttagatattttatttagcctacggcagctgctgcactattccgctgttcgtggccgatcgatcgtcgggtctcgccctcccgcttacgggattcggttaaggagttcgatgatctgataggattggaaggtgcgagtgaggaatactactgaaatttttgggggagttctgagagacggcaggacgaggattcgagcgaggaggaggggatcgaaggggaagacaacaatatatttgggcagatgaccccacccagcagatggtcacacggtgcatgtgtcaaaatgggacaaaataaacatgtcatcgccacctgctggataggataaggatatccttacaaagacatagtaagtacaatcctattattttcttttattcgaatcacttattattaaataaaaatttatttgtgtgtaaaatttttacatggtgtccttagccactcaaaagcaaatgacctaaaataaactacggtgaaaaaccaaaaaatcaaattcaaaattaagttctagtaaaataactctctaacagcctctccaaataactctctaagctaaattttagccattccagtgaaatttccctccaacagcctctctaacaggatggctaagtcatatggctggccaaaaccctccccacactagccaaatttgaccagccaaaaatcactggccaactgtggaccccacgcgtattctcctcctatctcgttgccggccatagtccacagcgccgacgtcgtcgcatgcaaccgccgtcgcccgccgcggcctccgccgccgtccgcaccgtcgccggcagcggcctccgccgccatccatgccgtcgccgcccgcgacctccgccgtcatccgtgccgtcgccggctgcgaccgccgccgtcgtccaccgcaaccgccgctgccgaccccacgcacaagctggagcatgagcagagctgcagaggcacaagctggagcacgagcagagctgcagaggattggagaaaggggaggaaaaagaaagaggaggagaatgaaaggtgggcccattgattaatagagagagtctgttggaatagaagacaaatttgactctctaaatttttgttaggctggccaaattggtatttggagagtcaaaaatggccactctgttgaagatgctcttagggtgtgttcagcacccctttttcccagcctatttctctcgtttttcgcgcgcacgtttttcaaattattaaatggtgtattttttgcaaaaagtttttatacaaaagttgcttaaaaaatcatattaatctattttggaaaaaagattagtaaatacttaattactcacgtgctaatgaactgctccgtttttcgtgttactgttccgggttgggaaccagtgtatacgaagacaccctaagaggggccaaaaaaaagaaaaactatagtaagagggacattttaacaatctcatagagtatgacttgtgggctcacatttgtcaataatatgtgggtctaataacaaaatcgttaaatgtaacacgtgaaagtggcaaatagtaaatatgtgatagtaaaagggcagcagagcaggcccattatcatatatgaaaccttctcattatcatatatgaagtagatttatcatatactccctccgtccctaaatataagggattgtgggtgaatgtaacatatcctaggctatgaatctagataaagggtatgtccagattcatactcttaggatacatcatatctatttataatccctcatattttagggcggagagagtaataaattagtagtagttggcactatgcataagaattaaagcaacaagtgaatctattagcactatcataagtataggtttttcactcttggaaatacattttctctattttaaaatgaactaatttctatatctaaatttttaggcaagggttggtttattttggtacgaaagattgctatcatgtttggttgcttgatgcagagctgtgcggcagcaatggttgcttgaagcagttggctgcgacgcagccaatccaccaaacagccgaacaaggcctacgataatatacatatgccagaaaccgtcgttgtatcataatgttgcatcacatcattttgtttggctgtatgtatcatactctctccgttaaaaaaaaattaacctaggatattttgagttttcttgggacggagttcataactgtatattgtatattttgatggttatatattgtgaattggacgtcatagttgcgcagaggatcaagctggtgtggatacatgagatggtcaagactagtgacagtagccgagccaaaacagatcaaagcatcatcaaggatccaagggcaaccgggaccctggagcatgaaatctgtctttgtgggtttgctgataggcgtgcagctctcttttttttccgcgaaagtacgaaagtacagctattacaatcaacataagcgcatggattatgtgcacacgtttcttttgaaatgaagatttaatcaatttgccatttattaggaatagttagcaatataactgaaaaacgttcagatatgtatggcctgttcaggctcaatttaatttgggatgacgcaagcatcatcttgtgcaacaaacttgaaaatgcgaaggagggagcccaagctactatggcacgccggatgcatgtcagcaccaagccatcaaatacaacagaaaacagcatcaagttataaatcattcagatttcagattgcaagatggctacgcaggttgcagaaattttcaggcacgatcgctagctaaatcaaagagacacgcagaaacaaaaccaaaagaagggctcaatttgcagtgctgttcaacagattgctcaaataaggcgtctaatacaaatgtaaaccacttaggacaaagcttctacataacatagttactgtaaacactgccgctccagctgataattcttatcatgcaaaagaagctcaggataaaatcagtaacattggtaaactgacgaatctcttcactctccgggtgcagaaaccccctgcttcagcttttccctcttcagcttcttcttggagactggcttcttcttccgaggaggaagcgtcttctgagcatacatgtagagcgcatagtttccaacaaagaaaagaatcaggagagttgcaaccacaagaaggactatcgttccagggttcaggcccttgttgacctcctcgatgatcatgttgttctgaagaacaaaaaaataaactatcagaaaccaccctaaagattgaaaatataattgcgatttaggtagctggaaaaatcaaaatagttaacccttcaaacttatatattacaaggttagtatgaacaaattagagcagacatgtacacccttttgtacacatgggaaacccaaaagctgacttcacagatcagcatgtctaagcatgtcaacagagcatgtcgacaaattatgttcaatatggactgttcagttccactacatatctgttaccctttattcatacagatttatcactgcgcagacgaagcttaattttaatacattattgagtctgacatttcatacatttacatgttttctacactagcaactagcctataagtaagattccaaaaactagtccgaggtcagccaaaacgaaatagaatgtgtgtaaaggtttgccattcagagaaagatatgacggttaactgatataaggatgcatacagaacaacaagacacaagtgttcagaacacctgaaagtgtttgaaagcaagaacatatacatttaaaagaggcaatcatgccaacatacagttccagtggattcacagaacataaattataaaacactccaaatgagagcacacaattgtgctcttaattatttattgaacggaactacactaatgaaaaggtagtcatgaatgccatgaggacaaagttaaattaagcaacgattaaacgatcatgtatgtatcataaataaaatagcaattcagcagaccggcaagagtaaaattatctagtgatgtcaattcttgaaacacgttatacacaaccagacacactaacctaatcaggtagcaatttaatcattcagctaggggatattttcctttttgagttggttcatgtggctcaactttggtttcatatctagtctaccagccaatttgcttcagattagaggctgatgatgataggacacagctaaaaaaacaaaaaactgaagaggaaacggaacaaccataaaatttaccgagatgtaacaaaatgtatgaccatgcaaaaactacagcgcaaattctacagatctaactatccacgccaggggactgatccaacttgggacatgggggttcagtttttggggggaacaaacaaactgttacttgtattagttaaggctctgaaattaagagaagagcttcttccagatctacaagagaagctagggtcaacacaagcaaattccagacaaaagcaaatccgccgtaaaaacgcgtcgagatccggtcaaacaaccgaaacgtcgaaggtttcgcacccctaaaaccaagagattaaacagaaacagctcgcagatccttaccgactgatccgccatggcagcgacgatacccgcagcaccagacgacaccagctgcggacctctgtggatcgaaaagaaaattagatcagcggctttagccaaagaagaatttctcggaggaagaagagaccccgtggaagtgagagatctccacagtggattaagcccgccgtcctcacctctcgcttcttggcgcggatttctcacttctcttcctcccccccttggcgacaagctcgcgtgatctgctctgtcaccgcttgctgctcatgctcgttcgtccacccgccgtgtcccgcccggctttatgtatttgtctccgagccgagccgagctttacccgatttctcgtttctccgtttatctgtgggccccacatgggtgtttccttggcacatagaaatgggacgtggctgattcatggtcaggatctgccgtccaccgctggatttgtcacctctctcggtcagtatccgtctgatcggtcaacggtcaactcttgtgtgaaggaacgagttgaggttttggatagggttactttttttggataatgcgtgagcagcgtatttttcgaattgggcaaatagaagtggagtttggatgagggcattattttggcatgaaaaatttgatttgtaagttcttctcgagaaatattatacaaatacaagcgcacgtatacacatgcatgtactcacttatatatttgcgtgcacactgtactataatgctcgatatgatgtccctaaaagtgttgcattaaattagatgatgaagtgaatgagagaagtgaggaaatggaagatgagtcactcctcatgcaaggagcaacattcacacaaactcgaagagaaaaaaaataaaagaaaaagtggattagacaaacaaacaaaaataaattcattagggtcagtaagataaaggtagtgtagaggtgatgtattgtatatatcacctcttattttacatggacaaaaatagatgtggtaactacctcttctataaaacttgttctaaacactttcgagaatttaggctggtatattttgagattgatgaatttaccacatgtgctgacaacttaaggttgacgtagtttaaaacttgattttgaaaataaaaatcatctaagtctatttttctataagggcgtatatataaaagttttatccattaattcattttttctaataagccgtgtgacttataatcaatattaggacaaccattttgtgaatgaaaattaaaggagggctaaaataaaataagggtggaaggaatgaatggctaagattaaaacttacatgtgggaaatggtagtatatattttcctaatgccattagccaaacatactatgcgggctcctgtcataagtatttaatgtttaagagtaaaactgagtcaattttttattgccataattgtgatatcagtgtaattttatagaatctatgcagacttacaagttaataagcttatgatgttatgataatattccactatttttaaaggcaaatttatgcatataacttttttagaagctaattacttgaaatttatttacgatagtcaaggttttagaattatgaacaaatcttattttaagtatcaaatatttatcaccagagggagtaacttttgctaagaagatggttaaaagcgaaagtctaacaggtggaacaaaccaatgtagtagtagtagcccaaatcgtgtaggtttttgttaataatggaaaattcattccagcctttatttcaaagaaactagttaaactacagccaaatcgcttaggtacccagtaaggattcaatccaaagggcgaaactgctcttcaaattcatcaaagcaaagatcgatgtaatgtcacaccgtcaactgttaaaataggtgtcaaatatactagtcctatttggttacagttggacttggagttgtaataggtgttagggggtggagttagagtcggactctgtaacccgtcatttctcttaaatagagagggggcaccacaatgtaatcatggcgactacaacgtagcgtagacacgcagggagatgatggcggcgtggccatggactcgtagcggctaggagctatattggttggggaggagcgcccataatcagagccccggggatgtaggcttcggctgaacctcgttaacaaatatcgtgtgtttttgtgtcgtcatctggcatgtcttgggtgatcaatgattgaagcgatcgagaaggttagtcgtcgttccgctatatcgactaacttttataacaagtggtatcagagcataaggtttcagcattggatcaagaagacatgtggaggaggaaacacgaggtggggatcgcgcatcgacaggagatcgtcagccgtggcgatgagatcgatggcgacaacgaggatgttgcggaggcggcgacctcgctcgcgatcagaccggcgatggcggaacgtgaccggaagacggggccgggcgtggccgaaggcgaccggagagattggaggggtagcgccatggacggcgcacccgacgcacgcggtgaatgtggatccgcggcggcagggaggctactgacggaagggcgaagccagcgagcctggcacggcgcggcggacgtggagggccgatgacgatgaggtcgtggacggtgaacacgagggttgcgactgcggtgcgtacggtgtacggacagcgcgtatggtacgtgctatacacgcacaagacgcgcatctggtgaacaagaagtgcagcacacaaagagtccaatggagctacgggcagcatgcactaatttaattagtgtttgcatggtgtaattatatgtaaaatcatacgacagggcttgatgcatgtacgtgcatgcggggctgcagttaattgcatgcaatagcataacaaatatgcatgcaagccggtcatgcatgaggagagcatgtggcaggacatccatggatctcaacgtggagtcgtgtgcgtcagaaggccagagaaatcctattcgagcaagaagtggtgtgtgcaaatttggtggtggcacgtgacgctaaatgagatatattggagccgattcttattggagcttgacacgggcccgacttggactaggcagcattctatgggaaggattcatcgagtttgtccaggactcaggttcctgtccgactcggtgactaatgacgctctttaaaagaaggcgtcaggacaggattggctaagtaactcacaacagcgtaggcacacagaggtttgacacatcgtttggtggactatttggcaggcgacgacgcaaattgcacgagttcttgggaagaaggcgcacgggtgcgggtggaccaagccaggctgacacggttaggcagctagcaggcggctaaaccaagggcagaagatctggtctaatcggtgcagcaaacagtcggtttgctgttgaatgtctgagatcggatcacaagacgagattgtgaagacgaatacagacggtactgagaaaggcgagtattctggtggcgatagaccagtcaggtcgcgggttggcaagttggcgccgacatgtatgaaatttgatttggtgaagtttgacggcttcggaaattttggcttgtggcaaactagggtcaaagatttgttagctcaacaagaagtttcaaaggctttgaagggtgtcaaaccggccaagatggaggatgacgattgtgaggagatgcagttgcaggcggctgcgacaataaggcgatgtctttcagatcagatcatgtaccatgtgatggaggagacctcaccaaagataatttgggaaaagttggaagctcagtttatgtccaagactctgaccaataaacggtatctgaagcagaagttgtatgggctaaagatgcaggaaggggcggatctgacagcacatgtgaacgttttcaatcaactagtcactgatcttgtgaagatggatgtggaagttgacgatgaagacaaggccatagttcttttgtgttcattacctgaatcgtatgagcatgtggtgactactttgacgtacggcaaggagaccatcaaaactaaagatatcacttctgcgttgttggctcgtgattagatgagaaagaacaaagagggtgaaacatctcaagcagagggtttgctagtcaaagaagatcatgctgggcataaggtaaagaagaacaaaaagaagaagatggtgaagtgcttcagatgtgatgagtgggggcatataagaagggagtgtccaacactgaagggaaaagctaaggctaatgtagcgacttcttcaaatgactcggatagcgatggttgtgatcttctcacgatgtcaagtgcacagtctaaggatgcagaagcgtggatattggattcagctagctcgtttcatgtgacgccaaggaaggagtggttctcttcatataagtctggtgagtttggttttgtctacttaggcgatgacacaagttatccggccgtgggagtaggtgaagtcaaaatcaagctagaagatggaggtgaacatgttcttcaaggagtcaggcatgtaccagggctaaagaggaatctgatttcgcttggaaccttgcatgaagaagggttaatattccgcggtaatcggaataggaagaccattgagatcatgaagggcaagatgactatgatgactggagagaaggtggagtcgcatctttacaagctgcgagggtgcactgttgcaggtgtagtccaggaggaagcggttgctgggatagcaattgcttttggtggcggcgggtctggcgcagactcgtcgggcggcttgcggtgaagctgcaaagaagacaacccaagtctggaggaccggtggatcggcatggtgattctactacttctaggtggcgtatattcgccaaggtggagtttgttaaaataggtgtcgaatatactagtcctatttagttacagttggacttggagttgtaataggtgttagggggtggagttagagtcggactctgtaacccgtcatttctcttaaatagagagggggcaccacaatgtaatcatggcgactataacgtagcgtagacacgcagggagatgatggcggcgtggccatggactcgtagcggctaggagctatattggttggggaggagcgcccatatcagagccccggggatgtaggcttcggctgaacctcgttaacaaatatcgtgcgttcctgtgtcgtcatctgacatgtcttgggtgatcaatgattgaagcgatcgagaaggttagtcgtcgttccgctatatcgactaacttttataacatctacagattaagggatcaagctatcgacagtatgacaagagaagacacaagagaattatctccagtagaagtttcagccttgcaggtataccagaagtgacaagcgaagcagaaacataaattaagcaatttatagtctagattcagagacaacataacactacagtctacaggtcagcaatcttcaaaatgtaaccatagaactcagtagtcgtagtgtagattcagaaattcaactaaacataggaaagaacagaagcctaccagtggcatcacaaatacagtactcttcagcatgaaatgcatcctactaggtcataatctagattcagaaaggcaactaaacacgacaaaaagagcagccaacagcatcatgaatactggatagcagtcatcttctgagtgaaacctcaaagctcaaacatttagagcgagttcagtagtcagcgatgataggtgtcgaagggatcaggcagagtattcgcaagctctaagctcaagtgctcgagatcatggctttccatgtcttcaaacacgatctcagcttctgtggaggccacgtggctttggttgagcagagcttgctgacctgcaacgcattggggggtgctgaacaccttagactgaatcgtcatgagctgcagcacctgtgctctagcaaggagaaaacatgcaaattcaagcatgtagatgttgtgaactttgctttccagtcggacgctgttgaggtggttcatgacacacccaatgtgatcaagcttttcgtggtagcttgagccaacagtgtcggtgctatcctgagtcagatcgaaccttgtatcagaggcctgcacggaatgatgaatccaatgaatctgtgttcagctaaattgaacaggtagtacctacacagacagtgcaatgcaagtattgcaacagctcaagctcaaccagttacctgaacgtgcaatgtctccacgaaaggaaagaaatttagcaagttcatcagcttgtccatgtcattcttgctcgagaactttacactgatagccagaatcttcacgctcagaagcggagcacgcaaaccattacagacatcctgatgcaatgcacaagtaaaaataactcagtgagagcaactaaagagtagagtaggagaacgacgaggataaatgaaacaagaaaccaccttctcaataacctcgtcgaagaggaggaaattggacgagctgatcacgacatagccgaaagcggtgagctttggcgcgccagagacgttgatggccgcggtgaggcgcatgtcgccgaggaggcgctcgaggcagggggcgtcctccacggtgagctcctcgaggttcttgtactgccacacgccgagcagcacgaggctgcggcaagagcggacgcggatgctgcgggggccctcgacgtgcttgagcatgacggtgcgcagcgcggggcagccggagaggacgctctggagggcggcctcggagaggtgggtgctcgacagcgtgagctccgtgaggcgggccgcggaggccccccggtcggagacgcggcactcgccgagggcgagggactcgagggtggcgcagccgaggagcgggtcggcgagcgcgaggtggcaccactcgggcgcgcagaggagggcgacctccctggcgcgcttcgcggcgagctcgcggaaccaggcctccgccgcggcgacgcggccgcggaaggaggtgcgggagaggcggaagagcgcgacggggcccgggtgggaggcgagcacgcgggtgacggcgtcggcgcgcgcggtccacggcgcgatcggggacgaggaggcggtggttctggttcctcctcccagtcccagggcggcgagggcggggaggtcgaggtcgtctaggcggagcggggtggcggcccacacgccgcggaagcgggtggagagggcggcggtgcgggccgcctcggcggtgccgaggagggagaagatcacggagaggagggcgtccgggagctcgctgatgtagtcctcgccgcctccgtccgctgctgccatctcgccggcgtccggggccccgcggcgcgcgctcctggctgggggtttggagaggatttgcaggttcagtcgaaagagcagtgctgatttgtgcgtcgtggctcttggctctcttgatttttcacaatttgatctttttgaaaaacttattttgcaaatagaaatcacaatttgatctttttaaaaaacttattttgcaaatagacccataaaaaacttatcacaaaaagagtcaattttttaggtgctagagtcattggcgccgtcctcctgccaccgtggcgggtcggcgctaaggtggcagggggagcacgctaatataattggtgccgcctaaaaaggactattttcggaataagttttttcaaaggtctatttgtgaaatgagtttttcaaaagaaccaaattgtgaaaaatccagcttggctcttgcccatggcccatggacagtgttgatttctttcagctgcaaatctgcagtaacatatattttttttgggtaaaaattgctacagaacactcaaaatttgtatgatttgctggtagacataataaaaacatgtcatggttgaaatatacttaaaaaaactagtaatttgctggaaaacactttcggttcatttggagagaaattctttaaaaagactggaatgccccttagggtcaaaagcttttgagcggagactgtagcaaaatgaaatatagtgtgtactagtgatgtatttgagtgatgtatttgaggtgatggcaaatttaaacttgcataatttctaaatttttactctaacatcatgtttaaagcatttggtcagggcatctcatctttcttaagaatttatcaatccaattgaatcgaaagtatcctctatcaaattaccattttctaggatgtctttttgccgtgacacgtttttttacgtctatcaataaattgcaaaaattttggatgtcctatagcaaaagttgcctatttttttactactttcgtcccaaatataaggagttttagagtttgacacggttactaaaaaaaatatgtagattaaatagtggaatattgtgattggttgagaagtggagctaggtgaggaaattaaatggtaaagggttgtgatttttttttttttttgaaatttggtgaagggttgtgattggttgagaaagaaaatgttgatcgagaaaaattgttatattttaggataaattttaattggctaaaaattgttttattttaggatggagggagtacttttttactccagtttttttggcaggaaaactaagagcggttagtcgaaagtaatttgaaaagatttggatcaatacgctatattgggctgtatttggaagtaaggtgaggccgggttaggctttggttgagtaacaaattcggccgtacttctccttggcccattaaacaaaaacgaatgtttaagaaaagatgcatataaaatgcagcgaatgttggaatgtgcaacaatatgaaattcctccaaaagactatgcaacgatataggagtatctcgcaaggagatcgaaagcgcgaaaaagtagcacaagcgcgaatatcaattttcatcattgactaatcaaacacagccaaaattttaaattttaaagcataattctatatttctatagttcgttttgaaggttttttttttcattcattcttctgcggcccatttaaatggtttttctgctctgattgcatgcattgtcttatctcaagaaatatgcagtaacagactaaagagaagcttattgagcactaaatacaaggagaaaaacatttctgtcgaacagattattcataaacatacaaatgccaaccgatatcgttatgtacaaaactacagcgaatgcgcaacataggatgggtttggtatagctctgaaaaaagccgttcaccctggtctatttccttcacgagtcactcgaaaacaggagctcatcagtaggcttttctacctcatcttcctggcattggcgatgaaacacaagcccctcaaatcacatcgtcagggcagcctttcttttcacctttcacttgagttgtattccggcgtcattaccaccaactcccttgagttgttcccccaatgatcagagctgatcattagtcct

SEQ ID NO: 42943 - DNA, 2368 bp, Oryza sativa
taaatatttgcttgagaaaacacatacggtcgattgtgaacctacaaatgattacctaaggaatgaacaaatgggtaaatacagagaactcattaaattggtcaaacctaaggtttcaagctctaatgtaagttagcaaattaccacacattaaatttttttcagcaatatttcgtgtcaaatagacgttgggtgctagtgaagcaataaatcattgtaccaacagaagacaaccaatatgatgaaacaaagtcaattattcaattctttttaggtacgaaattaacagatagtaccttatccatcaaccagaatgcaatagtcttgtcaccaactagtgcttggtcatgactttctgcataagtaacacacttctctgaccaccttctattcgttagggtgtgcacgatatcacccattttccaatattcgtcactttgcctgcattaaagaaagttggaatttcatgacaacatatttggaagttggaacctacccagaacatacattaatactagctctcagtaactcataaaaaatatgattaaaaagtgtaaaagcagctcttcaaagggcatagcagcagtaccaagatggagcactagaccagtaacatggcactataaaaaggagagcataactcaatgatatccagtaagttagttgaatgtctcaattttcagatgtacaatcaccgaagttccagcacttacttgaggagttcgatccatttgtccggtacagccatatgcaaacgatagtcaaaaccaacaccaccatcttgaacaggaatacaaaatgtgggcatcccgctgacctgaacagaaagcagggatgtaagttcaaccatgttgctctcacaaatagtttatagcataattaaatatatatttggtatcatatgctagccccattttgcattgtgcaacttaaataaatcaaattacattttctcatttaatgaagaatagaaaagaatgctgttgagaaactataaccatcaaggaacatgcctgttagttcttccaatgcccttaaactttatcaattggggacaaatatattatattttatatctggttgggaatagatactaaccgctttcacccaactaaaactaattaattggtttgtgtgaagtatcaatatgacagaaaagcagataccataagcacttacatcttcaccaatggctacagcctcaggataaagcccatgaattagatcgttcaccagcatcaagtaaactactgcatcaacatcagtagcaaatccaaaatattcgccatagttgccagtaaatgccacctataacaaaacttgacaattttagaaaaaacagtagcaattcccatcaggggcaaacaatactagaatgaaatccaagtatcagcagcaggagtcataataaatccattcaaacatagcaatggtttctgcaaaaggacattaaggcatgcccaaaacagaaatggcagcactctgaaatgcaatttaccagaaacacttgataacttacctgtaaaccatgatgagtatacatcatggaggtcaccccatcaaatcgaaacccatcaaacttgtattcttcaagccaccaccttgcattcgacagtaaatatcttaaaacctgcaagaggacataatgtatgcattggtaaggacagagtaacggcaatagtgaaccaatctatggtgacaatagtcaactgttacatacttcccaactcccatagttgaacaggcgagaatcccacatccagtgatgaccccgtggtccaccatggaagtaatgtgtatcagtaccatcaaaaccattcaaaccatccagggtattgtttgatgcatgactgcaggatacaaccaaaaagaaagaaagaaatggtaaaactatccaactaaaaaggatcaactaaatcaagtggatggaaaagaagtaaaaaaaattatctggtctataaacacatgaataaaggggttaagtccaagtacaataggttccgaactcttcagtcaagatattgacatgtatatacatggaactctttatggaataaacagtgtcatgggtggacgccagtaatctaaaatactagatttacacagacaaacaaatcaacatttcactaattacctgtgaacaatatccataagtacaagcaaaccaagctcgtgagctttatcaatcagagatttcaagtcttctggggttccgaaacggctacttggcgcaaagaagttagtaacatgatacctgtaaaaagaatataacaaagatcaaaccaggtcagaaacagaaagaatagttgcactattggtgtccacacaaagaaatttgttcagaaatttctgcatgttcagaacacta

SEQ ID NO: 42944 - DNA, 2912 bp, Oryza sativa
taaacctgctacataaatagaaagaactagattgcattctacaaagcgaaaaaggtttcaagacaaaaaagaaaagtcaaaatattaataacttattggcataccgggctactcattccaatatgtgattcatatatccgcagcgaatttggtcgtttaggttgaggatgttggaatacatatttttcctgcagttgcgtataaacaacattaggagatggaaaataaaggttaaaatggaatatcctgatcaacaaagaaaaaaagtagtattacacagttctataaggttttagtgacacgagcatagatttttttaaaaaaaatgcaatggaaaaatatttcgtttaaagactgtaaggtagaaacatacttcttcaggtggatcataatatataccgttgtacggtatttcacctggagcctgcacagcaaacttaatccaggcaggaattgaatcctttacgccagatggtgtatccatccgaatctggaaattaagaaggtgaaagaagatctctcagtaagctcattttgaaaatgattaaaccctcaactaagtaaatagccaatcagaaaacttacctttacacgtgagccatgaggaatagcaggggatccatcagcattgttaggcagggaaatctcccaaacaccatactcattctgaaagtgatcatgccatatatcaacactaataagagaaaaaacgttgctggcacatgtaaataggctcgtatgctgcgaaatacacccttctcatgtcatataataaaccagtgtggatggaagtgtacaaaattcaaggcgatgtttggaaaatgggtttgggatatgatttcccacccccaaagggtaagttttgatcttagccatccattcatttcacccatttcatcctatccctccattcatttccatttcccaatcccacctctcctaacccattttccaaacacaccccaaaaggctatattaaccattaggatgcaaaattgcatgcatgtgtttactgtttaccctaaacatgaattctgctattttggactcaaagaagatgatagttagtaaagtaaggaacagtgctctgttttcactgactttgagacaatatagagtagcagcattttagaatgacacacgtgaggttcaactttaaggaatataaacagaaataatgaacccagataattgaaaatatattaatgatacaatacaaagatggaaaataaaaaggttgaagacgtactctggtcatagtatctgcatttgggttccaattgttgaagtcacctactaatgctgcagactgcaataggatgaaaatgtcatttttaattcttaatgtgatgactgtttgaaaagaagttcatcaatatatcatttgtgctactggtataattccagtacactggatagggagtagtgaccactgccaaatcacgtacctgtgctccaggtgcccattctcggtaggtaatgccttcagcgctggaaaggacggaataatgatattgagtttgatcatttgatatccaagtagaatattgtaggcatttctgtagtaatgcgactttaattttacctgcgggtgaatccaagcttttcgtaaccacgagaaaatgcatccaagccaccttcatgttggtcaatagctgcacgcattctcttgtattcactgtatctgttcataccaccatgcataccaaaaaagatatactgaagttaacagagtaggtttcccaacaaaagcgccagatatcagaaattaatttgctgagttgacagagaagtgaggggattaaactatgcagactacttgccacatcctttttggtatctctagtgatcagtgccaatgatttgtattgcatttgtgagatatcacctctattttcaaatattataccaaccttaatcaaaatgaaaaaaagtaaataactaaccggtagtcaagatggttccgaaatccttccagcattgggtcaatttggtatatcttctgcccatctcctggtggtgggataactcgtggtttatcctccacagttggttcatcagcatctttgatcacaccctcagtcacattttcctcaatgtcttgaatcacttctgaagattcaagtttgtcttcagccacaacctttatgcttgcttctgccactgctggaatctcttcctcctcctcaaaaggttttactttattatcatcaggtatctacacagaacatagatggatagactctgcatgagacacccaaaaagaaaaaaaggtacattcttttgtggcaaagttgctagttggaagacccaacttggttttcagtagcccaacagccagcacaaggtcacaatgcacaaaacacatgaaacctggcattgccactacatcatttcatcacacatttggtcagtgaatgacaacagctcgaattttattcccggcattacctgagattcttcaggttgctcttgagtttccacgtctggttccgcagaggacagcaagtcgtcgctcccaccgccaggcaccagcaccttcccaggagcacccgcgcagctcacaacgccacctgcaaatgcaaagccgactctactagtcaggcaacgccataccacccccacttgcaagttgcaacaataaataagagatcatctgcatcagcctcaaaacgaaacataaaaaggaattagagaatgatcacagcgatttgtaacactaactcatcttatccggcaagaaaaaaataaactctggttctcagaattcagaaacagtgatcgcttcggtgcacccaagtacccaacaaagtgcacacacacatcacatacggatcgagagataacagtaaaatgggaggaataacgcatgcccgcgaggctgtgagctgcaatcgatcaggagaccttct

SEQ ID NO: 42945 - DNA, 1926 bp, Oryza sativa
ggggaggggtggggcccccgcggtgtcgccttctcccgtggctccgggtgcagagctggcagcggggtggggccagctgggccaggtgacgtacggcgttggggggtaggggagatcgcgaaccgacggtggagagcgcatcgcagagcggcagaggccatccgttgtgttgtgggctcctttctctctttttcctttcttctttttttttacttttgttttctgagaaaaatgaaccgtaaaataattttgtactttacagaggcctgtttagcacatatcagaatcctctgcaatcgaagccatataactttttcactgatatataggtccgatgatccttgagtccatatattagtgacaaaggcacttgcagagaatctcaatccatttagcacaagtttagctttagctttacctctcttgaaaccgaaactcagccaaacagtttcagctctacttaaaatagaaacggaactgggtgaaacgctttaacaaaatgaactaaagagatgaatatgggtttatgctgctctacaacttcactccagactcaactcttatagttaaatttagaagttagagttataagaaagaggtccagagtagctactcctttttcacatgactagtgataatgataataacggatcgcccctggttgcatcatggaggtcatgtgtgtcacgcgcccactggtactggtgcctcgctctcgaaaccgtccatttggtttccaagagagtgactggccatgggtgatcggtggcaatggcaactggcaagcaagttggtcacagcttcatggaagaagacaaacgaaaatctcgagacagagagttgaggtggaatatgctgggcgtgcttattcgctgtattgctggatgatccgataatcccccaccaagctaggttaacacttaacagcgtagttttttgcagcatcaccatacttcaatcttttgttgttactttttcaagattcgctcaccttgtttgagcgagtgttctgacttcggagcatcgactgagaaacaaacaggagcacccagatctcactagccagtgtcatcacgcaggcatcttcaattaattagtgattactacgtagttagtaattagcccaacacctggaaacgtgcaacaacagcataatttaacccctctcgatgatcctagatacgggagaaattattattatttatttaaacaacaatgtctatcggtgaactagttgaggaagaagagcagccgtctgaaactctgaatgaaacattggcagcctcgttgccgtccgtggtccctgcccttggacttgtccggtcgctttctctagccacaggccagatcgccggatcaacgtcgcgagggcacaccaaaaaggcgcggccgcgtacgacgacgggcctaccgcgccaggaggcgcgcgctctcccgcccgcgaattcggctatccccgtggcgtccgatattttggcctttgggacccttcctctctttgccgctagaatccacggcccgagagagcgaacgagtctgggccgtgcacgcgcgccgttccaaatctgtgtgtcggcatcaggaaagggacaccgggaatccagattacaacttacaagaaaaagaaatgctgatgtccaaaaggccaggtcattttcctctcaacagaaaaggcaggagaatcatataatctgttctgttcatggcaacaaggaaggggaaaatgagttatcttcgtagttgcggacttgcggtctcaaggtatatagtggtacagccatagaaaggaaacggcagtaatttacatgtgagatttcttgttttgatctaagcacgctaggtgtgtttcagaattcaaattccttcagatgttgtatagagcacttatcagtcatccagtagctgacgtgagggcctcagtaagga

SEQ ID NO: 42946 - DNA, 9657 bp, Oryza sativa
aatagataagcacagaggatcctaatccaatgaaagtctagttgactaaactcaaatatagattatacgaaactataaacactaatcaacaaaacaactcttggtacttcctatgctcctgatgattggccaattgctgttgcctttctaaaagactacaacaccaagcgtgctcaagcagtcaagctaagtggtgtactagtgcgcgaccagtgccaccatatgtgtgatgtgccgcacatggccacgcaccgaacaacctagagtcatggaggcgggcagccagcctcgtagcatgccttcatgtgcttggcgatcccagcctgtgaaagacgcttgctagtgctcctagctgcccaaataaagtgctgatttgcctgctacgcagcacagcagagaagccgttccactgttgcaggccgaggagcctgggcgcccagggtggttgggccctagatccacccctgtatgacaaggtaacgccacaactcacaactagcatggataactgctaactctcaggagctgttgtcaacgaatccactgtctttttgtttttacctagaccttgattttagtggcgtttcctactttcctcctgttcctgtacaatagtcgcctcagttgcaatttgtaaataagctaaaccataaaaaatatcaatatcaagataaactaatgaggtttctataggggggttaggacataagaacaagcccattttggccctcgaacattgctcgaattccagttctcaacctaaaactcaacagccacatatttttcacactgaacatccaactccaataccctagaacctattctgtgaaatgttggccaaaatggtgatctttttcgcaaacgtgcaggtttggctaacatggacccatctaagtggcatctaccccgaaatttggctagtgggagtccatgtcagcaaaaccaacttgaaaaatggttcaggaagttatttctttgggtttggaagttggggatgcaaaacagcaggtttttgaagtttggtgaaaattggactcacaacagagttcaagaaccaacaatagatttttccttatgcctatggaatttcaaaatggtatgacaaaatacaatgaaaccagcgaaacgcacactgataactgtttactaggaatactcaatagcccactgcctgtaatttttaacagaatgtcatttaaaacgtgagagcaactttaataaatctgactgcatattaggttatttttctataaattcaccaaggctatgtcaaaagtcaaaacaaattaactggtttaaacactttatgttaagatgagatagcacaaatatggtccagtgcctctacttggttcataataactaaagattatcacactcagtaaaggatttaccattttattttatctcacctttcagggtacgtaatccttcagtaaacgaacttgttaaaaactttatttcttagaggggactaaaatgtcttgacatggcataagaccacagaggaaaaaatacggatattgattttctcagtttagaatagtgggaactgggaacagaccgttgctagaattaaactccaaccctaagttgggtcatttacagccaaaatcctactagcatgacacaatattgacccaacaaacaatgatgtaaagatctatttattgtatatagaaagcaccttgaatactgctcaattatcaaagtgtttatagatgcatttgtgagactagaatagcatctaaaatagatactaaagaccaaagtgttctgcaggatatgttgatctcttcgctatagtagagaacaatggcactttggtgcattgaatgatacatctttgaggtatgtgagaggggattgagtttgcagaaacatcaagttaggcaatgcgaaaacctaatagaagcataacttttatgttgtggtaccaagagtgtgcaatctgcaatgggatgaaatatttgctcacctttggtatgttccaaacgtcctgcctcccgcttagcattgcaacctttgatatctttgtatctttagttctcaaaattctaaactgttcattcaaatcaatcgacctctccaggccagcatgaaccgcaataagcttacaaataatctgtccttcgttagtatcaatgggtacattttcctgccatacaaccatgcaaatatctaagaaacaaactccctttgcacctctcattatactttgcaccataaaaggatagcatacctcctcatggatccaaaccaattcgcgcagaaattttttgtgctcctcaggtacagccttcacaagatctgaatgacaataaaactttgtaagcattggtggtttctattgaagggaatcagggatccctccctccctctctcaaaagctgtatttactggtaaaaacaatagtagcaaattagaagtagctttgtatagttgcagcgggagttgtactatgaaaccatgcttacaaaccctgcacgagaggcatcaattcgttgtttgctttcattaggtgggctaaatgacactaccttgaaaagttaccttcactgttggtgaactgctcgctagcttgctaaattttgttatgttgagactacaggtcatcgaagtactataaaataagtttggcgctaattctgttagtgtatacaaaattcacctgtctataaatgttatcatggtcttatacttttgtgctttgtaaacagtactaaagtactaattcctaagattgtaactagagaaatagacaattgtgcattgatttcatatttcctggcatttggatttcagaacttcttttaaggtttacgcattgtatagcattttaacattttgggaaagcaatcagaattttcaagtttgaagccaaacgataacaatctagagagttactagtggcttagtgccagtcacctatggtccgttatgttccattgcaaagcatgaatacagatgaataaatcttgtgcggtactcctgaacactgacctggggatccatgagcaacgccgtaggactcgaaggtagggcgcgcgtcgtagatggagcccatgtacgatgaccccctcttgggattcctcttctccttcatgatcccgccccatctcctcccctggcaatgcatcccctcgtggccggggccacggtaccacccctcgttctcctcgttctggatgtactccccccaggtggacgagaacggggtgccgtcgggcggcggcggcagcgccccgacgaaggcggcgaaggcgaggtcgtggttgccgcagaggaaggcgtggcgctgcgcggggtggcgggacgggagcgcgaggaggaagtcgatgacctcgcgggtgctgggcccgcggtcgcagtagtcgccgaggaagacgacgagcgcggtggcgaaggcgtcgggcgggagcgcggactggaggttcgcccacaggctctccagcttggagatgtagccgtggacgtctcccacgcagatcaccacgcggggaggcggcggcggtggcggaggagacatctcgccgccggcgtcgtttcctgtttcccacaggttgctgataacacaccacagaaagagaggaaaagtagaattccaatttccaagtagcccagggaaacaaacgcaccgtccgatgatggtgacaacacgatcctgaccgtccatcctgatgccaactcccctcttcggctcctccaatcctctccagtgcggccggtgcctttctacagcggcgttccactcgggttggtctctcccccgaggcacggccgccgccgccgccgcgctcggtctaatcggaatctatttctcgacgcgactccgcttccccggctcccctctcacccttccgcgccgccgccgccgccgcttgtagtggttggggggcgagcggccgctcgagagcgaagcgatgctggagaaagacaggatagcctacttctacgatggtacgaccgcgcattcgctaagcccccctcatctcctctccattctccctaatcactggagcaaccctagctctagctctagatgatagagcgaaatcctacgccgtctcgatgttgtgtggcttaatttcgtcgaagaaggggcatgcaattagtacctaagctgatttctagtggtgttatatgattgtggaggttggagtggatgttacggttggacggcttatgagaaattccagaactatgaacttcccaggacttgttcaactaggatttgtggtatttcagttgccctagccctaggtgcatgacgcatgattcattatcagtcagtaacataaggtggggaagcaacccttgaatcaagatttgaattagaatcgttgatccctttatctgtttaagagggcgcagtcaggctagatttggttaacaagttcctatattctttagcgccagccattttctaaaaggtcaccaacgccagccatatgtggttatttcttagatcacacataaatttccatgataagttctctcacatattttgtactaggtggtttcatgacttgtgccctcattcacccatggtcctttacatctctgtttatagagagccactcattttgcagatgtgaaaggaagttttcattgttcaaaatgtgtaatttttattactcattttgttttgatcgtttacctttttactgtgtcaatgaacaattcaggcgatgtgggcaatgtctactttgggccaaatcacccgatgaaaccacatcgactttgtatgacacatcatcttgtgctttcatatgatcttcacaagaagatggagatatatgtcagtatgaactttatttattcccttcgtttgcacttgttaactgcctaaagttcctttcacctcttacttttcacacaacgatttatgcagaggccccacaaagcatatccaacagagctcgcacagttccattctgctgattatgtggaattcttgcatcggataactcctgacacccaacacctgtatgaaaatgaattacgtagatgtatgaattatgaaacttttctcctctatgaactagtactctgggatttgttaattttacaataaaatggttgtcacatatcttgctactcatgtttaaattattataaatttatttattaagttccttacctggatctaataagtagcttagatcttcatgtacagttaaactataaggaatctcatacacaacttaaggctaattagcttcacttacatgaatgctgtcaggtgtatattcacgatatgcctatttgacaattcaaggaaaatgagggcatgtttggtcccctttcaagctcaagcaacttcccatctaacgctgcctagatagcgttggtgtttagtacagcttagcaagtcattcttcataggatgtatatccttgcccattgaagcgcatcccttgtggtcaaggtttacatgatttggtgcactaaatagttttggatatctttacagtatttatatagtattagttgcactcttctaggacacatgtgcttattttacagtttcagggcaaaataactgaacacctaacctaagtagcagagtaatctggacaaaagatccaacttacccactcttagagcttttccccaattgaagttggtttccaacataatcctcatgccttttggagctttctaacttcatttatctggttccttcatatttgttcccagacaatcttggagaagactgcccagtctttgataatctgtttgagttttgccaaatatatgctggaggaactctaggtaatatgaaaattctgaatgcttctttctaaagtgaactcttaagttcttctttgctattttagatgcggctcgcagattgaatcataaaacatgtgatattgctatcaattgggctggtggattgcatcatgcaaagaagtgcgaggcatcagggttctgctacattaatgatctggttttgggaattctggagcttctcaagtaccatgccagggttctctatattgatatcgatgttcatcacggggatggagttgaagaagccttttatttcactgacaggttcatgctgtttccaataaagtcatggatatgtagttaatcatttattgctgccaatatttttccaatccaatttccatctctgtgcattttgtgaattttggtggtaccataatatttatactaattccagtctcgggcttttgattttgcagggtatactaatattgtatacttattttgattttgcagggtaatgactgtaagtttccacaagtatggtgattttttcttccctggcacaggtgatattaaggtaatgttccactaacaagctcctgaatattttttatgtactttttggtatgatgtggttggtgattggcccttctctgcattctgttttatccttacccttttcgcatgaagtgtgtgtgacatgcgtactctcatttgtgtgaaaagagaagagacagattaaccaaagatggtccccagttgattttgtaatgcacaaaattgatagcacctgtaggtaattgtttatgagcagttaatcttgtttctttttagttctacccgccaagaggctgtaaatatgtaacatcatagagttgaactttggttttttttactggagattcttggcatgttattctatttaaatatcaaccattgtaattgggaattcaggtggttatgtatttgaaaaacgtcatactagaatgcatcataattcgtatacgcatgcttaattgtcatctgggctgacaaaaaaaaaacatgtgcacatatacgcccgtcatttgaatcttgtagtatgttaatttgttatgtatccactgtactactaggcaactttattaaataaaaatatcccaaataactggaaggtagagcaagtgtgctacaaaaagggcaaggttgaaaatgaacataaaacatgccatgttcttctcagtaacgatgatactttatatagcttcgttttaaatgattgtgctgcttcatattgatttacctgactctcatttgaaggatataggagaaagagaaggaaaatattatgccattaacattccacttaaagatgggatagatgactccggctttactcgcctttttaaaacagtaagcccactttacattactttctcatctttcatgtcattgtttagtcttatcaagttatgcatgtctattatgtaggttattgccaaagttgttgagacatatctgccaggtgctattgttcttcaatgcggggctgattccttggcacgggaccgtctggggtgcttcaatctgtccattgaaggttctgtacttcttaaatctgatgtgtacttgttgattcagcagaactgtgctctagatgtaaagttagtgaactgtgctgcatattcttggatgagctattagggttcaggcggtatcttcgagataatgtgaaaccttctctcaagtctcaattatttcttaccatagttttgagattgttattgcactaatagttctgacttattttgaaatttaaattttgtttctttgagctatacttagtgaatgatcttttaatacttgcatgtgtacttgcaaacaggccatgctgaatgtgtgaagtttgtcaagaaattcaatatccctctactggtaaggagaaaccgttactgcgtgtgatttctcttgttcctccttggatatcaatgtatttcccatcatgcaggtgactgggggtggtggatacacaaaagagaatgtagcacgctgttgggctgttgaaactggtgttcttctagatacggagctcccaaatggtattcttttcttttgcaattctgtacttctcggtccttttggcctgttgttttagaggacactactagtaatccctcaaatgcatgcaacagttcatgtattcttttcctcacatttgctggcatatcaagttgcaaacagatctatcaagaacgggattgactagtagagttccttaataatttctaaaacagcagtctgtgatatgagttttgcatgactttcctttgcagaaattccagacaatgaatacatcaaatactttgctccagattatacattgaaagtatcgaatgtgaacatggtatggaaccttttctcattggcctttgtttgtcctacggttgtttggtgcattgatatttgattgctattaggtgcatcaagtaactgtccttttattactgagtatggtctaagcatttgagctctgtagtccatttggtatttcggctattcaattggtttgtgtttgctagaagtttaaaacttgcgttcctttcttgagaatgtgcaaatgccatatcacatgttgtgttttaaccggagcaggacaacttgaatagcaagtcatatctaagttcaatcaaagtgcaagtcatggagagtttgcgggccatacaacatgcgcctggtgttcagatgcaagaggttagtttttgattcacttacacgaggaaacctcccaactggaatttgctatgtaaaaaaaagggatacaagcaggacactataatattcctttccttttgttgcctatctttttcttcgttcaacatatttctgaacaagaacaatattaacatttttgcaggttccaccagatttttatatcccagatattgatgaagatgagctggatcctgatgaacgtgtagatcgtaagtgaaatactcctgggatgcattaggatgctaatatgtctgggtgtctgctgttccaagaaaacgaacggcagacagttgttttttttagtatatgttgtgtgttccacattatgctagtcctttcttcgtgttgttttcagacctttgaactttatatcgtccttatacattaactgtgtaaaatgttgcgcagagcatacccaagacaagcagattcatcgcgatgacgagtactatgaaggtgacaacgacaatgatcatgaggacggggcccgttgaaaaaggttctttgtatgatgaaactggatagagaaagtctggtgctgttgcgcggtttaacagcgttaggtgggaaatactgtcaattgacttgttaggatctaacacctttgcctgcatatagtgcgtgtacgttcctactttttaatcagttacatatgctagttgcatgcagagattgcaaattcttagtcggtggtaatgattcatagtttttggctgcacacatttttcctatctttttttgtttaaacccggcgtatgtggttatcaggttggacctactctcaacgtccttaaaaagaaataaacttctataatttggatatactttgtgttagctttttctttaagatagagggagtcagctggtgcacacgttttcctaagagtgtttcgcactgctctgtcaacttgagccagatcgttctcgctatcaaattgggcctgatcggtaggttttgggccaacctgagctgaacgcagaggcgttcccgggcagtaacggctggcccacctgtcacgttcactcacgctacgtgcgcttcgagcgttcgacggtcacggggagtcggagtcgctgccaaccaaagcgggcgtcgttgcgttgcgtggcgtggcgtggcgtggaggcagggggaagcatcgcgcgcgcggcgtggacatgtgt

SEQ ID NO: 42947 - DNA, 11482 bp, Oryza sativa
gtcccagctcgctgccgggtccgcgccacgaccacgccgtgaagaggccaggcggcgaggcggcgggcgggaggagcgtcaacggcgccgctccggctccagctcccgctcccgcggaggcgccggcgaaggcgccgcagaggaggcagaggcgcgggcctcatgacgtggaggacgaggcgtgggggctgctccgggagtcggtggtgcgctactgcggcagccccgtgggcacgatcgccgcgtgcgaccccaacgacgccagcccgctcaactacgaccaggtgttcatccgggacttcgtgccctcgggcatcgccttcctgctcaagggggactacgagatcgtccgcaacttcatcctgcacaccctccagctccaggtgatcacccgccctttcgtgtctcaacactcgctcttagatttttggttgggtcccaaactgtcgaaagagaaggactaatcactaatgcttatgcaattgatggtgatgctcctaataattgtactgcatactagtagtactagtagtagtgaagagggatgatttgaaattgacaagtgagaagtaaagaagcaaatgtaattatacttgcaattatggccagcatagtgactgcagaaggactagccaacgaggaaccgcctaccaaaagaatcgcaacaattttatacatcgagttgcatagattgctatagacatgctttcatttgctgaagtcaccacccacttaacagtagtgtcaagaattgtgtttctaagcaccttcttgcttaaataagtcatgtgtttccaatatttaaatctggagatcttcttctcttaaatctgattgttaacatctgcagagctgggagaaaacgatggactgccacagtccaggtcaagggttgatgccagcaagtttcaaggtgcgtgttgttccacttgacggggacgatgatgtaactgaggaagtcctggatcctgatttcggggaggctgcaataggacgtgtggcaccagttgattctggtgggtatagatgacgttccttatctcctattttgcgcacagcataaagatgtggcactttaacaatggttttcaggtttatggtggatcatattgctgagagcatacggaaaatgttcaggcgatctgtcggttcaggagagaattgatgtccagactggaataaagatgatcttgaagctctgcttagctgatggcttcgacatgtttcccaccttgcttgttactgatggctcatgcatgatagatcgtcgaatgggaatccatggacacccattggaaattcaggtagcatgaaaatttaacagagtgaaatatcataagttcatatagcaaagcaaacttatatgatcggagttaggcagtaaatgcattttgaattatggtatttattacatgctggacttgcaacaattacagttctgctctataacagcacatataggactacagtgtgcaaatgtcattcgggaaatggggcattatacgtttgctactaatttatacatgatgttcatatttcctttcttttgtaggcacttttctattcagctctcttgtgtgcacgtgagatgcttaccccagaagatggatcagctgacttgattcgtgccctaaatagcaggcttattgcactctcttttcatatcagagagtattattggcttgacaagagaaagctaaatgagatatatcgatacaaaacagaggagtattcttatgacgctgtcaacaagtttaacatatatccagatcagattcctccctggctggttgaatggatccctcctaaagggggttacttcattggatacatgcagccagctcatatggataatcggatgttttatcttgggaacttgtggtcaatagtaagtagtttggcaacatcccaccagtgtgatgctattttggatctggttgaagccaaatggtctgatttagtggcggatatgccaatgaagatatgctatcctgctcttgaggatcaggagtggaaattcattacagggagcgaccctaaaaatacgtgagccctatgattatcatgtaacccgtgtaatttagactgtttggatttcatcttatttgttttttttctctttcaatgcagggcttggtcttaccataatggaggttcctggccaacactattgtggcaggtacttgtgtttcattgctgataagtgttcatttgtccagtttagtgccatgaaaaatgaaaccttgtccatgttttgtttgaatattggaaccagttttttcctcctgtttaaagtttccaatcaacccctcatttgcagctcacagtagcatgtatcaaggtggaccggtcagagattgcagcaaaagctgtggaggttgctgagcgacgtattgccaatgataaatggcctgaatactacgataccaaacgtgcacgattcatcgggaagcagtctcggctttttcagacatggaccattgccggttttctcgtggccaagcagctgttagaaaaccctgataaatcgagaatactgtggaacaacgaggatgaggaaattctcaacgctatgaatcgcatgactgatgcatccaatctgaagaggcggcgtggcaggaaaggactcaagaagacttatattgtgtaagtccagaaatagtttcggcctatcgtcatatgtgtagaatatgttataggaatgatgagttcttgttgtacataagtacatttttgaagatggaaacctaatctcacatttttgtcatttcatggccccagtttagtcactgtctcactgatctagctagctctgggtcgtgtggtaagtagtactaactgaagtactcaacctatttctggaggcttcttgatgatcacatcaacatggtgatttactgcagtaatgaattcatcataatattcacaacgcaacacagctataagcaacagaacagagtgccttacggtcatcaacgaaagcacacaatggtgtacattccgtcggcaacggaggcctatattgtgcggtcactactagtcagtactcagtactcagtagcaataaacagaaaatgcacacacatagctgttgaatccgtgctgcccaactttatggtattggcaaggaataaagttacgcaagttattacccgccttcactcgggctggtagtacttcccagacttaacaagtgacagccaattccagatgccactgaggcaatatgcaaatgcaatacaacatgttctacttctatcattgcactcgtacaagatgactgccgaagccgtgctaatctggtattttgatggtattaacaaggaataaagtagtagcaggtttaacagccgaacatacttcacttccccaacattggcaggtgacccaagattttactcatttccaacagaaagctgcagggaagtgaaactacctctagctacatgctatggatgttcttccgaatacaaagtaatattattaccaccactagaagagctcaaactcaatgtcgtctccattcagcctgaactccaggcacttgccttccttcttcttccgtgccgtcgtgaggcttgccgcgtcgaagcttttcggagtctcaggcggtgcagtccatcggatcaatgcccagttcaggccttcgaagaagggatgccgcttgatctcagcagctcctttcgttgagcctagccggtactccggatccttcacaagcaaccctctgatcaaatcccgggcatggaagctgacagcagggttatcagggaacttcagcccctgcgagaccacatttgtcagtgtctcctcattgccgggtcccctgaacggtgtcctgccatagagtaattcatagagaaagatgccaagagtccaccagtcgaccgagctaccatggccatctcctctgataatctctggtgcaagatattcatgggtaccgacgaacgaatttgaccttgcatcagttggctcaacaacaagctgtggcagtgatggtttcttctgaggctcacccctcggccgccgtggcctggaaggggtagaggaaactagccgaggcgtgaagcaagaagaattggcccatgacggttggatacagagtggatcaatgcagctttccgcacaagggccagaaggtctactaggttcatctcttcctactgatgaggcccttacaagcattggatttactgagcacctcagggacagatcgaaatcagagagcataatgtgcccatcttcacgaacaagtatgttttctggtttcagatcgcgatatatgacccccaacatatgtagatattccaatgctaggagaacttcagcaacataaaacctgcaaaataaaaaggtaattctccctgtgagttacatcgctcaaagaacatacaccaattgatcagttaaaaacatcaatcagatggcagcaagcaagactgtatcagtgtctgttaaatgagactatagctcggttagtgtgaagcagccacatggcaatctcatgtatgttaggacatcaaatgaaaacacgattaatagaacttaagttccatacctagcagcagcttctgaaaaggtcctggtaggctgtttctgtcgtagaacatgcaggtcaccgccagggcaatactccatgactaggcaagacagattatcggtcgtgaaaaaagaatacagagttggaagaaatgggtggtcgagcatttgcaggatctccctctcagtttgtgctcgaagcatcttctttctacttatcaggtactcgatatccataactttcaatgcgaacatgcattcagaacccaccaattcagctagataaacagtcccaatatctccacaaccaagttgtttgagaagcttgaagttcttcagtcccaggctcccttgttggattgccatgcgcctaatggccccccatctcacatcttttgacatgtgaggcctgcagccattgccactgaaactaccataactatcatcgcttatgcttgtgctggtgctataatcacccatgctgctctttgagctttgggagcattcacccttttccttcgatcttgacaactcactgggctttgaaccatggatctcaccaacaccacatcctttggtgccacaattagctccatcagtgctgatagagctagccgcagccttcttgttgattggtgttggagttctgggttcatcctgtagggcctcgtgcttcttattagcttgagaattggaactttttgcctcacaagtcttgtgagataccactgcagcagctggttctggtttgaccttcttcttggtggaggttttactccggaacaccaggcgtgaaccgcccacaggaactgcacgggggctagatgttttcattttgccctttctctgtttagccaccgcaggacctgcaggcaaatcttcacttgcctcagatgacttattactgatcacatcttggattctggttttctggacctttgttgtggttggagatgctgaacgcacatttttcttagctgggcttttgttccgtaccttgttcttggcttccgttgacttcaccgatgaacttattacatccttctcaggcaaaacggacacttttccaaacttattcttttcatcccgctccttgttggtttgaaccacaacagatgtataaagcttcttaattgccccagcttctggggtatttgacaccgccgtcggcttcggcatcctcttcatggcggccatctccgacgcctgcgagatgcacatcttcctcagggcctgtttcaggctcacagactcaacaatctccgagctcgatatcggcgacttcccgagcgcgataagcctcctatccgtgctcgtctgcccagaagcccgtgcggatgtgcgcacattaatcgatctaatgagcctatcgagatcatcctcgacggagcacgaccgcgctccatgctcctgacccaccggcttcactctcaccctcaggtgggtgacaccaccaggacgggcatccttcgactcatccaccaattcgactatctctgagcaacctgaagaacccatctttctcaaaagccctctgctgcctccggagctgcgcctagtagagcattaactcatgcggcctcacaactaacaaccgcatctggggaggccatccaaccgctgacgcagctcaggttaggaccagtggttgcctgcagttcggtgaccaaagaggcagctttcctggatcaagaagcggcatcacggggccctgcaagaaaatcaagcacaaactggatcagatagagcaaaaaacccatctttgctcagggaaaaaaaacttagcaatatacaacaaggagtaagattaacactaacgagaatggagaaaaagcagcaaccaaatcaagtgaatctgcagcttgaaccagagccaatctcggtgccctcctcctcaaaatctccccccacagctctccttttccccacccaagagtagaaatttgaaaaacacaaaagaaagaaagcaaaaggaacacagatgcggtaggtgaggtggggttttgctctatccccagcaaaatgatgcgagatccgttaacccctggaggcaaaagcaagaagaggacacaagcagctcagccaaaaccaccccaaaacttagggccagccaaaaacaccagcatacaaaaaagaaggggaaaatgaagaaaaagaacaaagatttgtgcctattagatgcggggttttgccctggagaaacttaccggcaggagaaccgcggtggcggcggcgacgggactagggtttagctggagcgccgccgacgagtaggacaaggaggcggagctggagagagagaagggaagaaatgttgggttttcctttggagaagagttgaaacggagagagctcagcttcagcagcagcaatgcgcgcacatcacgaggagcaaagaggaagacgaaatgagagcggctgcctctgcctctcccctcactcactcacgcctacacctatgccctacaaacttctgtcacacacacacacacaaacctatccttgctctaccattctctctctaccacggtgaccaccgcaaaccgataaaggccccaccgggggcaccaccacccctcccaaggattttacgcttctttatttattgggtcacatttattaatatctgtagccacgtatcgcgtgctgctactgctgtgcccctcctctcccctttcacgtctctctcctcgcccttttcatgtctctttctctctctccagactaccgagcttttctctctctcttttttttttctttttatcttgttttgtcacccacaaccctgatgaagaaaagggcaaaaagaaacgaacggaacggaacggcacggcccgtagataaaacaattcatctacgaggagatagtaggagtagagtggtagaggctgctgtgtctggctatgctccgcctgcggacaccggacagaaagggcatcaaagaattcacggttccccgtactacgatttcgatttcgatttcgatttcgccctaacctcagcgcgcgcgtggcccgcagcgtcagcggcgcattatcctgccgcggcaacatggctggagtaatcaccggggcgctgcgcgtaacgtgatgagtggttttggccaagctcatcactgcggccgcgcaggcggacgggaggcgcagcggtgaccggtggtggtaccgtggtaggcggatgggtgaacgtgagacggtcagctactgaggtgggctcgtgatatcgtcgagccgtgcggtgcgtgacgcgcgcggccggccgcagctggcgaggcggcccacgggccaccgcaccaccccaccaccacgtacaggtaccaccaccaccaccacagccgcacggtcacaggcgcctcgtgcgcgcgcattgctgtgcgcctccctcccccacaccgcctcctcccgcctcagctgcattcactcgtccggtcgttgctcgtgcaccatgcgtccacgcccatcgccggcctattcgcttctctcctcagctaagaactttcacggtacgtttatgtgccattcagcctcaagcggtcaggatgggaatggttaggatatggattgaacctaaaccgttttaagtgagttcgtttatccatggtttaatagggttgatccaccatgagtctattatatcaataggttatacatagatatccaaatggatcggttactcttattacatatgggtaaaactcggacccaaaatttttaaactcgcgttcacactataaaaacttatcgaattcagttgaattttggtgggataatttattgtacagagaagcaactttgtataaattttgagccctttatacaagtggggcccacgatgcattactaggacccaaaaattctagttatatgtgtaaaactcggacccaaaatttttaaactcgcgttcacactataaaaacttgtcgaattcagttgaattttggtggaataatttattgcacagagaagcaactttgtgtaaattttgagcccttcatacatgtggggcccataatgtgttgctaagacccaaaaattctagttacatgtaaaactcggatccaaaatttttaaacttgcgttcacactttaaaaacttgttaaatttagttgaattttgtaggaatgaattattatatagcgaagcaactttgtacaaatttttgaaacatttatacatgtgaagtcattttagatcgaaccccttgaaccttaggttctaatggtttgatccgtttgatccatttatatttttggagcaaccctacaaatccgttaggacaaattgatccgtttgatccatttatatttttggagcgaccctacaaatccgttatgacaaatttacggataggtttagtgcataaatggatcgaccctaaccattcccatccttactcaagcttataagtaggagattctcagccacgtcaatattttctgtgaccaaactaagaacgcgtgaccaaactaagacacatgttattcataaaaaattggcagcatcgttaaggcagcccacactcgtcgctagggaaaggagagagggaggaaagaaagctcggcttgtctcgacgactagggagggagaccgtcaacggggagggaaggagggagccaagaaaatcgtcgcccctgcttccacactgcaccgtcaccgggctcgttgctgaggaggggagctcaaggccaacgccggccatagtcatggacgaggtagatgagtcagcgctagacccgccccgtcgccccctttttgtacgccaccaagctcttgcagtgccgtaccctgccagtcggaggaggagaggtggtgccgtcgccaaaccggccgcggccgcctcacttcctccaccatggaaaatgcaaagaggaggagcaccgccgacctcgccatccctcgctcccgtgccgccaaccttgccactgcttttggggacaaggcgagggatggatctggtcgctcgtcaactgctcccgcgccaccgaccttgccactccacctaacgtcatcgccctcgacgcgtgggccgcttcgccggcgttgtcgccttgacctcgcctcgctttatccgccattggggagaggaagataggaaaaaggggagatgaaaagtgaaaaaaggtgatattagtgggacccactataagtgacttgctgtgaaacatgtagctaacattattctttgctcacatggcacgttaggttcggcaaaatgtggtggccaactgctaatgctctaatcctcgacaagggtccatgagttggtgcaactgcgtggcaacgtcagtacgcctccgccctagcaaggtgtcagggtgggctctgtctcattggtcctgatacaatacacacgaaactttttccgtcccaaaatgtgcatttttttaaggtagaggggtttatatttatgagtatatgacagagataaaaattaatgtaactatcagttttactactacattcatcccaaataaatttatttttcacccatcacacaccaatataaaacaaaaaaatagaatacctttcaattaaactggcccgcgcagattgtgcagctagcattattatattttctctcgtataatagtatatatgttttctcattatattattaaaatatattacaatgacaacataattttaaattttgcaataactttacgaaactattaatgtgtaatattcatattgtattttatatacatgttagttattaattatttttaatatcaaattttagttatttgtaaattatatatattcctatatggactctagactcgtcttttaatattttcttttttttaattctgaatttttattatttctaattgtatttctatgtggactctaaactcatctttcaatattctttaatttttaatttcaaatttcagttacttctaaattgtattcctatattaactataaactcttcttcccatgtttttattaatttcaaattttagttatttgtaaattgtatttttatacgtattctaaactctacttttaattttattatgtttattctgaattttagttagttttaaattcctatatggactctatactctacttctaatattccttatttttttaattccgaatttctattttttcttaattgtatttctgtatgaactctatactctacttctactattccttatttttaattccgaatttatattatttcctaattgtatttctttatagactctatattctacttttaatattccttatttttaattccgaaattcagttatttcctaattgtatttctatatggactctagtctcctcttctaatattccttatttttaattccgaatttcaactatttctaaattgtatttctatatggactctagtctcctcttgtaatattccttattttttaattccgaatttcagctatttataaattgtatttctatatggactctgcttttttctttttctccgattaatgtgagaatttctaggccatgagagcgaacgtggaggctcatttttctattcctttaataatataatagatgtctctcgacttttctagttccaatgaatttatcatctactttcatacttaactctaatgtaataattatttaaaaataaatgtattttaagataaatccgagacagtaaaaacgaactcattttaaaacgaataaaaacttgctctaaaccctttatataggaggcagctctccagtcacgcatagtacagccgacgcccgagtcccgaccaaccagtcaaccactgcctgtctgcttcgtcctgcatcttccttctttccctccagaaaatttgaaaacgaaggttgcctcattgcctgggcaccatcagacccaaatccttccgagctggatgcggctgctcactcagtctcagcagtcagcactcactcgcctcgcatgataaac

SEQ ID NO: 42948 - DNA, 701 bp, Oryza sativa
cacattacattttggagtccgtgctgtagctggctatagatctgtagcccgctgctcttctctctcttcctttatctctttaaaatatgttataactggcttatagcctgctattgtacctgctctaacggtattattatgttttcccagatggactatgaatgatggtccagcctaagttagtcgtggcaatacctttttcagagcacacaggagattggcacatcttttgaataatcaagaacagagattggagcaggcacacggtgaaccagagctggtgaccggtacaacgacagtacaatctggtatgtacagtttttaaatacctgaaaaattttaatgcagggatacgggaacgatcttgttgctcttgtggcctttaaaacacttcctgtctaaagcctgagaaaatttcattgcacgtatggatgatgtacgtatgaaatcatattttcatcgatgtaatgattccctgtgacccggtagcagtagcgacctcaactgtcatggccatccatttcaatggatgcatggagtcgtctttgctttgcagttgcaagctgctgcccatggagacaggcaattaagattccaggggagtacgagcgtacaaccatgatcaccaattaaaagcaaagccatcatttggattcccagttcttgtgctcatgccaacctcacccttttcttttcccttc

SEQ ID NO: 42949 - DNA, 46966 bp, Oryza sativa
  unsure (1)..(46966): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattatagtttattttgaaccatgattagatttattttgaacaaatcaattttggccctgtactcctgttgatttctatacgcccattgatttttgtgttttctcattcttgacataaagatatatttcaatgtgtgagctaataataagttcctaacacagcaggagtcaaacaagcactgatatcattgtcggataaaacagacttggcctatcttgggaatggccttcaagccttggggtaaacctttcatcttgtgggatgctccccttttcggttttatatttaacagttgtggttttgctgtcaagttcactttagaatatttgaattttgtgctttaaagcttctctcatcatcaccatggaactatttgttgtatatcaaattcctatatcaagcagtagaccagtagtaaattatcatatttgcccttttgtaaagttaggctttattcgccataataagcttcttgcagtttatcttccccagctgcataattttaaggctgacaatttggatcaggataacgaaacatgattttataaaggatgaaccatgattagatttctactgttgattctttttcaatctagtatatgatcatcttatggacattttgctactgtaggttttctattatttcgactggtggcacagcatcaagcctggaagcagctggagttaatgttacaaaagttgaacaaattacaaattttcctgaaatggtataacctaatttttattttactcctacatttcttgaaatatatgttgcttcctagcatcgtttatcattgttggttactcagttttgtcccttaattagatatgtttgcactgactgcaaataaatttcattttatccaatggttcacatttggtaaattcagcttgatggtagagttaaaacattgcaccccagtgtacatggtggtattcttgcaagaagagaccaggagcatcatcttaaggcattgaatgagcatggcattggtgagattgttagttcatttgtgttactgacttatcttctctcgaacattgtaaagagttaatgtgatgaagtattgtcagttaactaggaccttttcctttgggcacagggacatttgatgtggttgtggtgaacttgtatccattctataacaaggtcacctctggtgtaatttctttcgaggatggcattgaaaacattgatatcggtggacctacgatgatccgagcagcagctaaggtgatttattggttcttgagactttttagttagcttggggattgatatcttcatacaaatttgatatcatgttgacatatgtaaatggatttcccatctatttatacagatggtatttgttgttcattgataggaacagttctattgttgctcaattgtgatgtgttcctgtgcctgacagaatcataaggatgttcttgttatggtggatcatgaagattaccctgctctattagagtatctgcaaggaaaacaagatgaccagcaattccgcaagatgctagcatggaaagctttccaacatgtcgcttcttatgattcagctgtctcagaatggttgtggaagcaatcgaacaaaggtattaacactaactttttgtaatgatctagtttatatatgatggttttgtcaacatttcctcagatatcattacactatcatgttctcatgtaggagatgtattccccccgaacttcaccgtgcccctgtccctgaaatctacacttcgttatggtgaaaatcctcatcaaaaagctgccttctatggggacaagagtctttctgtagttaatgctggtggtattgcaacagcaattcagcaccatgggaaggtgagaaaatcatgcctcctttcattcaactaaaatgaaacacggatagtaacttacaaaaaaatatctctttcaacttgatttttactacttgcatgtttatctgactttagtatttgtttttttcagtacatataacctgtttctggccatttccactctttgcgaactcatgttgtaccagtaatgtgacgtttcttgtgtttacatatgacattttctgttacaggaaatgtcttacaacaactacttagatgcggatgctgcatggaactgtgtatcagagtttgagagtcctacgtgtgttgtggttaagcacacaaatccatgtggagtagcatcccgacaggatattcttgaagcatacaggttggctgtaaagggagatcctgttagtgcatttggtgggatagttgctttcaatacgacaattgatgaggtatccagtagacttcttgcctctaaacacttgtgttgttgggcatgaccattattcacactatatcatgtttcaggatcttgcaaaagaaatccgtgaattcaggagccctacagatggacagacgcgaatgttctacgagattgttgttgcacccggctatacagaaaagggtcttgagatcctcaaagggaaatcaaagacattgaggatactggaggcgaagagaagtggaaaagggatgctatcactcaggcaagtcagtggtggctggttggctcaagagtctgatgatctaacccctgaagatatcaccttcacaacagtgtccgagagagctcctcaagacagtgagctctctgatgccaaatttgcctggctttgtgtaaagcacgtaaagagtaacgccattgtgatagccaaggtcagtatatttgcctctgctacatgaacaaaataatttgttgatttggtggactaacatgatgctgtggattatcctcagaataactgcatgttaggcatgggaagtggccagccaaacagactggagagtctgagaattgctttcaggaaagcaggagaggaggccaaaggagctgctttggccagtgatgcattcttcccattcggtaagaacaaatgttgcattactggaaaatctggactctgataatttcctgaatttgtttgcacacaacattaacatagtggcaatcaaaacaaaatgataatgcaaacttcattaatagttggatttatgtttgagttatgacccaggcaaccagcatctgtaggttctgagccaattcatttgctgatcagtagtagttcaatttatgtttgatttatgaccaagctaccagcatatgtaggttctgaaacattcatttgctgatcagtagtagttgaatttatgtttgatttatgaccaagccaccagcatccgtaggttctgaatcatgaaatacttctcttttctttttaagaattacattttaccattgcaaccaccattaccatgttcaacgattacttccttgcacgttctgtcacacacactacaagaacagctttgcaatgttgtcacattttgtaagaatcacatttttcgtgttcgttgatgccttccttacaatgcaacgacagcttggaacgacgccgtggaggaggcgtgccagaacggcatcggcgtgatcgcggagccgagcggcagcatgagggacggcgacgccgtcgactgctgcaacaagtacggcgtctccctcctcttcaccggcgtcaggcacttcaggcactgagctagctagcctcatgaaccttgatcttcctgcaaaaaaaggaaaaaaaacatgggcatgtcagatcgatcgctctttctgtatcacaagagcatgcagatcgaccagcgtttgatcaccttgagaaaaactcttgacggcttgtactaggctgcctgccactggtgtgacagaatttgatcagcttgacattttgcaataagattcatggtgataataagattaggatgtctcgtactcattctaaaattctctatgcgagtttgcaagccgcacagcagcacaggtacccatcttttttatttgtcagcccagtgtgctaggctgctagctacacatacagaagcatcttgtacatgtaggtggcttgagcatgcatcggcggtgccatcgccggccggctcgccggagggacctcgcctccggcagcgccggcggtggctagcaggcaggtgccgttggtgcatccactgtccttggagcaccgatgttaaaactatataaaattttagaaattaatggttagagatatataagtttttagaaattataatggtgagatatataggtgtttgggttaggctgtgttctttcccatgggttcccaacccatcttcctcgtttttcgcgtgtacacttttcaaactactaaacggtacatgttttataaaaagtttatattggaaagttgctttaaaaaatcatattaatccatttttcaaaaaaattttgtagctactacttaattgcgaacccctccaaaagagcaccgcctagaatagagtaaaacacaaagtaatttgaatatggcaattgcctgtctaaattcgtagtatatatgtcatgtatgtattatattatacttgtagtaggacggagggagtataagataacgagtgcatcatttttccctgctctaaagctccaaatctaagctacaacttcctcgttttttttacacgtttcctaaactactgaacaatgtgttttttacaaaagttgtctatataaaagttctttaaaaaagttaaacaagtccatttttaagttcgtaataatcaatacttgatcaatcatacgctaataatggtctatcttgtttcgcgtgacagcaaaactgacctctaagagaagtttaatagtacaaccaattattagctctaaatcatctataattaatttaatagccaatacatacaatacttatctataaacatatacttcctccgttccataatttagtaacctagaacatgattggatgttttatagtacaacgaatctagacatgcctcctgtctagatttattgcactatgaaatatcccatccaatcttaggttgtgttcttatctcaggttttccaactcatctctcttgttttccacgcgcacgctttttaaaatgctaaacggtgttttttttttgcaaaaagtttctatactaaaattgcttaacaaaatcacatttatccatttttgaaaaaaaagccaatacttaattaatcacgcgctaatggaccgttccgtttttcgtgcgcactgttctagttgggaacagcctctagcgaacacggttgttatattatgggacggaggggtactacactattgatatttggtcccacccatacacacattgcttcatgcaacccgtgctgcagctagttacaaatctgtaacacaccgctcttcttctttcctcttttatctcctcgatatgcgtttatagctggtttatagtatgctattgtacctcatctatggcttagtcttcccgaacggaaaacgggttacctattaacttgtgattaattaagtattagcctaaaagagctttaaaaatagtttaatatgattttgtaaagtaaattttctatagaaaacttttacataaaacatattagttagcagtttgaaaaaacatacgcgcggaaaaaagaggggtgagtttaaaaaagggagaataacacagcctaaaaagcaacaatcgaacgcagtagtaaacgtagaggaaagaaagtttcgaactttgcttgggcgaaggaagcctaagtattgctacgacgactaaacatggcgtgtcagccagtaagcaccagggtttacattattgtcggcaagcatgcggttaccggccttaccgcgtgggtacggtaatagaaaaaccgcgataacctccttaaattcaaataaatttaaaaaatgatttgaatttttgataaattttgcacggtttcatacagtttttcatggttaacacggtaaccatgcttaccgctagggccgagcgcgataacctcggccccggtggtttgtgaaacttctggtaagcacactgtcagtaagtgggttcatcagagtaacagtgagcctgcatacacttcaacgttgcatacgtggcgccccaccacaccacctcactggttcacttcactcacccaagtcaccacctcacctcaccaccacccacctcgtcttcttcttcgctaagcctaaaaagaaaaaaaaaaaaggtctccctcctttttcttctcttcaaccccctctccacgcacgcgctcccccccgcgcgctcgctaaccctagccatggccgcaccaccatccgaccactagccgcggcggccagcgacggcgaggcccccccaccccgtcctcctcctcctcctcatccgcttctctccggtccgtcccttcgttgactgccgctcggtttgcttccgagggttttcctctcccgctgctgctgcgagggagggtcgatccgttcctccgctgggcgtgcctgtgcgggtgctcctcctcctgcttcttccgcggactcctcctcctcgaaggtatatcctctcgaccgcctcggagtagtcgtcgcgggtaaagttgggggaatccacccggacgttgttgatttctgtgattttcttatggtgattatccctagctcgtttgaatttattttgggggaaattgtgttgtggcacgctgagaggctttctactccactgaatcggtgaatcatttaacctgattgcggatttgtcaagcttatgccgtagtgtgatagtgttaaccctccatggcatctcaagaaaagaaaagagagaaattggggatccgattgccttcccctctttgccccacaccacccaatatccccacgttatgtccgccactagctatatttttgttatttttaatagtttgtgccacacggtttttgagttgaggctcgttcttaagctatgaacagttttttcctatgaaccaatggaaaataggtagggatttatgcgcccatcaggaaaaaaaaagaattgcggactactagttttaagtgactagtggcactggatttctaaccttatgggagatcgaggagaataacttgtttctttaatagtatggcttcccttttttgatagataaggctaagtggggctgcagaaggttgcaatttcttggaagcctgttttccttatttgggcacagaaagatggaaagaatgtccttatgaaggctaagacatgcgaccacctcaattacttatctgtcgtactaaattatgatttgtgcaccatatagcttgtctaattttctctctacttgagtggtaatccagaaacattatcatcatcgttaatctctgcaaatcttaatgaacaaagtattttcgtaacagtacctctttagcttttttttttcaaatattagttctgagcaatgtgtttaaattggaaagacagtctagtcgcctcaatactgactaggatgactaatagtgactaataacaactaatcgagtgactttccaactaatcgtggttagaatcaagccaccttagtaccggccaggacactaatcgcgattagtcggacaaattgaaaacattgggcctgacaaataatcgggcatcatcgtcatcatcagactattttgattttatggaatgaatttattgttctcttctgtggcttcaggaaattttatttatttatattttgttgtgattgaacaggtccttgtgaactgaagtaacctccacaggagttcacatgttctagaacaccaagtgtcaggggaaaaacattatggattacagcaacagttcatgttctagaacatgcagtgggcttgttaggttaaacaacactatagagtccaatgaggttctgttttctaaaacaagaagtgggcttgttaggataaacagcactgtagagtccaatgaggtttcgctttctaaaacaagaagtgggcttattaggggaaacaccaatgtgagatccaatgaaggttcatattcacaacacgaagtgagcttgctggggcaaatggcgttgtggattccaacgtgggagatttatgttctaaaacacgaagtgggcttgttagaagaaatgccactttggattccaatgagggatcatgttctaaacacgaagtgggcttgctaggggagatggcattgtgggtttaaatcaaggttcatcctctaaaacaagaagtgggcttgttaggggaggtgacattatgaatttcagtgaaggttcatcctctaaaacacgaagtgggcttgttaggggaaacactactgtggctgccagtaatggttcatattctgcaactccaagcaggtttgttagaggaaacatcattgtgggttccaaagaggggtcatgttcaagaacaagaagtgggcttgtcagagaaagcatccagatggattacagtgacagttcatgctctagaactcgaagtgggcttgtcagaagaaagccctttatggtatgcagatttctaacttcatctaccccttttcatttgttccaagtgcaacatgacatatatgtcaatgatgaccactctatattcgttgctaggttcaagtcaaggatgaagctgccatgaatgggctgtctgatgactgtttgaaagaggacagtccaggaaagaatgaaccaaatcacaagagtaatctggtatgctgtaacgatccttgtttttgtcttgccttttctatctaaaacacttcactttgtcattataattattttattcttaggttgaaaatagtgataaaccagtcatgaaggggcctgatggatggtggaaagaaggcatgctaacaaagaatgggtcaaagtacatgagtgacccggtatgctgtcatgattcatgacccttttttctcttgctgagttctatctaaaccgagtaaacaacatgctatcatgaccctttttctcttgcgcctttctgtctaaaccaatatacttgttatttcattataggttcaaaccaagggtgaagcatgcatcaatgggcttcccggtggacaatggaaagaaaacagtgcggaaaagaatgtatcaaatcacaagaatgagctggtatgctgtaatgatccattttctcttactccttatctgaaaaagatatatctaactagctctaattatttcattgctaggttcaaagaaaggatgatctaattgttgatgggcttcctgatggatggtggaaagaggacagaccaaggaagaatggatcaaatctgaagactgatccggtatgctgcaatgtgttacttttttcttgctaatttctgcctaaaacaatacatctaaggctcggttcaaagtgcttatttgattctaactgtgaactactccctcggttaaaaaatataaggtgtttaggtttcgttaggacaaggctttgacatgtccagtttgcaaatacttgttgttttgcacatggacatggtctccaaataacaattttgacctctgttttctattacaatatatgtacaaaagtacaaatatcaacaatatatgattttattgaggtaattttcaagattaatcttatatatatggtgtccatatttttgaagtaaatattttagaagggcatagtcaatgtttagaagtttgacatctgtcttgtccgaaacggcaagtatgtgcaaactggagggagtataatttatatgaaaaaaaatgatgttattagatttgtattcaaaagtacttatgaattatgattatgccttttatcacaaaaatgagatcctaacagagtaatttttggtcaaagccttgtcctaatgaaacctaatacacactatatttttgaacggtgggagtaattgttgtttgaaacactcatttctttggagccgtgacaactaaatcttactagaatcagtaaagaaccagattccatactgcagcacaatcaccgcatcggtccaaagtcattagcatgtctatggatacttgcacttaatatctcaagaactctaagctgagtttcaactctccatattcatctcaatattgtgcagcaacaataccctatgcctaatataattgcaaccagcaatattgttccacttgcatcttggttctattttgaggtagagtagccacccaagaaatatattctacaggtgctgcatgtatgctgtcgtatgcgaccatctcaataagaaaagcagttaaaagcaatatagggcctgtgtgtttcttgcaaaagttcccttttgtcgtatccataggttaacttaccatctttacaataagctcatttgttctgaaccgccacatttccaaggaggccaaatttgttagtcatcctcttccgtggcacatgtgggtgctggtgttacttgtgatattatttgaagcatgtctttgtttgaaatgtcaattatgatttcatagcgtgaacatttttatatgagcatatcctgtgctcctgtcagttgaacctacattttagcgtgcccagtgttacctttggtgctaggtgcgggtatgatggcaggccagcacctagcgccaacagccaccaaggcgagttactgactgcctaagcaggaaaaatcagtttgtcagcctaggcgggcactgttccccttgttgactttataatgcatgttgcattgctagctcttgtgatcctttaataatgaaagccttcagggcattccaggaatgttgtgtcttaaacttatttttgccttgttttaatctctgcagtactacattgatccagtcagtggatatgaatttcgctctctgaaggatgtgcaccgttttcttaaatcaggggacatctataaatgcattgtaaggccaagaaagagaactatccaagatccttgtactattgaaaaccaatctcatgtgagttccttgcagttcttcttggtttgagttactggggcattttgcttcttctatcaggacattaaataaacaaaaatactaggtatcttaattaccatgcacacctcaaattgaacatatttgctttggttaaaatttatagagtccagccctagtaattatatgtttcttgtagctcagacatcagccacatgtgaagtgtcaactgctccttgtcctggttgcccctctttgcgtgcgtaaagaatcagagttttcatgcactattacatcagataaagaactctgattccttctgaattcaattttactatagactctactccctccagtcttgaataattgtcgtttagatacatggaaatcatgtgtgcagatctgcctaaaaattactaacaaaatatttaaatagaaatttgtggccaaagttgtgttttgaagatggcaaaaatttccttttgtatgtccccttttcacaacaatttgtacttattagatcattttgtgaaaatcagacagcaacattgttgcaacatacaaggccaggtaccgccgacaaggccattcaatgtgaattgctaacttcagaaggtctcatgctgccgtgggaggaacagctcagtccatatagagaactcaacaacccaaaaaagatgcccgagttggagggcatgatagcatctcaaaaacatgcctacaaagttgatgctccaagggaaaagaaatcttttccgagaaaaagaaaacagccaagtgcaggagggaagcccaagaagcataaaatcgtccctgcaaaaatggttgccatgcctgtccgagcatcacctcgcttagcttcactgaagatcactcatgatttaaatactgagcctgaagatgaacttatcggtgtaaatcttgtcaatgaggtacagtctactaaagaaaatcctactgataagtcacgattgaaccaagcaggcatttccactgaaatgacgtctgttcaggaaagggctgacaatcagttgctgtcaagccaagcagacaccgggaatcacatacgtgttatggagggggacactacagattcgtcacagctgagacaagctgacactgtgaaccaaatactcacagatcaggaaaatgctgtcagtcaattacagtcgagccacacagattattttgttcaaatacgacctagacaagaatacgttaccaattactcacaatcacagttgagccgtgctgccactgtgaatcaaatagagactaatcaaaggaacatgtcaggtcagttgcagtctagccaagcagattctctggatcaaatacagacagagcaggaaagttctgccagtcggttacagtcaagccaagcagactctttcaatgaaatacatactatacaagaatacattactgaacagtcagagtcacaagtaagccatgcaaatcaaatacagattgatctaggaaacactgtcgatctgttgccgtcgagccaagcagacgccatatttcaaatggagactacacaagaatacattaccaaccagtctcagtcaagacaagcagatattgtggatcatatgcaggttaatcaggataacactgctaatcagttccatttgagacaagctgacacagtcaacagaatacaaactatgcaggagagcaccactgatcagccacagctcatccaagctttaactgtgaatcaaatacaggtcaatggggaaaacactgccaatcacgtccagtcaaggcaagcagatactgtgaatcatatacagcttaatcaggataacactgtcaatcagttccagttgagacgagctgacacagtcaacagaatacaaactatgcaggatagcaccgctgatcagccacatctcatccaagctttaactgtggatcaaatacatgccaatagggaaaacgttgtcaatcacttccagtcaaggcaagcagatactgtgaatcatatacaggttattcaggataacactgccaatcagttccagtttagacgagctgacacagtcaacaaaatacaactatgcaggatagcaccactgatcagccacggttcatccaagcattaactgtaatcaaatacaggccaatggggaaaatactgcaaattacttacagccaaattatgctgaaaataatatcatgcaagttggtttctctttaactcctgagccggaagaagcacctgccacaagcttttggagaaatgttgcaaatcaggagttaccggtttccatgcaaacagatggaaaacctgttgtgagctctgcgttaaatgttgaataccaaaatgtgccagccacagcacccgctcagccaacgcgagctccacatcctgaagnagnnactatccgtctgggctggctgtgccatctctatttgggaattcctggtcagatccatgcattgagtttgccttcaagacccttagaggtgacattcctgttctggatgatacttcagctgttgaacaatacttccctcaacatgacttgaataaacctccatcaccagattattctgcttcaccaagttgttttagttcctcttttgacaatactagaaactttacacaagtcgaccatgccagcctcccagcaccgaatccgtcagataaactatacaatggtggttggttccctcccaagtgacttccctagaaggaaaaaagtgcagcactacgatgtacctgctaagatgctaaagaggaaagcccaagtctggtacttattgttagaactatgttgtaattcatgatctaatctggtatatgctgtaaaactgttgtatgattgtatcttgctctaacttgtagacaaaatgtacatccgactagagttaccttgtagggttaacatagcttcaagaacagaatgtcgagtagagggatcaatgttgtttctgtctttttttggttgcgtgcagttgctgggatattcataccatatactgtcagagctagctcactgatgtgccatcacatggagtgtcttaattatttgagataaattcttccatgcggatgatgagccctttaattttgcttttaaggccaacatgtattgaattgtgtttcgatgggatagtaaaagtgccagtgcattcaagtgcaacaatgctgaatctttgatgcaattctgattcgcagcttgtattatgtattaatggtgcgattgcaatagtatagagttattttattacttcctcttatcaaaatataacaacttttggttatatacctgaagaagggtatgtctaaatatatttctttattattatctaatgtagatggaaaagataacgattgccccctcagttgtttttcctctttctctgagctgaaagttatagtgaaactaccttgttgaaaatcttgcgacgcttctacgaaaaaaattgttaaagacttataaatgacagctacgaataaaaatataagatattttatttctttaggacaatactttcattagcaattaatctatagaacatatttttttattttgtaaaattgatgttattagattcatattcaaaaacattttcttattattgtactttagtgtcacactatttatgtatacaaatagtagaaagcaattcaaatacgctttatatttttataggagtagagtaggattttaatccttgggataagtttaccatccactctggtgaaagttcattttaagttcctagaactttcgccaagtcaaacactgcatttgcaacatgaaacgaaaccaccaccagtaaacagtaaacactgacactaaccagtgaaaagaaagaagccactgacatatttttcagaggaacactgacactactgcctgcactgagcaagtttaatagtatagtccactgctagctctaaatcatctatagctaatgtaataaccaattcatacaatagttgcttactatactattaatatttggtcacatctgtcatacacacgttatatcttgaagtctgtgctgtagctggctacagatctgtagcccgctgctcttctctcttcctttatctctttaaaatatggttatagctagcttacaccctgctattgtacctgctctgagaaagcagtgacattttttcagatgaaacactgacactagtagaatcactactgactgcacaagtagaatcagggataataagggcctgtatagttggggaaaaaatttttttgggtgtcacatcggacgtttgaccagatgtcggaaggggttttcagatacgaatgagaaaattaacttcataactcgcctggaaaccacgagacgaatcttttgagcctaatcaatccgtcattagcacatgtgggttaccgtagcacttatggctaatcattgactaattaggctcaaaagattcgtctcgcgatttacagtcggtctgtgcaattagtttttcttttttgtccacatttgatgtttcatgcatatgtctaaacatttaatgtgatgtttttggggaaaattttcttgaacaaaacaggccctaaatacttcctccatttcatattaggccctgtttatatcctggcaaaattttacatcctgttacatcgaacatttggatacatgaatagagtattaaatatagacgaaaaaataactaattacacaaattgtgtgtaaattgcgagacaaatcttttaagcctaattgcgacatgatttgacaatgtggtgttacagtaaatatttgctaatgacggattaattaggcttaataaattcatctcgcggtttacagacggattctgtaatttgttttgttattagactacatttaatacttcaaatgtgtgtccatatatttgatgtgatatgccaaaactttacacctctggatttaaacacagtcttataagactttctaacattgcccacatttatatatatattaatgaatctagacatatatgtgtgcctagattcattaacatctatatgaatataggcgatgctagaacgtcttataacatgaaatggagagagtattaaataattgacgaagtaagcatagctcaactaaggccgtgtttagtttccccctattcccaactttccatcacatcatatcacatcaaaaattttcctacacatataaacttccaactttttttccaaactcccaactttcttcaaactttcaacttttttcaggaactaaacacaccctaattaagttcctcgtggttgatttgacacgggtggttgaactagtccaccacatgagctggttaaatttcttgtggttgaaccagtccacccggattcaaattttagatttgacacggatgcttgtattttcagctaattaagtttttttgttgttgaaccaatccaccgggttcaaatcctaaatttgacacgaatgctcgtattttttgactaattagtgtaatttcatcaatcttaagatatgccgacagtcttctaggggtaggttgcactagtagaatcagtccatccgggttcaaatcctaaatttgatactgatgctcatattttgagccaattattggtgacttcgtaaatatcaagatataccagcccagtcttccaaatatgctcagtgcaggtacaatagtagactataacccatctataaacacatatcgaggagagagaagaacaatggactacaatttataaccaactgcagcacggattcctagacacaatatgtgtataaaaggtgggaccatgtattaatagtgcaatatatgtttacaagggcaattgcaaatttaccactactttgaatcgttattgcaaaattaccactagaaaattacaaaaataccactagaactgttattcgacatccttcaatatttaaaaaaactggtggcaaatttacaaatgcccagtttataagtaaccattgtatgaattgactattaagttgactataagtgatttagagttactagttggctatactattaaacttgctctcaaagggctaattattagtgacttcgtcaatctcaagatatgccggcccagtcatttatggatggggtgcgcgttgtgagctcctgcgtttgtactgtgtttaataaaaaaataataataactgagaaataagggtctgttcgatttgatgccattttcaaccttaccaaattttggtaaagttgccaaaaagtgattacatttagtttgctgtcaaattttggtaactatataagaaatcctaccaaaattttggcaagttgccaaacaactatgtaaatttttggcaacttgctaaaattttaataatgacaaaacttagtaagttttttttggtatcaaagtgagcaggccctaatattgccatgtggggctcctctcctcatctcacgctgacacgcacgcacaaacgctaatgacgacccaatcagcagcagcagcctctctcctactaataatctccccaagattggatcatactctcatctcatcatagtctccgcccatccgccatcgctcgcagatctctctcgctctcgctctagctctcgctcgaggaggagatggcggagatcgtggtggcgccgcgggcgccggcgccggcggggaggtggggcgccgcgccgccgcaggagctggtcgagaggctcaaggactacggccaggagggcgccttcgcgctctgggacgagctcgcccccgaggagcgcgacttcctcgtccgggacatcgaggtcgagatcccttgctcctgctgctgctgctgctgcttctcctcgcgttttgatgttttcttttttagagttttagattcggttgctcagttgagacttctgcgtaaagattccgttttgagtggacactagtctgtttgttgatcgaatgtttggtaaagatttcttttttgtttttttttgcgttgcgattgtggcgcaattcagatgcgcagctgatctcatggagatggagaaattcctagttgaaatagttactggttagctttagcttgatccttgtatgtattcgtagttcatcatctgttgctgcctttgttttttttttttagaaaatggattaaaatccggcctctacatccacaatggatgtacacagcccactgttgctgcctttgtacattgagcttaattgtgatctcatgcacaaggtgaattgacagcaatgcatttttgtgtatcgtgagatattgaccttggcttactcaacttcgtgaactgcatttcagagcctagatcttgctaggattgaccggatcgtccgatgctcgctcagatcacaaggtgtgagatcatccatccataggcattttcccatgtaacgtgtgcaattttctgaattctgatcatgtgatggtgctcgggagcacaggtgttcctttgccagccgtcgagcctgtgccggagtcgagtgtctcgaccgtcgaagatagaactcctgaggacaagcagaggtggtggaagaggggcttgaaagccatttcagaggggaaattggctgttgtccttttggctggtggtcaggtactctcaaaactcctgaaaagtatgattggaaaagatctatgaatcgcatagcaggaaatgaaatctcacatatcctctttctctccaatttcggacagggaacaaggcttggcagttctgatcctaagggatgcttcagtaagttgtcatactttatcttgttgcatgctacttccactgtgccattaatgttatttatttttaactacagataaatgctctttttggtaccctactattttttagaattattttctcattgtatatttcaacaggaagtttcagtgttaacttttccatgttctccttattgtcctatggtcaatataaaaataaacttttttactcatgagaaaaacctttgctggtattctatactgcaattgtttttcattctgttgtgttgatgattatagagtatttttggagtaatatcctacgttttagtctgctttcagtcttcagtgatcttaagattcatggtgttcttttcctctgatttctgctcaggcatcgggcttccatctggaaagtcacttttccaacttcaagctgaacgaattttgtgcatacagaagctggctgctcagtccactgatggtaatttagtcaagcatgccattaatggtttctttactctttcttaaaaaatcacatgttcaacatgttaactttgtgcaaccccaggtactccacaaatacactggtatataatgactagcccctttactgatgaagcgactcgaaaattttttgaaagccacagatattttggcttagagcctgaccaagtaaggatcactactttattctttattatgaacggaaattccagtgaagttcaacatgtgacctcctattgccctatgaaacttctaagaattatgtttgacttgattctttattcgtaggtaacatttttccagcaaggtactatcccatgtgtctcagctgatggaaggtttattatggaaacaccatacaaggtttttaccttgctttatttatatttttttatttcatctcccattcttccatcattccgttgcaagtgaaccagcattggactatctaatcaaaatacaagtattgtgataataaacttgcttgaatggtgcttgccttctggggttaatgacatcttttgcaacattctgttgaaaactaggtagcaagggctcctgatggcaatggtggagtgtatgctggtaattccttgtatcagaatacaacaattatatattatcgatgttagccacaattatgttgtttatttcctctttttactgtgccacagctctaaaatctcaaaggttgctggacgatatggctggaagaggtgtgaaatatgtagattgctatggagttgacaatgtattggtgagtacactttttttttaaaaaaatatatattgtaatggggcctctctctccccatctgtttaattgatctccttttttaccagaataatcaatctctttgatacaggtccgtgttgctgatccaacattcctaggatatttcattgacaagggcgtgtctgctgctgcaaaggtcgtaaggaaggtatgccagtgcattatccaatccctagcagaatgagaagtattcttcaacttcaattatgcacctcatttttgtttttcattattatgctttgctgttaaaggcatatccacaggagaaagttggagtgtttgttcagcgtggcaggggtgggcctctttctgtagttgagtacagtgaaatggatgcagctatgactactgaaataaatcaaggcacagggcgccttcgttattgttggagcaatgtatgtctcttcttattccctttcccctccactgtccatcctttataagtgttgataatcattttactatctttctgtcaggtatgcctgcatatgtttactttggattttcttaatcaagtaacaaatagtcttgaaaaggacagcatgtaagtattgttactgaagaactattttgttcttgagcattatgattcatgatgtttcatttcgttccaacatttatttccgtatcaaagttgtggtttaagcataggtaattgccatagtatttagagctatgttcttattgtaggctcgaataatagaaaacttcttgtaaatgacttcgcccaattattttattacttatttagtactatatagctaacttactaaactttaaagaaaaggacaattgtgtggctgtatttcaatgcatttttattttagaagttttattttgcatataactgttttgcctagtggtaaatataaaatattcttatataactcttcagatcgatcaacacagttataatctgtaccaccacaatcgacctgataattgtctcttttactaatttatgtggtaatttctagcccttgagagtgaattaagaggcttcttttaaccttgttttaataatagaacagacattattatatcaattaatataataaatcactgtgactagtttttcgttatacaacctcttttttttttaatttttcttcttcctgcaatgtgattgttggatattatacagcaataccacttcagtgtcaacttactctttccatattttgtgcttaattttaaaatcctgtgcccagttaccatttagcagagaagaagattccttcaatccatgggtacacggcaggcttaaagcttgaacagtttatatttgacgtgttcacctattctccatcaacagctctttttgaggtttgacttcaaattcactattactagttctatttaattactgaaagcaaacatttattggaaagatctcattggtattgttggcacctaatgtttcagattttgagggaggaggaatttgcaccagtaaagaatgctaatggtgcaacttatgatactcctgatagtgccagattaatgctgctccgccttcacagccgatgggtggtagctgcaggtggctttttgactcattccgtgcccttgtatatgacaggtaacgttttgtatgtatatctagaaacttttgaagaccgtcactagctgaaatttttttagatggaaatttgtgaattgattatcgcataactttacttgtacttcaggtgttgaagtttctccacttagctcttatgcgggagagaacctggaagccatatgccgtggacggacattccatgcaccgagtgagatttcattttaggaatagtgtctgtcgaaagcaacagtctcagacccagctaaaaagcatctgtctcaagaagagaatggcaggatccctcaattttcattgggacatgagatgagatagttggacttgagctcttgcagttagaatgttgatattagtcagcttgttgtaatgccagtaattgtaattcaacaattggagttggctccctttccatgtaccatttttgtgctgctcaaatgtagatgatcaaacaatggctaaatcttctgtaaaaaataatacatctctgtaagactggtctatgcacaattgttaattcaacgtgctctaaagtgagaagaaaaagaaaacaaagaatggagtacacattttcctttttcaagtttgcaatacaattaatgcctatgtttggttgcttcaagcagatatcagtgaatcacagtatggctttagccatctgtctccgtcaataaaagaagtgttcaggtaaggcaaaacctgcacatcactaagcttctgagcatatggcactctatctgataagtttgcaccatcacccgtgcacctgtactctccatagaacacagtcctgacaattcaaacattacaaatattaatgctaatttacctttttgtcatgcaggtaacaattgacactgaatagagagaggatgcatactggtctcttgaaggatcattccaatcattccatccttcagaggcaatgatgtctgacattgaagtgtaggcgaagacgactgtggaatatggtctccatgctctccccagccatatcctgccggtgccgccaatgctgcaattgacaaaagagtagccagtgttgtcgtctacagattcccgggcatgcgcagtgactgaacctgtgatggttctcacccctgcaggaacaggatctgctatggaaatcaccctgcaattctgggaagtgcacaggtggaagcagtcagtgacaaagtgtatttttgttgtcttccaatctttggattatggttttactcacttcatagagtgacctggcatctccaaagataaagtcaatggaaccctggatgaagcattccttgaagtaatgccggccacgatcatcgtgaagcgtatcttgcgcaccaaagaagccgcaaccccagaatgctgcctggtcaccgccgatcctcagtgctaccgcctgagcaccgacatcaccgggtcttgggattggtgccacattctggtttcaaataattcagagttagcaaggattgctacctaaggtgcagtctgtgacttaagctgaaattgctgtgtactctgtgtttacaatgaagctgatgtttttcgcaacaaagcctgttgcgaaaacggacactgaaccgctgtagaacgttccatgcgatgagttggcagtgtcgttccaagaaattgccgtcagatcgaatccctggccctgaaatgtgatgttgggcttggttgctgggactgtcaccttctcactgcaacaattcagcttcggtaacagcacacttcgcaacagccaacagtgcactttggaaagagcactacaaatctgaagaaggtaagaaacactgatgcttactagtagattcccttgttgatccatacaacattcctcttcttgctgaagcttggaacagcattgaccgctgcctgcaccgttgtgaagttgcagcagccattgggatcgacacagaagattgaaattgccgcggtatctggcggtggaaattccggtgggaaatcatcgcataacggattatattcgtcgcgataccgatgatttccagtagaatttgtagtgccagatgttagcagatagaatggaagggaaggtgctgcaagatcaagaaggattccaaggaatgaagaaatggctggactatggagatgtgatgagagcagcacaagtgcagatatgcagcaagagagaggaacgataaatttggtgctcatttgtatgactgaattgattcactatttcttggagaatctgggatggatttggggttttaacatgctgaaatgcactttaagaagaagcttaaattgcatgccttgcaaacaaccgatctcctttcttcaagcttgagacgcagcctacaactacaacagctactaggaggctaagatgtttatttaatgcgtgcaaaaattatcaagtcaccgtcagaatcttagagatgatcttatcaggcagcaacaatttcacaatagcaaacatcacaagatcttttagttcatgtgaaatagacatcttttgaaatgtcagtgacatggtgaacaatttccagcttaaaaaaaacaacgataacgcacatcaccatcataagactgaaacaaacaggctgttgatgctattgcttcaaagaaggaacatggcccaacgacagggcaacagcaaccacaatttgcatgaccagagatctaaacaaaacttgcacggatacatttcagatgagtggcaaatgctccagggacctagacagaaggtcaaaacagcaagctagaagaattctaagtgaacacttgtatatttaactagtgattgattaggcattttcgataagctcaagctgcaatgaatgcttcttcccaccacctgtggaaccagctgggatgactttaataacgttgaacctcacagtttttgataaaggcctgcacaaccacacacagggcaaagaaaattcagaagtaaatataaactcaggggctggaaatgatttttgttcataaccagaataaatttcatgacagaacaaaaaaataataatcacatgaactaaacatttttgcaatttagggcctgtttggtacagctccaacttctaaatattgctccaggagttgagtctggagtggagttgtggagctacctaaacccagctccacaactctagtatattttgtgagagagctccacccaactccactcccagttttggtggagctgaaactatttggctgagctcaagctccaggaggggtggagctggagctggagctgtgccaaacaggaccttaacctggttaagacaatagaacagcctcatccaaaacaatatgatgcttggttctgagttatggcatcaacaatgtaatacaagaggaatgacagagcagatgaaaatataaattagtttcttaattttcaagaacattttaaagaaaacagataattcagtggaactttcaagtcatgtaatcccaatattcaggtatgcagaacaaaacagaaaacatgtactaagtacagcatcagctagagaacattacctgcactggccaatgatgacatggtcaccttccttaacacggaagcatggagaaatgtgagctggaatgttggagtgcctcttttcatatctacaagatgaacaagttcaccttctaaataagatgccatcacagataagaaatgtaagttcatagtcctccattgctttacttaccgctgatatttcttcacaaaatggaggtagtttctgcgtacgatgattgtcctattcatcttggcactgtggcatgttccagcaataattctacctctgatagaaacagttccagtgaatgggcatttcttatcgatgtaggtccctgaaacagaattagttaacaatttgattacattatgatgaaagtagcaagtttccctaggtattcctaagtatatcatcaacagaacaattgttacatgcattgcaaaataaataccaactgtagcaaaaagaaaaattcaaggtaagcatttttcttcctgtagcccaacgaacagcgcatacaaattggtatctggtaaggaaccaaggaacaatgtttgctttcatcaagctcttttttaaaagaaatggtatcactaagaaatcactgatcactaaaaaaaactgaggaataaatttgataactaaaaacttttatctaaaaagaatcactgccaagttaaattactttgagcagggaatgtaataccatcaagactatgttggaaccaattacttatctaggtattcacaaagagataacctgtttcgacatagggcaaatgtagttcatgatgtaggatgtaaaagaaagaataccaaagtataaagaaatggcagtgcacacttcagaaactaaattatatgccaaattacagggtgcatgatttgcatagttacagggaagaatttatttattaccttcaattgcttcccggggtgtcttgaagccaaggccaatattcttccagaagcggttacctcccttgccaggcttcttccctttgccagatttctttgggctgaaatcaagcacctaattattagatacaaatgatgtatttaatgaaccgcaaaaattacaggtagaagcagaaccctcaccaaaggaagaccttgggctgcttcaggaaagctctctcagtctgaacaatacaaagaatgacatacgtcaaaactactggcaccgtataatgactacattctaaagtgtgcaatagaatagtcaacaaattgtaagcacgacatcgacatgtaccacggtaaatgcaacataactctgctatggtgaaacatgacaaaggttttatcagaacacaaacaattgagcatcacccaaataaaacattttataagcatctagccatcatgacaactctagttagtttttacttaatagagaagacatttcctttaccctttatgcaactttactttgtactatacactatacagcttccttcacatatctgaacccaatctaaccatcattcccacccccaaacacatcatcgattttttgtcaatgaaaatcacagtatacagagataaccaatgaaccttgggttgaaataaataaacaggtggagtcttggggagcgccaatgcgacaacccaaactacattaatgtcatcgagtctcaaaatgtacaaagcatttgtgtctcagcttgcgagctctgaattcacatccccatcgcaaaaccatagtacatcgtggattcttaaacagaatctttaaaaaaattcaacgaaaatatgccgccatttcctaattatatcctcaggagatgcccacagatcaaagcctcactaccgtaagattcaaacttcgcatcggtcatcacactacactggatcagatcagatcagaccagtagatggctcgaacaccctagacgcgccaattaataactggtcctaaatcctaaacgagaggaatgggaggggatgcgagaaacagcgcatcgacggagagagagatcacgcggggtgggtggcgcgggcgcttacctgctccgccatggctggctggagggtgtacggcggcgaagggggaaggaggctgcagcggcgatgcggcggcgggcggcggaaaccctaacgagaaaggtgtgatgatcttatatacagaatggggagggggttttttaggagctcattcaatgtggaggttttgctgaaaggaccctgatttttttggaatttgtgcttagtagtcacattgtgaaatgaaaatgagattttgctgaaaggaccctaaaggctgtgttcttttggaggggttgggaaccctctcctccgcatggaaaacggagcgatacattaatacgtgattaattaagtattatctataaagaacttgaaaaataggtaactttcctatatcaactttttgcaaagcgtgtatcgtttagcggtttgacaaacgtgcatacagaaaacaagggagatgggttgggaacccatgagaaagaacacagcctcaccgactactcctgtcccataatattaatggcatgtttggcaagagaagggaagaggaatgggagtttgaaggaggaagttgatggtggaattggttatgggagttacatttttagtccccatttgttgtttggttttcgagtccaattctctcataatctcacgaattaatatgtcttctctaggtaagagatcaactgctaaatgactaaatttaattttttggtcaattcgaccaccaccttcggttaaccatattggctgaaaattggcccaataaactcaataagtaaatgttgaagaacatcaatttaagtaagccctagagacttgacggcaactacaactgtaaattcattgcaagcgcctatgcctatactctaatctagtcctttgatctaaatccagcgcacaatgacaatacatttggttgatttagatatctcaacgtgaggctgaggtcgagggccaggactttaggaggacattgaccaacagacttaccatttgcgtagcatacaattggtttatgacgattgagattgaattgattgatctcgactattttatactataactaagtatttgatgaccagaccgaagactgataccgaaatcaatattcgatcagatatatcttagccataccgtacgtacgtcctcatatccatatatatctttgaggatacccctgcaacttccttgccaagcaagctaggggaaaaattggtcaaacacaaaatcaaatagtttgtcagaacatttcccacttagggtgtgtttagttccacaccaaaattggaattttgactaaaattggaagtttaaagaaaaatgttggaagtttatgtgtgtaggaaagttttgatgtgatgaaaaagttagaagtttgaagaaaaagttgggaactaaacaagggcttatgttctcattccagctgccctactaactactaaggctgtgttcgccattcccggttcccaatcggagtagtacgcatggaaaacggagtggtccattagcgcgtgattaattaagtattagctatttttttaaaaaaatggattaatttgattttttttaagcaactttcgtatagaaactttttgcaaaaaacacactgtttagcagtttgaaaagcgtgcacgtgaaaaacgagggagatgggttgggaaaagggggtgacgaacacacactaagggcaatagcagtgcaagctatggggcccatacccctagcccaaagttatagctcaaagacatctaccccacagtgcaagcacccatatatgtgtggctaaataggatgaaggtactatggaaagaaacccagcccacagtgggcgttacccgagtcgcgtggtcacagggagcggaacgaattaattttcctaacctacccttccagcgactcctctcccagcccttcgcctcctcccaatccgctgcacccgccgcttctcctcctcgtccaccggcgctccactccggcagcctcgcctcgccgtcaaccccgccgcctcttctcccgtcaacggcgccgcctcgtcccggtaggccgtgccgcctcgtcctggtcggccacgccgcctcgtctcccgtcgatcgcgccgcctcgccaaccagcaagggcgagggggaggaggaggaggaggtggtgggggagtagatccggcgggcggcgaggtggagggccggcggttcttgttggtcgcgcaagcggccaccagttcttggcggcgggaggtgtcccggctaccgcggcggcgtccgccatcaccgcccgcgtccgccgctcctcctcccggtccgccgtgcctactcgcctctcacgccgcggggaggagggagcaagaaggcgtcgccacccactgcacgcggtggcggtgaggtggaggaggagtaggaggtgggggagtagatccggcggtcggccaccaccaccagcctcaccgctgcccaccgccaatcctgaccctgccggcgccgccgcggtcagctctgtcaagaaatcaagaagcgaatcattgttcttaatatctttgcatgttctgttctccagttcttgatgagaaaaatcaagaactgctctcctgtttttatctttgcttgttatgttcttatattcagttcttgtgatgtttgttcctgtggtgttttaagacccagagggatcctactcctatctatacttgcttgtcatgctcttatcttcggttcttcgattttcttgccttttcttgactcgatggtgggaggaaaaatggatgtggtgggaggggaaatcgctgggcgggatggggtttttcgtgggcgaatcgggaatttcttcactggatgcggcgcgaggtcacggtgtggcgaagaaccgaagcccacagcgcaggctcctttcgtttttttggccgcgcgtagactcgagcaaacaaggttctacgtcgctcagtatggatggacgtgaggagcctaacttggtcacgggcgctcgttccatgtcgaacaaaatcctccatggcgccccatagcaccggtccagggtggagcacccttaaaggcctaaggaagctttggaatcctctcctcttatggagaatgtatcattggttgatgtactatgctacgaagcactgatacggctaacagtcagcgtatccgtatcggatactccatcggatacgctccgatacatatcccatacgtatcctcaatttttctgattttcaaataaataaagataattcggatacttcttggatacggctctgcgcatcctggatagtcccaagtcccaaccctaacaaatacttcctccgtttcacaatgtaagactttctagcattaccgacattcatatagatgttaatgaatctaggcatatatatgtatctagattcattaacttttaaatgaatatgagaaatgctagaaagtcttacaatctgaaacggagggagtactgtcaatcgccgcatctacgcgtgggcgcgcggctgcgccgcctccgcaaagccgctgccgccaacgacggcaaaaggagagccgcggcggccataagtcgaacggaccaccgccgtgccagacgtgtaccaccttcactgccggggcgcagcgccgccgatggccgccatcgccgggcacagagccaccgcactgagcaatatgggtccttcgttcccactgaaggaaccgttgatggatctgttttgtgtacgttcttccccccttatttttttctaagaactaatgcatcttgtttcatatgtctgatgggttttggatttgcaagttcagagtactgcatctatcgttcctagtgcctagttcggctggagtttcatcaaggctgactggaccaccagcaaggaaaaaacatcaacttgtttttattttggcactgcttacagtcttacactaatttatacattattcttggtcctctgttatctgggctttggtggagataatataatccaatcagaaagttcattatttcaggctaatctctttagctacaagaaagtgttattgtttttttacagggatttagtaatttttttaattaataagtatatatagacgtatccccgtatcggtgtttttttaaaagtgacgtatcctcgtatccccgtaacgcgtatccgtatccgtatctccgtatcagggtaacatagttactatgcttctaaagttaataaagttaaattttttttaaaaaaggatacccctgcatgtgatccctagctatgactatcaatatcctatatcctatgccgtttgcatgggcaagcagccggaggattatttggagaatggagattcatcagttccttggagcgcgtggaggcagctagcagaagctcatactgaatattcatatatggtcccgtgccctcgcgccgaacaagcctgcagaaaaccccaaatcgccctccaacggaatcatcgctgaactgatgaaatcaacccaaacgcacagcgaattccaccccaaaccaccacagatgcggaccaaaccgctgaaatcaactcaagtcaactcaaatcaccccgaaccaacagatctagacagtgcaagaaaaaaacggcggctcctgcttctgctcctcctcctcgcggcggcggcctgtgccgtgcggctccgccactccccggggtccggcggcgctgctcgaggcccccctcggcaaggtcgccgcggtggaggcgtgccccgctcgagcctttcccctcctcctccgccgctgcacgaggccagcgtcgcgcttccacctcgccgccaccgccgccgctgtgatggctcggcggcggaggggaggatcaggagcggcggccgcattcgagaagtgaggcagaagaagaggaggatgaggaaaagtagataagtcagcggacggaccgctcgagggtaagtgaggaataaatttgttccgcactacccgtgtccatgcgcttggggttccgcccactgtgggctcagtttccttccatagtaccttcattcaattaagctacacagaataggattcttgtactgtggggaggagtgtctttgggacaatttttgggctaggatccggcaaccggtgcttgcgctctgagaggccttagccgccctcctcttgtgcagccgatcaattcatctctagctgctggtggcactgcaccgcagcctcatgcaccagctatagtactacatgcgttccaaaaataacttcatcttttatcatcataacacaaattgatatgaagtaaaaatatactaccaaagtgtctctccttaaaagaaaaaataatattatatatttatgagagcaagtactacggacatccaaacgctcgtatttgtaggataataggatcacatgatgagatggaaaaggaaaacaaaggagagagaggagaaaccacctctcatgtcatgaaagaagcaatctctacacaaacttctacggggaggagagaaagaaactaatatagtaatatagtaaaatatattattatggtatattagcacgggtgtatatctaaggcaagtaatatgaagataaattagaggtgatcatcatctttactataaaacttgttctaagtggataagaaatatcaacaaaataaaactaattaatttatggattagatataaataaagtgaaagaagtgatgtcattttgaaaagaatggtagaggtaaaagatacgaaattattttataggatggaggaattggagctatcatgcatgggctaaattagccggctccctgacctcgacagctcgactgctaatggcgatgtgtatatgtgatggtctgacggtggctgcttgtggcagccggtggatttttctggggtttgcttttgagctagctgggagttcgagagaagagaaaagaagtaaattgggaagatatgtaaaacgagatgagctattaatatataattagttgagtattatttattttaaatttaaaataaatagatttgtatggtttttaaagcgacttttatatataaaggtttttagaaaaaatattaccgttcagtagttcggaaaacatgtaaccaaacaacgcagcgcagactgcaggattgatcacatatctactcataggggtgaagatggtcacggaaattcccgatcaaccgagtgtcgtttccgtataaagggtaccgtttccgaccgtatcgtttttttgctattttaaatttttttcataattttttctgcatcgtattaatatcgatactgagtagtttaaatgataaatatggtcaattattggctgatcgagcaccgtttttaaagagatgatatcaattccgatcgtttccgacccttttcactcctatctactccatatcatatctgtccatggtgtttgagattacagtgactgattgattgggaatgcattcacactctgcagtttctagctcgtacgtacctccctctccctctttttcatagacaaaaaaattaagttctggtttacttcctaactttttcttcaaatttctaacttttccatcacatcaaaactttcctacacacaaacttccaacctttccatcacatcgttataatttcaatcaaacttctaattttagcgtgaactaaacacaccctaattactatctacatcagtacaagtgtgagttttcatgtccaacatttaactatctgccttatttaaaaaaatataattagtatttttattattattatatgataaaacatgaataatattttatgtgtaactatttttaaaaaaaatcataaaatttttaaataagaatgatggtcaaacgttagatatggaaaaccacaactatatttatatttatattgaaacggaggtagtactacaaaagaccgacattgtactgtgtaacgtactgtttgcacataagtattagtactgagctaactgggtcgtgttttcttcaaatataacggaagatattataagccccgtttagttgtcggccataacttatcatagattagataaatttgatcaactatttagacagttgtagcaagattagtacttctaaaaaactagggctcgggtgtaagtgattaagaaaaatatgacacgattctctcttaagcttactaaggtggtgtttggatcccgttactaaggtagtgtttgaattcagttactaactttgtatagtctctgtcacatcggatgtttggacattaatatgaagtattaaacatagactacttacaaaactaattgtataaatgagagctaattcgcgagacaaagtttttaagcctaattaatctataattagcacatgtttactgtagcatcacataggctaatcatggattaattaggcttaatagattcatttcgcgaattagtccagggttatggaatgggttttgtcattagtttacgtttaatacttctaattagtgtccaaacatccgatgtgacagaggctaaaaatcaatccccccatccaaacagctcctaagccgtagcaaagattttaaccaccaaaccttagaaaggttcaaccaaagtggttgtggtagcatgtgactgactgctgaacataccctatatcactattatagaaaaggctattggtgttggttgggaaactttcataggtgccggatttcccaactgacaccacgaagtctattagaggtatacgatttgcaaaaaaaaaaaaactccagcttagctcaatttgagctaagctagtgcttcaaagtcaccaaaaataaatccaaatatatatatataaaagtacacatcagacaatcaacaagttcatggatcacacgatcaaatgttcatcgataagttcacatcatagaatcaagcatcataaaaagtcgctgttggctgcatccaccggagaaaagcttgctctagatctagaaatgaagatagggttaaggcaaagagaaatggtggtgctcaccgaaggctgaagagatggatggagagagaaagaggattcaagtcgacatgggtgctcattggagccggaagtagcaggacaccgttggccaccgttgctggccggatggagaggagaggccaaggcaggccaggggaggggagacggacggagaggccgccgtcgcccatggacgcccttgcccgtgagatctggagcccaccgcccgtgagatccggagcctgccaccaccatcatcgatgcctctcctcccaccgaatctggcggaggggaggccgagagagagagagagagactctcggtcttatccgcttgtcaccgcgcactctcctccccttatccgctcataagctcactgctcagtttttaaaaggtgtcagttttttaaaaggtggtcatgcgcatttaatggatggaaaggtaatgggggatgacgaatagaggatttagggccacaaagcgtgttttttgggtggaaagtttagggattcgatgcaggagagttgcgggaagcaagaatgaccttagataatggcatgacactagagcatggccgctgatttcaccgaagaagggaaatattttggtggaggcggctagggcttttctatgtggacgaggtgggacagagatgtatggactggagggaaactataaaactagcagggacaggcaattttttttaaagaaaatgaggacaggcaaatttttctggagctaaattctttagagttagtcccatataatcccttctttcataaagttaagacccaaagctgagatttggtgaagccacgtcatcatttaattatcgaccgttggattacatctcagtggtcctcattgcgttttggagcatgccctcggtcccttcgctccccaccgcatcgcctcctgtaccgtatcgcctcccccagcaacagcgactacggcggtgacagactctgtcgatggtgacagcgacggtggcggcggtcggggacgagcgcggcggaattggacgcggacgagggcggctgcggcggacgcggaagagggaggcggcagcggtcgagggcggcagtggacgaggacgaggcggctgtactcgacggtggcggcggcggacacggatgagggcggtggcagcggtcgagggcggcggtagtgacgacgacggcggccacggacaagggcagcagcacctttgcttctgttgctcgtgctgctatcatcggttcctctctcttggaagctcgcccactctactgctgcaggttaattggtgcccttttttttctttcgtttagccaacaagaggaaatcttcctccttggctaattcggttgtgctgctcattatcctcattgtttcttggttgatttttgcagacacacagaattgggggcagacctctgttgttcatcttaggtgagaatgaatttacagactttcctttttctgctgggcaacactagcaatctattctggcattatctctctctttcgctactttgtgtgaagctattcaaggatggtgtgctgcagacgaagattagggacaaagacgatccccgcctgtccaagatgcggaaagaggtggtggctgggggaaaggatgctatggaggtggacaatgacttcttcctggtgcctgtcaagatctctgatcaccaggtattcttattatttcctacctgttgcatagtataataaaaacttacagtttgctaaataagtttgcttcctacaacatagcaatattaaggtgaaaaccaaacatgcatggacatttcacttgactgggtagcagcatgttcagcatgtttgaaaccttgaatcatcacccctcgtatcatttgcacgatattttaacaaatctatctatcacttttacaatatttaacatatacttatcaatatgtttcacattgaagcatggtattatttgattgataaaccctgatgtttcattattatttttttctttttactcctaacttgctgtcaaaaaaattaataattacttagtaattctcgcattaaagcgcggggaatcaccttgtttttaatcatatcgcagggaaacatgaccggccagcatggtgaacgtttcagttgtttgttccctcttaatactgtaaaactgtatgaaacaaaaaatttccctatgttcctagaatggtacgatatgggtatttttattttccttgtctccacacacactagtaggaaaatattaaacggtagggaacatggggatttttagtagtgagataaatattattaagaatgcgaagccgtgttttattgtagataagatttcggtgttcaatcaacgaaaacatcccaattcctgtatagtaccagacagattattgtctgcatgaatacaagaccaataatttgagtgttgcacacgcgtaatgaatgccaatagcaagccactatttatagtatgaacgcattgcagctaaccttgaaatatcgccgtttatgccaatcaagagtctaataatacaatagagtgttgacaacagaggaaatacaggagatcattgtcaacctttctattcatcactggtagtacaagagtccaggactccaggaccatgaacatgatccttctaataatgaacccttcagagttcagacatcgtatatattgccctcttccttttagcttttatcattttcagatttttgccatagattacttgctccacgcttttaaaaatacgatttctaaaaatcaatatcatctactgcattattaatttaccacttattgtaagccagatgtaaagtttacttatattttatcgtgctaatcgagtaaacaatttgcctcaataattgatgcaaaaatcttttttttagaacgcaaaaatctgtttgaaacagggagaaaagcacgccatgcattcaggtgccatctttgtcaggggtcaatcatataaagatacactaatatctgaagatctatatattctgatattacatcgttgtagctgcagacttcatcacagaacaaaaagaaagataaggctgcagtattccgatcatgtccatttcacttttataatgctaaaaacacggcagaaatcttcagagcccatgatgaacaccaatgcaaaaagttcaattcatatggaaaataaaaaatggatggctaagacgctccaaggatacacttggttgatgctatatatctgaactgatgtatgtggaagctgcagaatccttgattggattagtcatcacctagctagtttatatactcctagacgtcctagactagatggagttcaagtggaagatggcaacatcatccttattcactggctataaatgaaagttgcattcaggcattgagcagagcatgcagtactgcagaggatctcaattgtatatatcaatatatggttgtatgcatgtgttgatgtcggtgatccttttcactggctacagatgaaagtctgcacttgccagtaaaaaaaaaagacatgctgctatatacagtatcccatgaaaatatgcactcatgaacatatgaagtggtacgtataaattaatactacctccatttttcaatagatgacgccgttgattttttctcacatatttgaccgttcgtcttattaaaaaatttacgtaattataatttattttgttatgagttgtttatcactcatggtactttaagtgtgatttatatcttatacatttgaataaaattttttgaataagacgaatggtcaaacatgtgagaaaaagtcaacggtgtcatctattaaaaaacggagggagtacatatataagattgtggtacactgaccgtgaaaatccgtgcttagacttagaggcccggttttaaatccactatcttaaaaaaaagtggtgcatataaattgataagatgattcacttatattttataaaaaattatattagtacagcaagtaaaataccatatactctctcagttcataaatataatctattctagattttttgaggattaatattgaagggaaaaaaataggataccccctcatcaaatgggaggtggttggagataagctcatgtgaaatttaagtaaaatagtattttcgaatttcttataatttgtggataaaattgaaacccaaaattcgttatattgatgaatgcatagagtaacagttagcgcagcatatctcttttcaaattagaattcagttaatctcatatataagcctcttcacatgtgtcttaattccttcctaatttgctttctctcatgtcagctttcttattgtgcgtgtgtgacaactgacaagcttatatatggaagagcagtatctactgtttgcaaaatggtgatgtgaccaaagtaaagacaacagaaagaggacataaacgtggacaatttagtgatcactgatgattgatagcttcttgagcattcatcaccacacaagcacgttgttgattgaagcaccagaaacgtcggtgccatattgatatttcatttgcttgtaaggatcaggaatttcgcctgaacattggccggctttcaacaccggccagaatggttcggttttgttgagtgaaatttcaatttgaaaaaaaaaatcaagattgagagtttgaaactaatactggtgaccttgttgctgagttaattatgtggtgatagcggtagtgtggtttttaaccgccagtgatagctggttcagcagtagtgtataatacaattttttgcacaatattaacaattcttggccagcttctcttcgatggcctagcaaaaaaaaaaaactagtaagtaccgtgcattttagagtactatataattttgcatagaagctttaaaacgatggaggatgatatgtgaagttttaaatggctataatttaagcaagaaaaaaacgaatccgaagtacgtgccaaacagttacggagagtcgttggacaccctgttgataagtcttaggtggtgtttggatacagggattaaattttaatccctatcacatcggatatttagacactaattagaagtattaagcatatactaataataaaactaattacataaatgagagctaatttgtgagaaaaattttaaacataattaatccataattagtacatgtttactatagcatcacatatgctaatcatagattaattaggctcaatagattcatcttgcgaattagtccatgttatggaatgagttttgtcattagcctacgtttaatacttctaattagtattcaaatatccgatgtgacagggactagtccccagatacaaatagagctaaatttattcccaaaggttttatgagattgcaccactagcggtttgcaaataataaattcacatatatttaaacctccccacattattcatgtatagtatttctataacatacacgtcgcatcttgctagagatccataaagtctacacaaatatcagtgtgtcgtttggatgtagtgacaagggtcaggatgcatgggttccttttccatccctaggacataaatcatcctctagaatacaagcccaaagttcttaaaaaaaataaaaaccaagtcgaaaaatatatgaagtgtgaaaaaaagacgcttttaggatgtcttggatatatcgaaattgtctggcattcccattttattattttagaattaaaattattcagtttgaataaaaatgaattgatttccctggtttggtttggctcagcttttcagtaagaactagtgatatctcaagtgctagacaatgaggctgaggagctagagactcaaagaggagtgttcctcatatactgtaagaggcagcaatgtgtactggttcaaaaaagagaggaaatatagggtaatacaaataaaaaaaaatattgttgtagtttattttggcccaaggcactaaaagttaatgttatgtacggagtatatatatgttagttaagttcctaattgatgactagaggatataaataaaattaaattataggtaccatttcaaattaacttttcattacagtaaatttcacactaaactagaaagtgtgacaaattatattgctactctcattaattaagtcctgattatctttttcacaaaacaagcattcaaattcccataatagaggaagggaaagatatatctataaatgctttggaatatactaatgacattatttaaatgacagattgcaaagcttacagattaacaattagcctgacaaatggtcatgtttatggaactcagatcaataccaacccaagaaagtttactcaatgttttttgaacatcttcaagttgccaggcatctatcaatactctggaaaagcaaatgcacaatgaagcttaaagtttttctttggctcatgctaatgaatcgactcaacacaaaggaaatgttacataaaaagcaattcaacatataagatggcacaaactgtttgatgtgaacctccatgaccacagaaagcatggcacatttgtttttctcctgtccattagcacaacaatgtctggcaacacattggtattcactggaatttggccttggaatttatgaacatgatcacttcagctcagatctcttttcagcacactttcttctttgaagttttgacaatcggctgctggcacatctggtgcagaaggagtgacctcatttttaacaatgttgctctcagttttgataaatggaaggctgattttctgagggagtttgccttgcatatgcatagagcaaaagagatggacaaacctaggtgacaatcatggttagacatttttaattaatttgtcttttgtaaattctcgtaaccttgtaaatcttctatattatattatttaatgtagcgcagtaggagcctctcctactgttttacgtaaagaaaatattttgagaaaaaaattaaatgctaaaaggaagaaatggaaggagtaacaagcctgctttaaagagtagttttaacttgtctcaaaccagtgacagatccatcggtggggtttgttggtgcgcaagcccaaccttcaacctcagcttataattcactactctctactctctttttttcatattttgaaccatttaacttttttttctagtcaaactttgttaaatttgatcaagtttataaaaaagtttaacaatatctaaaatataaaattagtttcattaaatctagcattgaatatagtttgataatatatatatgtttgttttgtgctgaaaatactactgtatttttctataaatttagtaaacttaaagaagtttgattagaagaaaaaataaacgacttataacacgaaatggagcgagtactagtgactctactggccatgcatacggcaaggatgccacatgctacgtgaagtgctgggcgctcaaagctgcaagtatccaatctactctctgggtagatcatacccatttgggaatttgttcctatagatttgtgtagatatattaatatagttgaaaatcaaaatagagaaagcaatgtattttcttttgatcgtatgtgtatttaggtctcatataaaaatattaaggtgatatatctctattttgtttagtctagagcactcgctcaatttacatacgggattcatcactgtctcaaacttaattactttaatttttttagaactaattaaacttactttaattgagagaggagatgggcgtgcctttttcccatctagcatttgacaaacgtgcggacaatgatgaatttaggagaggcaaaaccctgttcaatttagcttcccctaatataatttttttccatatttttctatgatatatacaaagtttcgattatttgttagtaatccaaacaagttaatttacccgggtaataaatatctttaagttcacgaaagcgtgtcttgctcattcagctagttgaaaataactttgtcggatgtcgtcataatacctttatgcatattctatttcggatggttgccatttggtccaaccaagttgagagaatattaatattatactcctagttaagcacagctagtatagcacggtacgtatggattgaaattaatcgatattaggggaatccaaatccaaacaaattaaaggtcttgaaattatccacccacatatatattttaatttcagtggataggtgaaatcatattagttattttagtactgtaccatcccaacttccaaacaagttggaagatgacatatatatagtagcgccatggcaattattgttgcaaacaagggtcatgttgttccaaaaacaacagctgattaattaggtaaaacctcttcagcgaggacaaaccatgtcagctcgtagagtttaattagttgttgttagtcagccaagcacttacgatgcaagcgaagtcccaacgccatcttgtttatttttcactactttcagtcaatattattggatatataacgcgatcaaaaatatttgcaggaattaatgctcatttttcttacatagacatatatctcattacttatatatatatgtacacgacacgcatataattgtgaatacgtgtacgtccaatgtcaaagaaaccccaaaggataaactcagaaaataaatagtttctataaaaatgtgcatgtagttagacactaatatctaagctctcataaattaagttatgcgtgtacttaatagttttggtgcatgcttttccaataacttaccgtataggttgtaccgattattagctgcacatgcatacataaattaagaacacgtttagaagaaaattttttcgacggcttaaaagccaaagacacataactgacataataaaggtactccctccattatctctattttttttaacattggttagcttaaatttgaattaactagtgtcaacatttagagaaggaggtggcgattttttgaataagacttctacaattttgctgttagcagcctaaaagtcaagacctgtaacaaattgaaaagaagcctctaattaaattaattcagaaaaaagaacagaaatgactcaaaaacagggccctatagccagaccaaatattcactatatataaatacaaacacatcattgaccattggaagctaaagagcttaggccaaacatgacatgcatgctcccttgcctctggcagcagcagtagccaacaaccaccacgttggtgtacctaactctcactaaaaccagcaggcagttacacgcgtcactggctgcccaaactgaagagggaagagccccaggtggccggtcgcaacagccaacaggcaggcagaaaggcgaacccagacgtgggcccgggggtcagcgagccacgagcggcaatgatgaccacatcatggtgcaggagaggatggcaacatggtgtccacacgcctactcgacagagctctctctagctcagcccaaaaaaaaaaaaggtgacggcatatgtcactagttttccgtgtttacaatatgataaactgtagaaacgtacacacgcacgccttacaactatgggtctgtttagatctatttgaaatggcaaatagcaaatggcaaaagttttggtggtaaaagttttggcattgcaaaagtactagttggtatttagatgtatgttaaagttttgccattctagcactaaagtgacagagagaaagagagaggtagtggtcccaaaacattttttggcacaatttgctactatggactagcaaatgtcaaatgccaaattgccaacttttgctactagtgtttagatccaaaatggcaaaaagtgctacaaaatggcaaaacgttttggaggatctaaacagggcctataaacaccttcggtaaaaagggtcgaagaccgagccgatattttttttgagattgataaaatcatcacgggtatttcgctgtcgatggatacgtcgctcatcactaaaagaataattagccgtaaatgcgagcacccgtaccaaatatagaatttgaaacctaccactgaaagaaaaattagtcgtaaatataaacaccgtgttaaatctagaaattaaacccaagtacactgattccaccataagaaacctaaccagttaaattacattcaattcatataaattattttctatattatcttcttaacaaattataaccacacaccctatttatctatttaattaaatctgttttcttaatacatgtgtctaactttaaaagtgtttatattttaagatagaggtagcaaatatatactcggtttatatcttccggcgtaggagttcactactagccagcaaagccattccgttcccttctggccaatgcacatctggcaaaacccaaccgatcttgctaattgctaggtaggatttgctgctttggcaacatttcagtttatccttttggtctttctcattctcaaggtatctctttgtcgttctcctgatcaccaggaaggtatctttgtgttactcttgttttcggattcatttggttgacatcttgttttcggcttcgtgtgatcaataacttttgttttcggctttattcgatcgatatgggcctaattatatatagtggtcttatcgtatcgttaatcgtctattataggatggtattctatttttttctcttacattttaatcgttaatcgtctatttttttctcttatatagtggtcttatcgatcatggcactgcatccgtagtccatcgtaatcgttgaaacaaaccttgtactctttccgtattttaatgtatgacgctgttgactttttgatcaacgtttgaccattcgttttattcaaaatttttgtaaaatatgaaaatatttatgtcatgtttaaaaaacatttgataatgaatcaagtcacaataaaataaagtgataattgcataattttttttaataagnngaatggtcaaacgttgtaaaaaagtcaacggcgtcatacattaaaatatggagagagtactattttgagtatggtgtgtgcgataacaaatggggtttctctttcaaagtttcacatcgtaatcgttgaaacaaccttgactaatcactatcgcccccaatgaattagagcgtgttcttgtttgttgtggcttggccgtctacatcggaattgctatagttgattcgtgtctcaatgatgaaaggtaaaaagattgtagatgcgaatgctccaaacttagcaattttaatttgatgtttcccgaattgaaaggtcgtatctactactccacattttatagatcaaatcagaaatttcaattttattcacttgaatttttttctgtcttttggaagctcgacctctgctgctctgcatcaaacacgatgccactgtacttcctactaaaagcctgtttggcagagctagtaagagtaatagattttatttttctccgtaactcaatatcttcaagcgaattagctcgtgcatgtaacttatgtatcataataaccgaataaatttcagtttaaatatttttaaaactagccagtgcatgtatacaacaactcagtactatgagtaaccacacactgaacttctcaccgttcgtgaccagtgaccacaggaggacggaacatccactttgtcactcaatcctagcagcagcgaagcgagcaacattgttaagcccgagccactactagcattttcagatgatcaactaatttttataaattgttgatggatggaggaaacggtagaggcggagcccgacccgcaaggggagtggctccgccgctgctcaatccaaccgtcaatgcagcatctgacggctgagatccaccaccgcatacggtccagttgcaccactagcggcagaggatgcaagcagcagaagcccaaatttaaggggaatttaactatttgccacttttagattttgtaattatccaaatgcccctatgtgattcacgcttaataatttaccactggcaagagatgatttcttaaactatttgtcacttttgtctacgtg

SEQ ID NO: 42950 - DNA, 6291 bp, Oryza sativa
agttccatattctagtgctgttggttctttgatgtatgccatggtttgctcccgtccagatttatctcatgctatgagtttggttagtaaatacatggctaatcctggtaaagaacactagaaagctgttcagtggatttttaggtacctcaaaggcacagccgatgcttgcttgaagtttggcaggactgataaggggcttgttggatatgtggattcagattttgctgcagatttggataagagaaggtcactcataggttatgtgtttactattggtagttgtgctatgagttggaaggcaacgttgcagcctgttgttgcctagtctaccactgaagcagaatacatggctattgctgaagcatgtaaagaatcagtttggttgaaaggattgttcgctgagctttgtggagttgattcttgcattaacttgttttgtgacagtcaaagtgctatatgtctcactaaagatcagatgtttcatgagaggacaaagcatattgatatcaagtaccattatattcgtgatgtagtcgcgcaaggtaagctaaaggtatgcaagataagtactcatgataatcctgctgatatgatgacaaagcctattcttgttgctaagtttgagctttgctcaagcttagttggtatagtggtttaacccaagaggctattcggcgccgaaagtgtttttgtctttgttgtattcagggtgaaggattgtttcatgctacaagaaggaattcgtctcaaagtggagtttgttgagttgtgatccaaattcatttgcacttaataaaggccaacttctgccgtagtggagcggaggcccgtcgccgggaggcttgggccgaagcgaaacggatcgtcatcccttttaggattccaccatatatatacctcttgtaagccgccgtgcggtgtcgacccccgtttttataacaggaatcaatcgtgtaaacagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacaacaatgatgcacatgacagaggaattcaaaggatggctatggttctcttgcgcaaagcaaattttgtaattcttttcacaggcataagacctagcatagactgatcaagttttaataccagtgttcatattaaacaatgacggttctgtccactatccattgtgatcccaaggatagcttcccgccattgaatcgttatggttttctgaggatgtccaccttcccacctcttgggaagtggctcccacagcataaaattcatcatgcaatattccatcccacacaagttaaagaatttagagtctagccaagtgtaatacatgtctcggtgctcaataaccgcgagcacggctattcgaatagatttggttcactcacactgcagtggatgtacactttacccgcactccgcgactgcccaacacataagcctcgtcccaacacacgagacgcgtcacggcaaagcttttcgataaccccgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacgcactcatggcagtcctaccaatggcaacaccgatgtagggcacgcctctcggccctacctcaacggctgtcccaccatagcgcacctgcctcactcaggggtgaaccatctatgcagggatactgcctccgctcggctatctaatccgctaggtctatacccattcgagaagtacggttgtacgggggggtcgttttatgcttaacttcatggctcggtccttaattgaccggggacggtactagcctttcccagataccacccaaatcctccgtccgccccagtcgaaaacaattgtttaattttatttatcctttcacaaatcatgtcatcaacgtcatggcaatgtggcgctcatgtctccacatgccgtatttcaattaccttcccaaaggtaattgcccaagcatatagcatttgataaatatgagtatgcatgattctagaatagcatttctaagcaattgtcatagttgactagggactcatgcgtaaacatggttacaaagatttaagggtaaacaataatcaaggcatggcttaatcacaagtaggatgttcatcattgcatgcaattttatttgtaaacaaaacaatttcgcaattaggatcaacatgttcaaggaatagtgatgacttgccttgctcgaggttttgcgggtcttggccttcacctggatccgcggctccctcggtctctatagttacgtgcgagaattgatctgaattcggttagaattcaaataaaaatccaagtaaatccaaatggaagtcgaacgcgaaagtcatttcctttttattaattttactatccgcgaactatggcaaaccccaattttggtttaaattattttgcggttacaatattttgttgtcgtatgtttttaatttaatctaccctagcattatatccatatattaggttagaaatttcttatcgcgagctaaatgtcggacggaatcctaaaattatcttataatattatacgacttaatttagtctatgattaaatataatacacggctaacaccctagtaattaaatccgaatcgctaccgttgatcgattatttatagagattacccagaaataatccacaataatttacgagaattcatacatttgtttaattattaattacatctaaattaataccgcgaattgatttcttatggagagtactaaaagttatctataatctataggaatttatccaattataatttccttaatcctacatttaaatgctagtattttaggtatctaattagtaagagtttatctaaccatattttcattaatcctacaattaaattctagtatttgtaaatattttaaattcccccctaaattcttccccttttctttttctctttttctctccctctattttattttctctctccctctattttcttttctttcctctcttttctctcttttccttttcttttctttctcttctttttctctctccctctctttctttttcttttctccttctctctccctctctttctttttcttttctccttctctctccctcccggttcctctcctcctcccttctcttttccctccctcggttctccctctctctctcggctctccctcctacccgagcggcgcggcgacaaaagaaagagggggggggggaaacagcggctcaccgacggcggcggcggcgacgacggcggcggcgacgacggcgcacggcggcacgagaacggcggcgcgggggcacgggaatggcggcgcggcggcacggaaacggcggcgcggcggcactacggcggcggcacgggaacggcggcgcggcggcactacggcggcggcgcggcgaaaagggaggagatggaggggaatgggtatgggggagaagagatgggttgggggttttatagggtgtgagagggggagaaagagggggcggtgaggggatgcgacggcggcgcggcagcgcgcggggcacgaggcggcgggcacgcggcgcgaggtgacgagacggcgcgcggcgccgcagcggcgacgggacgcgtgcgacgacggggcgcggcgatgggacagcggcgcggcgcggggtgcggggcgcggggcggcgacggcgacggctcggcagcggcgacgcgactgcgggcggcagcagcggcgatgggacggcgcgacgggatggcggcgagcgatgcgcgacggcacgggcgcggggcgcgaggcggcggcatggggcttcgggatgacgtgataggcggcagcggcgacgcgacggcgggcggcacgaggcgcgggacgacggcgatggggaacggctcggcagcggcggcgcgcggctcggggcgggacgcgacggtagcgcggcgcgacggcgacagggcgagtcgacgggcgagcggcgatgggacgggcggctcggggcgcgaggcggcgatgggacgcacgagcggcgacggcgacagcggcgacgcgacgggcggcgacggtgcgcggcggcggcagggaggaggcggagcggcgcgcggcgcgcggggcgcgaggcggcgtggcagaggaggggctagcgctagggaaccacgtcgaacacctggcggccgatgaacagtgacttttcctatttatcccgattttagtgtattttccatataaatttgatttcacaattcctaattttacatatatgcattttactcaatattcatgttatcttaactaatgaattcaccctagattaatattactcatattttatttttatataattttcttgaatttaattagagttaattcttattcctacacttttcgatttaattgatacaattatagtcctaataatattttactcatttctatcctctctaaatattattttaaattgctctttaattatttacttagtcaatttactttttagggtttactcctaactaattttccattattcgcgatttataaactccgagatcaaaattcattaaaataatcgaacaaaatcggcatgatgcaactttatttaaaaagtttttgaaggtccgtatttttagagtttagatttcgtcgtcgaatttttagggtgttacatgcggcgtggtaacctcaccccagatatagtgaagatattttgctggctggcgcccgtggttttttctctcctactttaggagggttttccacgttaaatctcgtgtcttctgtgattgatctattgttttctttatcgtttgttagcttatcgtttcctaacaaactgaagaggtccggcctctgcacctagatgagcctctgccagtaagcaccgaaaaagcaggcagcatggccggaacgcctattggccatttctgtcgtcaccttctccgcgacatactagaggagggtggcccagtcgacccggtgagccgagccgtgcctcacgctttccgcggcgcggtccacctcctcgatgatggacacaggaagaggaggcggctccggcgataggtgcagggtgaggaagcggcgccgacgatgaacacggggtgaggaggtggcgccggcgacgggcgcggggcgaggaggtggcgccggcgacgggcgcggggcgagggagcgccggagcggcgttggcgacgggcgcagggcgtggccgtgatggacgatggcggcggcggcggctgaaggagtctcgtcctgctcgcctgctcggtggggaatttggtgaatggccgaatgggccttcactggagtctaaccattttggacccaatactgtattttttaaccaaaaccagatcggtccgaaccaatttgtctaagaaataagtccactttgattcccttaaaagtgacccgaatctaatccatgactctaaaccacaaaattggatatctcaacccccgaattatcgaaaccggtgcaatttgactcctttatggctttggagggcggtttcggtgacgtggcgctgatgtggcagtgtagacctagtctatagggttgacgtggcgcttaggtgtcatttgaattaaaaacgaatatgtgggactcgtttgtcattcacacataaaaaatgtgggggcccactgacatgtgggacccgttcttcttcctcccctcttcctcccttctctctttctttctctttctctcccctttggtcggccgagccgcagagagagcacgggctggagcggcggcgggtgggggccaaagcggcggaagctggagcggcggtggcggtgggagcggcggcggatggcgctcgccctgtaggccgactgcttcaccagcgacctgagccagctcatcatcgctgacgtgatgtccgggtcagtgccgctcgacgcaagcacgagtatcaggccccccct

SEQ ID NO: 42951 - DNA, 32553 bp, Oryza sativa
ccccacccccccccccccccgtgtctgcctactcatcctattcttcagtggatggtgaacgacctgctaacaatcaattttatgtctggttagttgctaaatgaatcaattttatttctggattttgtgatgcttgtggccttagcagcaccagttgaaggagatgcaatgcgggatgagttggtggtgatgatggggctggcgcgggagttgacggccatgcagcgagctcgagcaatgacttgatgacatcatcgttgcaatgcttaatagcgtagctcaatggcggccctcgctcgcctaatatcacgcccagaaattcacgagtaattttcgaactaatttgtacattaaatccttgtccaggaatcagcccaggtacacaaactgacaatttaatatacagattcatcaaaataactaaaacgataaatacttacataaaaggcacttagtcctcatcacgaagaaaactgcaacggaaaacaaaatctagcgaagcttcagctccactcccacaggcagctcaactgggatctaagccaaaggtcttctccttctggatcctttttcttcaactgagatttgatgattattgcaaggtgagtaaatgacatactccgcaagccacacagcaagtatgcaagtgcataggaataccaaaggatggcataatatagggttcatttgcgaaagcagcatttagcaaagatttaagagtagtaaaactgtagaataattaatcatcaatattaatcaatcactgaacagcacacccaatgctgcacaggcccaaccaaacctgaacaaccaactccggtcgtacagatcaaacctccaaaccaggaattagccattccaaaccaggagccaaattaactttcacattattatcattgatgagtagtgtgggactaatcacgaaaaatattgttagacccgcccataaccacgggcacggctattcgaatagttttactctggccagaggtgtaccactgtacccacaagacataacctcaacatcatgtctaccatgcgtcgccatactggaaagtacccgaatagaggctgtgacaatactccacacaacacaactcaccacagtgcaccgttcctgtatcataatcaccccctcaataaccagaggcatggactccccagcgacccccacggacttttcgccgcttctcagtctggcaccccgtaatgaaccatgctatacaaaaggtaaagccgttgcccatgctgacttatggttggcatggtaaatgtttcacaatagtagcttgcgaaccagtccttaattgccatgagcacgaccatcaaaaccatgtgctcacaacccaccattaagtaggttttaattatcaattaattatcttaacacgattaaccatcgtgagctaccattaaatataaccataaataaatatagtatgattcatcccattaatgatctaatgtttctaagcatggctaagcaattatatatatagcatttagctgaaccaaaccaatatataaggttctaactaataaaattattacccataggaaaaaaaagtcatcttcggccataattaaatgggaaaggctcaccacccggtgacattcgaaaataatgcataagttgagataaaacattagctttaaacgggttcaacatgttcaaagggttgtttgggatctgtgtgacttgccttgcaaacaagcgtcttcaatacatcttcaggaacttctccaccgaacaaacgctgcttcgaaacgacaaaaactaaacctaaaacgcaaaacgagaaaaaacactaataaaaaccaaataaacagtacaattaaagttcataaatgggtagagcttgaatttagatgaattatgagacttgaacaaccttaatccgagttcgtatgaattagttatgaattaatgaagttttaatcaattaaaacctataaaagaaaacaacctaaacaatttatgacatcatatttaattaatgttgcactgaaaagggtagaagacgacatcagccctaggattagagaaaaagagctggtgatactgataaacgggacccacctgtcatagagacaggaggtagcttgatccaccatagactcagttcacagagagttccataagatggatgactaggattagattaaccagagttgaccatgatccaacggacgagatcaaatccgatctagggtttaggatagcggccacatggcaacacgtggcgctgacgtggacgccacaaggacagccacgtcgacacggcgccggcgagcactggatggcgacgaccacggcaaacagcggcacgacggtggacactgaggacaccaacgcgaagagaagatcagcacggtccttaccggcacttacacgatgacgggcgatgaaaacagcggccggcgacgagatggggaggatggtggcggcgactttacggcgaataccggcagagaaggggtggacggccttcggcttggcgctgcgatgcccacggaggaaacggcgaggttcggcgaccacaggagaagcggcaaagcttcgccggagatcaaaacatggcgacgattcggccttcgcggtgacggcgacttccagcggggtttggcgcaaaggaacgggtggccggggtagctctcacccttgcgaagccgatggaggtggcggcgcaagtcggcgatgaccagagaagtgacagacgacggctggagcgatggtctgcggcggagagagaagccgaacgtggggaggtggcttgggctagggaaaaattcgggaaaaagggaaaaacggaagaggaggccgaggggctgctatttatagccggaagaggaagagatcgactcgggaacagtggcagagccagctgttaaaacctgtggggtcaaactggtaaaattgtttaagttttctaatattgcaacgcaaatatcaataatttttgggctgttttgtaaaaacctgtggggtcagctgaccccccagattacacttacctccgccactgctcgggaacggatggaatcggcgacggattagttagggttcgccggaaaaacggagctcgaaacggcgtcgaattcacgcgatatataacgggattcaaaggggtttcttagggataaggtagaggagatcgaggggaatctgtttttgcaaccaattttgagaggggagcaacggatgcgacggattttgcggaggaagcggcggcgcacgcacacggctcgggctctgaacaggctcggcttggggagcaacaatagactttcctttctttcatgggctggtaggaggagggatccaaatcggacttcagccaagagaaagagggagagtgggctgctgcgggctaaggaaaggagagaggagagggaatgggctgaattcggtccagacaaaggagaggatttaaattactttttaatttaaataaatactgaaatgatctctcatttattaaaaatactttcaatgctcaaataaatccaagaaaaatactgaaaatacttggacacacaaagtacttaatgaaattttatctagctcaagttaatgttcaaatttttcatagattttattcacacacttactttaatcattaaataatttctaaaaattccattttaacaacgatttataattttgcgattttcagggtgtgacacctaaccagcttgacaggctcgatgtcggccgtgtcgtgagcctgtcgcatacaccggatgcccgaatcttattgttgcaatcggcggagaggccagagcgccggatcttgttatcacggatggagggaggcggcggagggagcagggagctcgttccccggtgagggcgcggtgcctgtggaggtgaggactgtggttagggcgcttaggtgtcgtgccgtcgaccgccgttcccccgctcgatctcgtcggcgtcggcgtcggcgctgccgtcctctcccgcctccttgccggccattgagctgcccgttgccgctctggaacccgccgtcagctctagcccgccgccgcgccacttcagccgtactccccgcgggcggccgaaggagagagaaagagaaagaaagagagaagggaggaagaagaaagagagagaggaggacatgtggggcgacatgtcagtgggccccatattttttatgtgtgtgagtgacaaatgggtcccacgtatatgtttttaattcaaatgtcacgcaagcgccacgtcaaccccatagactaggtcaacaccgccatggcagcgccacgtcaccaaaaccgcccttcaaaaccaccaagggagtcaaattgcaccggttttaatagttcgggggtcgagatatccggttttgcggtttaaagtcatggattagattgggttcacttttaagggagtgaaagtgaacttattcctttgtctaaacaccaaaccgcaccgaaatgggcgaatttcggaaaaattccagggttctgggattcaattacagaaaaatttcgggcctcaccgaaatgggcgaatttcggaaatttcggacaaaatttaaccgaatttgttgcaaaatttaaacaaacatttgtaaatttgaggcaatttgttaacaaacatcagcaaatataggtaaaatgtttaggcaatcatataagcatcagcacacaaggagaattacagcattggcacatcccaagcactagcgaagaatacacgcgttgcagctccggtcggagcatagcatcagcaatgctaggcagttgcattacccctattactcactgacgcagttgccttcaccgccggcgcctgtgttgcgcacacggccgccgccgatttggccacatgagagcatcaccaagaatgagtattgtggaccaggggagaagatggtggaggggggagatagatgcctaggattcaggtgttgcggaatggaggaggaggacggcgacgcactgctccgacgctggtggcggcttgcatctcgcagctccatctaacagctgccgccaagggaggggacaaggagtcaaggaggagaaaagtgaatgaattctagagtggactttgaacttttatacccaggaacgatatttgttggcttgtttggtgtttgggctggcctgaaaatttaaattaggccgaaataatttggccggtttagtattgtctcgggctgcaccgatatggacgaaattcaccgaatttcggcccactcggtccgaatcccagaacctaccaacaacccatttctccccatccagaccagctccatttaaagaaccaaaccatttggcacatcatcatcatcatcatcatcatcatcatcatcatcatcatcatcattattattattattattatcagtagagtaaatttcacaaaactacaagtattttgtataatctatcacaaaacaacatatttagaaacttgtttcacagaactatagatttaatatattagtttatcacagaactacacatttagtgtcttcatttatcacaaaactataaatttagtgtctccattatcacaaaactacaggttttaataatgctgaaacctgtagttttatgataaaacctatagttctatgataatggagactctaaacatgtacttttgtgataaatgaagatattaaatatgtagttctgtgaaacaagttcttaaatctatagttttgtgatatattgtgcaaagtacctatagttttgtgataaacgaagatattgaatctgtagttttatgaaataagttcttaaatctgtagttttgtgatagatcatgcaaagtatatgtagttttatgaaatttactcttattattattattattattattattattattattattattattattattattattattattattattattattattattattattattattattattattattattattattattattaatgaatagtgtggagctaatcaggaaaaacattgttagtcttgttcataaccgcgcacacggctattagaatatttttagtctagcgagaggtgtacaaatttacccacaagatttagcctcaacatcatattgaccatgcatagcgatactggaaaagtacccgaatggagactgtgacaagacacttcgcataacacaattcaaagcattgcaccttcccgaatcatagtcgccccactttaaaccaatgtatagactcccagcgaccccgtgggcttatctccgtcacttctcagtctagcagtccacaatgaaccatgctatacaatgcatccggttgttgtccacgctagctcatagttattatggttaacgtttcagaacagtagctcgtgaaccggttcttaattgtcatgagcacgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgctgaaaggggtgttttagaatctgtgactttccttgctgttcttcataggcttccaaaccttcttcatcataaacggtctcttcggaacgtcggaagctaaagcaaatgaacaaaatcaacaaaacagtaccaagcataaacaatacatatggatatttttaacaaatagatcttgattttatatgaatttagagactgaaccacctaaatccatgttacggtgaattagttatgaattttctaagtttaataggatttaatccattaacagacaatgtttaagatttatgaagaattatttttaaaaaggaaaagggaattattgtgtcatcatggatcgggtccacattagaccgggtgcacagaagcggtccacgaacagctcagattagatcggcttgccacgcaagcagacgatgaggtgaactggttgggcgacgtggcgctgacatcatcgatgacatcatcgcctgcggcgactactcgggaccctgtggtcaccggcaatctagggcacggcgttgaaaacggaaggcgccgacatgacaagcgtgacggggaacccaccggtgtgcggcgcgacggcaaatggcgacagacagcgacggcgacaaggttggagcgacggcttggctcggatcatcggtggcggcggcgttccagcggtagtcaatggcgtcgggccggtgtatggggtgcgtctcctccttgcaatcccaaagaaggcaacgggaagcggaggcggcggcgcggtgacggcggcgctagggtttgcagtggcggcggcgctaggagcgacggcgacggacggggcttgggaggatcggtagagtgcgattagggctacctatttataggcacagagggagagattgagcccaacacgatcgcggtggcgccgggaaaacctagggttcggtttggagagataaggttgaatccgagctcgattccacgtcggattcaaagggataagagccgattcttggggtaaacgggagaggaggataaggggaagatttcccctcaccgaatcggactcggggcaaaaggtgacggcagatttaagagaaaatcgacggtgagattagacggtgccatgtggcagccaaggagcgtttgtaggaataccacatgacagcttaaaagcgtttatagaaagtttaatgaattttagtatatagtagatagtgtgctaaagttagtgtagagacgatatattatacacattaacccttagcttatatggataaaatataaaaattgaacatgtttttgccggtattttggtacgttgtccatgtatgagtcgatttttaagttcgtttgtttttttaaaatacatattcgtatttgagtcggtttttaagtttgttcgcttttggtgcttttggtaatacagaaggaatcgtataagaaatctcacagtgaatttcatcttaactaaactatataacaataataagattaaaataaacttcacccgttgtaaagtacgggtattttttctagtatggataaaattaaaggtggtaattacctcttctataaaatttgctccaagtcctctagtaagccggccgggctgcaggactgtagttagccttgatatgccataattgtgttttacgaattgttacaagctttggctgtttgcgtgaatatgtttctttcaacgggttcacgttccaatcttatctaataaaccgatttcagggttagaactctagttcttgattgggacaggtggcaccaatcttagaacaccgatcgaattcttggctggagaagcgcaccacgtatcccacccctccagcagcggtacgatagcatatcgacggtgaaaaagacgtcttgcggacttaaatgtatattgaaacttttaagaggtcttttttacaaaatgcgtgatctcatctagaacagcccggaagtagaccaaaatatcctctgagaaaaaaaagaatctaataaaaaaatcaacaagcggttagccccatcacgtggcctaattccatatatagttttgtcactacgcatagccatttgattaaaaatctggcaaaaaaaaaaaaactgcccccattgcaatctttgagtctttgttcgaattgaagataaatctggaattaatacaaatgaaaagatccgaaaatgtggtgcggattgtaaagaaaataaggataaaaataaaaaagccaatcctgcccacgagccgctgccatctcccctcccacaagacgctatcgtcaaccaccggattcgtccgtcactcaccgtgagatggtgctgtcctgctgagccgtcaaatccgaggaagtcgacgcggagcttcgctgcaggaggtgaaggtggagaatattagagagaaatgagcagctcaacatctgcctgcatgcctgtgggcagcggggagaaaagaagcaaaggaaaggaagaagaaaggtagaagaatgacagcgtcttctctctgtccgcccgtgaggccgtgacgacagaaaaaaaaagaggaaattaggaagagcggtgaaaaatgcatcaggaggactgagtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccatgcctaacgggccgtgccgaaacgggccgtgccggacccgtgcccgtgccgtgccgggccgggccgcccgtttggccacctctaggactgaggggagcacagctgtccactggattgctcgatgcactggtcactgggcagaggataagactatactgttgatgagtatcaataaatacataaatagtaaagaaagttagtactaataaattactcattgctggtttagattggtaccatcttaaagcatattattttgtgccaaaatttataaatatgtggatgcatttagttttgttactaaatattagtgatgcatagggaattttggttacaacacatttagcctatcctactaaaacttaaaattattgccaatttatcaaattattaacattacaaaatttttgacaggttcgtttgggcactaatctaaacatgcctttaacttttaaattacaatgttttaatggatgcaaaatagttataattagcgtaaaaaatattttacaatatttatataacttaagcaaattgcggttaaagtttatacctaaacaacaaaaggtagtatcaaataaaaaagaaacagtggagtagtagggttgattgttacatccaatttggccacatcatctgcttattagtttatacaatgtattgcatctaaaacattatctccaatacattataattatttaattagcttattcatttttatcctatacatattactctccaatttgctaccttgaagtttgtaaagaggtttctccttgtataaaggcctgaagggtgactctttctctttctctttctcctctcctctccctcccacctcacccattttcttaaaacacacacagtacatgtatgcactcacaaagtgcacacaatcatctctatgaacctctatgaatacacacaagcacaccacaatcctatgaatacctctttgttgatggatatatcgctatcactgaaaaataattagctaaacccagtggactggttctaccacaaggaacttgccaagttgagctacgctcacctcgcctccacctcaccaattaatcttacgtggcaccttgcagcttatgcttggatgttttatagtacttgctctaaaaggtttgttacgtactccctctgccgcagaagaacatcaccttttgaccaatcaaactaaggtatacacatttaattggaattttagaaaaaaaaaggaatcgataaggacgtcagtggtatttctcctcactactaatttgtaggagaatcgttataaataaatttgtctggggtggaaggaatagaacaatagggattttgttttagttggtgagaaaagctctgtcattataaggtggcataggcattaagagactatgtgactaagtggacaaattaaataagatatattatgattgtttgagataagagagtaggtactcaattgctatattttgctatattgtaagacaacttttaaatgttagaaattgctatatttgaaatgaagggagaatgtttttttattaacgatcttttttacgtaaaaaacactacggtcgttatttaaaaatatctattttgcaaaacctatttacaaatggaccatggtttatttagctgaagatgaggcttgataattaatgctttaaaaataagtatatttcaaacaaagtacacttacataaaaactccttttaataactccagcataaatagatgaaaatatgataattttaaattaaataactccacatattgaattaagaatgtaatggaatcgagctaatcctactcaaaatctctcgaaatttctaagttgatatatttataaggatgggttaaaaaggacgcgccaaatggcgcgctaattttctagtgctttctgtttggaaatagtatttcttcttagctgtcagttgacggttactacgtccatgtgctatgataatcacagagtatgtattattaatttggttgctactagcagaatagaaggattgctaggtaaaaaaaaagtaaagtgcacggacggtccctaaacttacgtgggtgtgttacttaggtccctaaactctcaaaatgaatttttgggtccctcaacttgtctcgggtgtcatataagtctaaacgggttcaacccactctgtgtgttgatgtggcatgtcatgatggcgcctacgtgttagcagaaactatatgtcagccacatatagaaaaaaaaattaagaacatgttttttccctcctcttttttcatttatttttcaaaattaaaaatatcattttctcctctctctctctctcctcttttcttaaattttattttcttcatatgagtgacatgtggatcccactgacatgtaatcgtcaccgtggcatgtcacgtcatctcacagagcgggttgaagctcgtttggacctatatgacactcatgataagtttggagactcaaaaatacatttcgaaagtttagggatctagatgacacatccgtacaagtttaagaaccgcccgtgcaattcactcaaaaaaaaagaatagaaggattggttctctttattttgttaggtgccattggaattaagtttcctgatatcactgttaatcccgttcttatcagatgatatgtcaggatgacgagaattcctgtatatagcaatggttgatgagcaatgattacgttcaaactatttcagaattgattttgtggtaatttgaggtttgtagaaatcatacaagtaaagcaaaaagttctatctgttgttcctcctggttgaacagagattatggaatacttggtttccctttcaatgatcaacccacttaaccatgaatagttggcagtagtctgattgttcaatctcgaaaaagtgttcttctatctgatttaaaattctgagcaaatggtgaggaaaaaaatgttttttctcaaagggttaatataacaaaaaaaatgaatttctatattcttgtcacaacgtacggataatttgctagcatatactccctctgttttcaaatatttgacgccgttgaattttttaaacatgtctgaccgatcatcttttttcctatcatttgattcattgttaaatatacttttatgtatatatatagttttacatatttcacgaaagattttaaataagacgaacagttcatgtactaaaaaatcaacggtatcaaatatttagaaacggagggagtacataataataacccaagtcactttgcaccaaacctgacttttttggtaactgggagtttagatatggtaagattaagtggcaatttgatttttagtcttgtttggtaagggtatgtacaaccgtctttattagtggctttctctattaacatgcaaataaacttggtgatgtgcaagaaagggaaaaaagagaaaaatagttgttacgcacgataacggctcagagtcgactcttagtatttattagaaaatattttgttgcatggggttgaaagaaaggaaagaattgggaaaaaatatttttttcgtaaaatatatatcgagaggcctctcgatctggtcctatcgcgtgacgtatccagggacatcatgcacgggagaagtctactacatgcatgttttttaatagatatgtatgtcttttttctcttcaaacaaagttttctctcaaattacttatccgatctacaatccgattataccattgtgttcgttataattaaatcttcagaacaagatctgacatgattacattacgatgaaaaaaaattatagttgtaaattacttttattacatatataagttactgttatcatatacataaaagtatacttttagatttgactaaattacttcttagatatataaaagtaaattttataaagtctaaaagtaatttacatatattataaaaataacttaaaacaaaacggaagtaactttgtcacggcattaaaagtaaattcgttgtaggaataaaaatatgactttatctagaaattaaatttaatcagcataaatcaacacacgtaagtttaacaatttttaaaagtaacttcaatgttaattggaagtaacttttgtatggttaagaagtaactctctataaatctgtttaatcaccgattgtttttttcctttcatttttgcttttcatgtagaatgagaaaagaagataaaaccttcgatggattgtaaataacattgatggaataactaatgagaattagttaggtataagatgtaatagttacttcctgataacctttctaatatgtaataaattacttttaaattaataaaatatttgaatatattcaatatgaatcttgatttgttacatattttgagtggagtacaatgatgcaaatagatcttaaaaatgatatgtgatttaaaagatataagttattaaagagattaaaaatatatatactattgtatttttcaagttgaaaggagacactagatggatcacaaaccagctacccgtcacgtccaacgaaaaaaaggcatgtattagagttactttcattttattataagttattttataatatatgtaaattacttttaggctttgttgaatttacttttatatgtctaagaagtaatttagtgaaatataaaagtaatttagatatattataaaagtaatttataatttttcatcaaaatataattatgtgagatcttgttataaagatttaattgttacaaacacaacggtgtaatcggatagtagatcggatgagtagtgtaagagaaaattttatttgaagtatagatggatagggtctctcatagatggagtgatacctagtttagacaaaccagctatcattagctgtctagtcacgtcctatttttttatattaatggttagagaccatattgacttttaaatggtacagttttgtacatacgctaaacgctaaaggtagtgggaactgaaagtagatgttaaatgaaaatacatccgtttccgtttcgttctgttctgttctgttgtttctgcccgaggtcggcgaggcaggcagaacacgcaagacgcaagacgccgatccatgggggcagagaacacgcaagacgcaacgcctaaccgcatcctttaaccatgtatagtactagttgcgcttaagagggtagacgtacgatcgactgcgtctcgttcgatcgctcaccggccgcgcgtcgacttgggcttcgctccggtaattagttgaaaaaccattcggccggctggtcaccgtacttaatttgctgatccattaattcttttttacctttaatttggacgcagatcgatgatgccggccgtcgactagccgcgcgcggccggccagaaaccaccaggcgccagccaattaaccctggtgaggctggcttctccctcgaaaccattgcatattcatcgatcgctagctcttctgttcaccacaataacgtatattcctcttcaagcctaaacgccgcccgccaaaagcccctgtgctgctgctgtgccgccatctcaccggatctcgacgccgttgctggagctccacgtacgagcctggcttctccgccgaaccacgtgacggggtaagcagcaggctcatccaccctactcctccctcccttccttccttccttcttacccagttcgcgagctaccaagaggtaaaaggtaaaacaatgtgaacgaaaccgttgatatatcataactgatggtattggagtaattatctaataaaacatgggtattttgggttaatcaaataccgaattgttcagcattatctggtagaaaaaattgtcaatcttccgaggctgtctccaatacattttttatcgttcggtggagaaaaatgtaaatcttcccgtacattttgtttcccaaataaattttatcattttctaacatttgaatgtatttttgtgtagttttcatgcatcacaattttatcattttgtaatatttgaatgtattttttgggtagttttcatgcatcacaagtctaaaattaagtggaaatgcgtgtttgtatatataaagtagcatatatacatggcagctaaattagcccctaaattttagcatgcgtacatgcatgcatgatgattaagttagaaaccataatggccaaattagcccctaacttttagcatgcttaactccagtcaacgcaagttaattattagctagcaagttcaaatctttggaacgaagatgggagaataggatctaacattgttttttctttttattactgtagaattaaagagaaaacatctttttaaaaagaatttcctcaatagtagcgattgcactttgatcaacacaataataaaaaaagacactttttttttgcgccaaacaacatggctgcatgataaaaacacaaatccattccttcttcacttaccatcgtatgttgtactttgatctttataagactttgtatctatgttcatgttcattggggggagaatatgtaaatatagcgtattgacgatgaattacattttaacctgcaaaccagtgatttaccgaggttacatgttctttgtgataaaatataaatcttaaaataaccgcgcaaacattcagacatattttatcctatggtatcattaggaacataatatcaaccttaaaaaaactacaatcaagttcttagggagaaaatgtaaatctaaaagaatacgtaaatatcgtaacggaggattaccggcgatcatgttcttaggaaaagagtgtaaatctaaaaagagaacacgtaaataaagtatggaaaatcatcgaacatattggagatgaggtacccttctctatcgcttagaaaaattatttttttacccttattacctaattacatgtgtcgatattaaatatcttttgagtgatacttttattatgtacagttagattttaattttgattttaatttttttaatgcaaacaccgtaaaatctctcttatacctagtgtttaagcctctgttagcacagtcgttgtcgctatggccgccaccgtgctcatctgccactagtacaataatgatttttccgtgtggtcagaatcggttttcgcgtgcggatctttcacatgtctggaacaaggtgtctgcgaaaatccaattttttcgtgcgagtgatgcacccgcacgggaaaataaaaaatcgaaacaaaataaatcaaaagccgctctcgaaccctaatctagcctctgtcaccaccgtcatcatcctcgcggtcgccggcgacgaatccggcctcctcgcggtggcaggcgacggatccggtctccccgtggtggctggcgaggcggcgatggttctggcttccccgcagtcaccggcgacggatccggcctccctgcggtggcaggcgacggatccggcctccctgcggtggttggagatggatccgctccgccgccaccaccctagccacactcgctgatgtcgccgctgcctccgccgctctaaccgatgccgccgcctccgccgccctagccgaagccgccgccgtcgccgggattgggagattggaggagggggaggaggaggggagagggagagggagagggagatgggagtgcgggagtgacggatctgagagggagagtgtgtgggacagtgggagtgggcgtcgccgtcgattaaaagggggtgggctatttttgtgtgcgggtcacttaacaggtcagcacgcgctgatctttccgtgtggtcattttaaagagccgcacgtgaaaatggagcacgatttttgcagacgcgaacacttacgatccgtctgcaatctaaaattagtcagtgtgctctgcatttcaccggggcaaatatcctttgctccgctcaacgctggcgacctcaaaccgctgcccctccacgtgtctatagaggtctttttttttatagaggatgtctttagaggtcttaaacaaatgtctttttatttttgtctgaaaggaattaaaatgttcgtttacgctttcagccgttatataggaagccgtcgtttagcttattttaagcataagcgaaacagcatattttaaaaaaaataatttatgaataaaatttttatatatgtgttcttagcgatctaaaagcaaaggctgaaaaataaactttgatgaaaaaacctcaaaatcaacttcaaatttaaggttgaaaatttaaattttggctgataagcataagcataaacgaaaagacgagactgatagggttaacctccaaatgcattaataggttccgctttcacttgggaggacacgtaaatcatctagtatatgccaacagggttaaagccctgtttcttgcagcttggaattattataatccagattattgggagtaagctgaaagaaacagacaacttattgaagtagcttattataatctggagcccagcttattataatctgataagcttatttaggtaagctttttccagattattgggtgaaaaattacccaccatgccaccccactccctctttagactttgccccaataatctaggctctaataatctaggaaagaaacaactaaccgcttattatactacagattataacaatctagtttataataatctgactcaataatttagattataataatcccaaactgaaagaaatagggcctaaataaacgtaaaatctaatcggcgcatgcgcggctgctttcactgtaactgttacgaggaaacctacatgtaataatttttctattttttaattcataaaaaatgatactattattgaagctcaccaatcattttaaatttcatgttctatgtgctcatgtgtggtggcatttttatttgggtgcaagacgggaccatcacataggaaaaatgcgccctaactgttgctagttaaaactaattagtatacgcacgcgtcggcctatatagtcgtgtccttaaataaatcataacccagtacacagctgaaaaatgaagatctcttttccaaacgatatttcttaaaaataataagcttacctcctctatactctagtggtgatactaatcaatttgctcttttgcactttacagcaaggcaaacaggtagctactattcaagatggctgcccagcatgatatggtgtcaaagtttggtgctgctgccattgtggttatgctcatgcttgtcgtccctaacagcggcagcggcgaagatgcagggcatgacaaggatcaattggctcctatgtcaagcgaagcagaatttggattttctctcccaattgttcacgggcgtccaccggcacccggtatggatgacgagaagtttgtgactccatttagaatttatgaggatgttgtctatcttgctgaaatggagattggtgagcggcaacagaagcaatacctcctgatcgacacaggcagctctttggtctggacacagtgcgacgaatgcccgcattgtcacattggcgatgtgccaccatatggaagatcccaatctcgaacattccaggaagtgagctgtggtgatgatgatgacaatgataaagaagaagcaattgctagttactgtccagcaaaaccgccgggatatatcactttgtgcgtcaatgggaggtgtatgttcaaggcgctatataatttgaccgggcaaggcgagactgttcaaggatacatgtcaatggatacatttcacttcattgatgacaggagatttgactaccaagctaagttccggatggtttttgggtgtgcacaccaagagaatatcgttcttacagctgtcaaggaatgcactggcatattgggattaggtatgggcgatgcatcgtttttgaggcagaccggaataactaagttctcgtactgtgttccacctcggatgccaggttactcatataggagacacagttggctccgttttggctcacatgcacagatttcggggaagaaggttccactggtgatgcggtggggtaagtactatttgccgctaacagccatcacttacacatacaatgagcttatgtctcctgtgcctattattgcctataagagccaagaagactatctacacatgatggtagatacaggaacctccttgctaagtctcccgacctctttgcacgatgatctgatcaaagaaatggaggcaataattaagtcagaaaatattatggaaggggccactagatggcccaagcactgttataaacgcaccatggatgaagtcaaggacattaccgtcacacttagttttgatggaggtttggatatagaactcttcacatccgcactcttcataaaaacagaaactacaaaaggacctgctgtctgcttagcggtgaatcgtgttgacgattcgtctaaggcaatcctaggtatgtttgcccagaccaacatcaatgttgggtatgacttgctaagtcgtgagatagccatggatccgattcgttgtgcctgataaagtacgcagcttgttaaattgattaggagcatggcgttattggacgcattgattcatgcgtggttgttttagtttattggttatgttaccaatttgcatcttcacggctgtcttagtttactattgatgactgctgaaatggacctgctacttcgttgagttcgtttactattggtaactgttgtaatgaacctgctatttcatttgagttagtttactattggtaactgttgtaatgaacctgctacctcatttgagtgctgtaatggacatgctacttcattaagtactacaatattattttttatctgtctagacttgtctacatttatgttccactctaccgtaattaacaatcaccacttctccttcgtcgtttgtttacatgcagcaagtaaataaaattctgattgtctgctactccttcaatgaaaaatctcaaaaattttgtgattctctcagggcgacattttggaaaagacaatccttataaacccatttctttgtaagtacgttgctgtcagattacaatagtgcataaaccacctttcaggatacaggctaagggaaaacttatttgaaccaaaaaaatcgaatggcctcagtagcctagtacaaatatatctatatcacgcacacaacatacacatactcgggctgtgcagcccacagcatctgagaaggaaatccttacaactgcaacattggaaaaattttactacgcatccttcgaatgcttgggcatatgttcttgattcggcaaaggcgctgtcaattcaaaatagtcatcaaacacgctgtatccagacacgctgttggagcatgctgcatgcgctgaatgcttgcagttgagttcccaaattgggaaaaggttgtctatacaagagctttaactgcatcacaaaatatatggtttattaagcaagtcgataagaacccaaactatcagaatggtcacaatctaagctgtaagttcagtaaccacgttccaacaaaagatagctggcaaatattagttttctagcctttcaagcaaagctgacatcttaacagctgacagaatatgagattgtactagatgcaatgaaaagtgagagatactcacaatctgttcatgcactcctctttttagcaactctaacttggaggatcagatggacatctcgcttgaatatggacctcaattcttcattggcttcaataccaattctcctgaaacagttgtcacaaatgagataacgcattaatagtttaccaatcatgcacaagaataactgtcggaacgagattgattggagaagtgaactgcaaatgcactccataaaaggaaccaccatctgccagggtgaccagttttttctttttttaagatggtggagagcagtttcttcataagagaatgtgttacccgattttggagccatttttcccaacaagaatctgtcgttggctttgctttggtgcaatgaagtgttgttccaccctaagagaaccatcttttagctccttccagtccatcagacgatggtcaattacataaggaatttcctgcatacatttacccgaacataccatagcagacaattccatcagaatcaagagaaaattaacaatatgccactccatagaggtggctttaacaatatgccacccaataggatgtccttataaagatgccactccatagagcatacccctaaataaaatgccacttttggctgtttagaggttttgattactttgtttatattattttatcagactcctcacgcgaaatgaccgaaatgcccctttcatatcgtttagatccagagtcagattctttctcttctctctctcgatacttctctctcggccggcccgggcatgcggggttgtcgccgccggttccacgccgcccctccggtcaccccctccctgttatggtcacccgtccgtgccccccaccaggcgtcggcgtgcacccggcccagcgtcgcctccccgccgcccccctctgctaggtacaagtcgctgcccccccccccctctcaccacctcgccgccctcccttcccccactcccgccgccccgccgctccccctggtaggtagaagtcgccgccctcccttcccccactcccgccgctcctctgcctccaatgtaacctcggcctctttctcctctcagacagtaaatagaaggttgacaacatgagctcgaaggatttgtcctcgaggtaaaatctttcatatcgctgtacattttatattttcatcgagttagatttctaactcgcttttttctcttgtcgattcaaatcgtttaggttggattcagaactgtctagagtagagatgcagttggttgaatatgggacaagttccatttcagcagtttcagttctagcttcagaatgtctagatagttgtacaagtgtgcctttatgccttgagtatggggtgatttcagaaccagcagctccaactgttggtgtagaacagcaaccttttcagtatgttgattgggataacttggagatagatgaaacgttagatgatgagggaaggattcaggtcatgaatgatgaccaattatacgtactcctaggcttgagggatgaggaaagggcaaaaaaatcggcgcatgctgctggagcgaatggttcaagtaatgctgctggagctgatgattcaagtaatgctgctgaagctgctggagtcactgacggcatcgagggtgcagcaattcctgttgatgattcagtaccgggtgagcttgttataagctatgacaagaataacccttgtatggatcgatacactaagtacccctcaatgaaggaattcagattggctgtaagacagtttgctatcaagaaggaatttgagctaggcaaagtgaaaactgacccggagaggtatagggtaaaatgcgctattgaaggatgtgcatggagtcttgttgggcgtaggcagaatgataaaactataatggtactaacccaaaacataatttttttgacattacttctagcgtgcctagaattgtttgcatggttttaatggattacctttcattgctattgcaggtcacagttcataacaaagaccatacttgtacatctagcatgaggataagaactactacaccgtcacaaggttgggttgctgatagggctgttgatatccttaagactacaccaaacatgtcttgcatagacttgatgaaaaggttgcaggatgatcacaaggtaactctctcttaccatacagtttggcatggaatggagaaagcaaagaaagaattgtatggatgttgggaggaaagttttcaattgttgtatagttggaaggaagaggtccttaagagatcacctggaagtgttatagaaattgacatcaagatagttgatgggagggcatactttcataggttttttgctgcatttagtccttgcatcaaggggtttgtggctggttgtagaccataccttagtgtagatgctacccatttaaatggcaagtggcatggttttttgccatcagctacagcaatagatgggcataattgaatgtatccagttgcatttgggtttatagactccgagaccgaggacaactgggtttggttcatgactcagcttcatagggcaataggagacctagaacctcttgctatttgttcagatgcatgtaaggggttagagaatgcagtcaataaggtgttccctgctgctgaacgaagggaatgtttttggcatcttacgcaaaaattttctaagaagttccatggtgagacttttggtaatatgtaccctgcagcaagagcctatagggaagaggtgttccagaagcacatgttccctattattaatggaactcctgaagtttggaaatatttgacaatatatcataacctaaagtggatgaggtgtggcttcaaccccgcaattaagtgtgattatattacaaataatattgcagaggttttcaatgcatggatttctgatatcaaggatttgccaattgttgacctagttgacaagcttagagagaaggtgatggttctatgggataagagaaggagaattggagaaaggcttaatggtaagattctaccagctgtaatgcaccaattgaaggcaagaacaagaggattaggccacttgaaagttatcacagctagcttacatactgcagaggtgcatgactatgtcaaagaatttggaagacacgttgtttcaatagtggcaaacacatgcacatgtgaggagtggcaacacaccgggcagccctgtgggcatccattggcctttttaacaactcagagaaatgttgacttggaagggtatgttgatatggtttactcagtggagaaattcagggctgcatatgagagagataccggcaatgccagacaagtcacattggccaaaggtgaaaatgcctttcgatttgggcgcaccactagagaagaggagtgttgggagacaggaaattgaggatcaaaggatgccttgagactggtagcaagagtagtgcaaagagtgatggcaagaacaagaaaatcataagaggtccagttacatgcaaaagatgtggtgagaaaggtcataggcaagctagctataagtgcccactgaatggtacaaaaaaaaggtattaatatttctgtttttttcactttacatccttttaaatttgtggtacttcatcctatatgtataaatatatgcaggaaaaggaagcctaggaaaaacaacaaaaagaaccttccacctgaaccttccacaccacaaagaacaaccaatgaagctacaataatgcaagaaagcccgggaatggttacaaggaggtaagttgatggtcaaatgacaagttagaattattctccttgctgtgcatgcttcaaatcaattgtgtgtgtaacttggcttttgggtatacatgcataggcgacttgcaatgcttttgggagtgaccagtacttctggagtggaaggggctagagagccgagagagatggctagtacttctgcagaccatccaagaaaaaatgactcccaagaaaatgaagtcaacctaatgtattttagttgtcaaatgtgaactactgtaatgtatttgtcaagctactgaactactgaatttgttaggcttgtgaactgtatttcttttgggtctctttgatgcttcatgtaaccaatatgctatgtgctatgtgctggaatgctatgtgctatgtgctgcaatactatgcctatatgtgctgctggagacctctgtgctgctgtgtgcttgctgcaatttatttgtttatgtgctgcaaatgcttcactgttgtgtgcgctgcaatttgagggagcacagatcgtgctatggtgtatgggctgcaaatgctatactgatgtgtgctgcaaatgctttactattgtgtgctaaatgcacaatttatttgtatggtggacttctgtgtgctaaacgaggtggtaactgatttgcaatttatgctgtgtggtagtaactgatttgtatttgatgctgctgtaatttgagggagaaatctgacccgaacattgcaaaaaggagctaggggtacttttgtcatttcgcgtgtcatttctgtcaaaaaacctctaaacagattaaggggtatgctctatggagtggcatctttataaggacatccaatagggtggcatattgttaattttctctcagaatcaaatagtaccaattacacagtagcaatatgtccaagaattaggccctgttctatactccaactataaacttcaacttcctcattttccgttagcacgcttcccaaactactaaacggtgtatttcttacaaaaaatttctatatagaagttgtttaaaaaatcaaataaatcaatttttcaagtttacaataattaatatttaattaatcatgtgctaatgagttttctcgttttgcgtgcactggaaatatttttccctgggcatgaaacaaacgaagccttacttggtggatgtgatccagcatcttctcccgcacaacctccaatgagatggttttcatgacctcttcagtcattgtagttggttcctcatcccaaggtcttctcactgcctacatagcacatagacgtgatttaaatattgatcaaaagaaaccaagttcgacgtcacagcacgcaacagagataacatccattgaatagtttataaactaaaatacctgttccatcaagaactgtacaaggtctttgacccctttgccttttagtccagataccatgaagtacctaacattccaagaaattgttttatgaggcagatgaaatggtaggaaggcaatgcaagtacacctgcagactaaggggaacctttcatatgcaggaagatcttcaaattcctttgcaactttaagcaagtcttttttgtcttccacaaggtcgaccttattcatgcataatatacgcttctgatttgggtttacctcagcacccaaccgtttgattaacttgacaactcgcgtgtcagggctgcatacacgaagaaattgattagaggtgtgcttatcatggtctctacataaaataagaactgcatttcattgattgacagacaatactgaggaaaggaaggataaaaataaatatttgccaaggcttacgttttaagatgcctgttgacatcaaacaagactattaataaatcataaaggttaattgagctccaggcactctctacacgaacagtgacatccctatgaggtaatccatggtggcctaacatgagccctggggtgtcaaaaaagcactgcagtgcagagaatattatcagtgaaaacaactaaaagttaattaaagaaaaaattgtagatgacacccataggcaccaatttttgtagcagctccttaattacgagctatgcatttgacattttttacagacaaacccaatcagcacagttttttaatacgaagtccattactttgaattatatatctatgagatagatacaatcaggccatggggcacaatgtgcttgcactgactgatttgaacatctctcttaatgtaatcagtaatggtagaaataaatcacaatgtactctgttttatgatatgtaatatattcatcattgtccagaattcagtatttgcaaatgaaatacagacaagcatcgttagacaggatttttagaaatccataacggtaccatcaaaaattgaaaatatgaattcacttcatactagcacaagcagatattggtaacagaacatactatttgagttatcccttttgtcagcacgcccaaaatttcatgagttgtagtatttgtcttgcgggacactgcagccacttttgttccaacctgtagcaaaaatataaatatggaacattaggctccactacaaccagttctcctccctttttttgttaagaaatggcagggttgccatttgatttagttaatgaggaaaggttccaaaattataaggaaaaagaccagggcctaaacaaaaggcatagtttacatttgtcgtctttgccactattaactatttagtctctacaaatgatgctaagccagacgcatacaacagccagctggtaagtctacctgcttactaaactatacttaacccaaagaagccattatatcaacagaattccaaaaaatgaactccaatcagacccagaaaatggtatactctatatttattgatgtttaggtattgtagtaataaaaacccaaatctgcaattgggcaactgcacaattctgttaaatttttcatacagaacaggataccattgaggcaacgatttgcaacaactcatggccatgcccagaccttctgaaataattcaacatcaagctagaggaacattggtggtctcagggaacataatcgaaattccttattatttaagcctcactggaaacagtcccaaaaaaatggttcaggatgtaataactagcgtaggtaatcttaacctaggcaggctagcttacacagttatttctgtctctgacaacacacaggttagcttttccagttttttttgtctctgacaacacaactagttgacctaaactacagcttgattagatcaggagcatctgtatttgtagtgcagaatggtcgttcctgttgtatgttgattaatctaaacataagtttagcaaagttagaatttttcacctggataaattagccaaataaccatggttgcagagatcagtgagagaatgtgagtttaagaaggatgtctagaaattaacaacactaagttacaaaagcaacacaatttctgtaagcattttagcaaacatccatgatacaaacaaatatagggtgctctaaggaatgctacaacaaaataaccatttccatgtcacaaaattttcaatgctgtgacatgaaaatacgtaccatggtgtttgttaaacctacaaagaaatataggattatactatgatcactgtaaagtgtcaaaacacacaactgcacttcaaactcctaatgctcctctaagaaatgttacaacgagctaaaccaaaccatttccatgtcacaagatttttgttctttcaatgcgtgaacacacgtaccatggtgtttgtgagcgaggacttgccggcgttgggggcgccgacgatgccgacggacagcgacatctggtcctcctccctgacctcgccagggcccaagtcgtcgtcgggcggctcgagcgcggcctcgagcagggccagcgcaacctcccgcgaccgctcctcctccaccgcatcgtccaccccacccctctccttcccgaacagcgcctcgtcggcgcgcgcgcggagggaggggtcgaaccggagcttccggagcgcggagaccgggttgcgcgcctgctgcggcggcggcggcggcgtcggccccgagggcggcagcgcgaactccgagctgtcgaagtcggcgtccggggcggcggcggagtcggagtccgatgaggaggcggcggcggaggcggaggaagaggaggccgaggcggtggagaggacgcggagcgccgtcgggatggggctgagggttagggtgcggagcgggcggagggccccgacgaagcggcgcatggcggcgacaagccgcggccggcggcggcggcggcggagggtttaaggcggggggggggtattttggggagagaaatgcggagagggaggaagcgaggaggtttgcaggcgtgtgaaagggggaggaggcctttttgggccgtccggccctccaagttggcccggttggtctgttgactagtatgggcccatgaatggttgcctctacatgtacatgtactagtagcttgttggttttcaagaacacaaaaggcacaccctatttcgtggatgtgactcctttgtaataacgaacaaatttgacatatatttttggatggataaattgaagtcatttatatgaaaatcatacaaattattgcgttccatatctggagtagtcatttatatttgtcgacaaattttctcctagaaatttgacagatgtaattatagtacaagcgtgatgtaatttatatataacttgtatgtaactttcaaaaatctctaactaagatgctatttcggtgaaatggaggtcgtgggaacgaatcatctcatatatgtgcgcgaaatgacttttttccttcacttgcacaaatattgaaacaatttaatggttcaaaattatgggcaagttacattgtagttacattcaagttacagtgtaattacactacgattgtactataattacatttgttaaatttttagaagaaaatttgtcgacaaatatatagcaaaattgtttagtcccaacaaaattatatcagttttagatttggagccctgccaaaaacctcctaaatgtccataagttagtatccgtgttcaccaattgtaggagtacactgtgaaaaaaccgcgtgaacgatttttccttgtatctttcagtagatcatgttcatgcaccgccgaggatacctatgcgtgtgtggtagtgtgtgttcgtttccgcatcctcctgtacaagagaggaaaagaaaacagagaagcatcctgttctgtcctgcaacccattggacggtgcagggccgcaggggcctcatgccatggttgcgttctcctcatgctttcgttctctgcatctttgccttttgatctcagcatggtccagtttaatcccttttgcatatattctctgccagttaaacaattctgcagggaagaacaacgcggcaaatcaaaagaatgtttctgttacttcagcattgttctgtttaaaacagagaatcaaatcaaaccatacattcagtggcaacagtttaaactatcagtgtcaggtttcagaggtttctggaataaaattcaggtttcaggtgagccacacaagcggtatatatttctgaaacaaattgcagatttcatcaggaataagaagctacagttttgcatttctgaaagactagagaaaaaggagacaacgctggggattatttgattcttcactgaacaagtgaacaaacttcacagagctcttgtcatacaaaaaggatttaccctagctgagaatctgtacattgacattgactccaaaaggaggtcatcatttttatacaaagcttttggacttgaagagaaaatctgttcaaggaccactacctcgactaacccatttgattcttgttcacttcatttggtgctatactggtggaagcacaccatttgcccaagaatcagatttgtcctgaacttttgacttgtgtactcatgtcagtaaactctaaactttcggtcgtattcaggccatctttttctccaattctggttgatggagattctacaaaagctggttgcagtaatgctatgacaacatcaaaccctgtcagctacaaactaagctcagggtgtctttttcagagacaatattcaaaaatttgcagctcttggttgctctgaagatctcatgcccatatggcaagcagagacatcatcccagcgccgaggaagagggcgaggtatactgccagctgaagctttgtgtttgtttgaagcttcggattgttgaaatctgcagcgaggagatcgaccagggacatgtagatcagtatccctgctgcagcagagttgaagactccctcgacgacaagtgcggtcgagctgtgcttgctatagctggatgagattgcgatccccagtgcaatgcccaccggagcagtgagggagaagaaagtcgccatgatcactgttgctttcgccttaaaatttgcctgtgtaagaaaatgtgacacaaagtatgtcaaattattgtctcatacgagaaactttaaagtctgtccctttttcatttttatggaaagtagcttatggtggaatggattttcacctaattgaatgaactaaagtaaactgctgaaattgtggttcttctcagacatagtaatatctgcgtggatattgatcagcactggatagtggatacagtatactgataacaattgaaaatggttgagaatcctggccagtgttacatgacaaaccagtctcaacccatttctgaaaacgcggtatttttaggtatatgctaaatctgaagtccagttttaaaagcatctgggaaaacagaagggcaaaaaatgacgcagcaattcctgtttgtgtatcctgaaaaaaaaaactggcattgagaagctgggagcttgtttgagcttgtcagttagtgaaggatttctgaaccatagtggaacggaatcaattattgatggtcctacttcaagtttgctttgtacagtatagtcgtgtagctagtgataagttctatcatttgagctataaatatctctgtctatactctatatgtcgtttttcgcacgcttttgctaatggagcatgcccttctgtttctgtcatgagcccaggtgccttttacctgattttcacgtgtagatattttatcaatttgccatgtaacaatgtaggtaaacaagcgcacagctatagtttcaacccttctatgtcgaattgtcgattatcttataccgcggtatgaatgtaatgtgagatgttcatgttaatcatggctgtaaaatgttattgtgatatacctgaacaatgcagccaccaaggccaatgccttcaaagaactggtggaagctgagggctccgacgagtggcctgattgacgacggcctcagtgatgcgcctagcgaaaccccgatgatcaccgagtgcaccaggattcccagctccagaacctgcacaatcacaattcttttgtcagttattcttcgaaaag

SEQ ID NO: 42952 - DNA, 824 bp, Oryza sativa
atccaattaaattacagcttaattccaacaaaagaatccaccatccaattacaccaacaccattcatcagaagtagttaaccaccagattttttggggcctatggcaaatacagttccaaatacttcaacaagagccagcaaaaaaaaaaagaaataaaaaagaaagaaataaaagaagagaagcgaagactttgacttttcagaactgcgtggtgtttgacccggacgccccggcgccgtagctgctccggcgcggcggcggccgccggatcgacacgagcccctccgacacgacgctcccgtcgtcccactgccggccgagcagccccgtggccgtgaccgccgcctcgtcgtcctccccgcgcatcgcccggagcgtccgccgcgccatgtcccggcccacgccgccggcgccctcggccaccggcgtgagcgcggcctcgacgccggcggcgcgcgcgagccctcggaacctcaggctcccccggctcatcccgtacagcgacgagatgcagtactcctcctccgcgctccccggcgcggcggagccgctgctcatcagcctcaccacggcggccaccgcgccgccgtccatcagcgcggtcctcccgtccgggcagccggcgaggttcgcgaggatcatcacggcgatcctgcggagggcggcggcgtcggcctcgttggcgcggtcgtccctcgccgcctccgccgcggcgagcagcgtccgcaccacccccggcgtgcgcgcgatcttggaccggttcatcccggagagggagacgtggtacagcgccatgccggcctcgcggcgggcgaggtgggc

SEQ ID NO: 42953 - DNA, 713 bp, Oryza sativa
tatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcagggggaactacatttatcttcctgcttttgttcccttcttaccgtgtcctcctttttattgggcttaaccatcgcagtattggtactttcttctcaatccacccatccagtcaatccccaattatataggtgtaggccgtgctttattcctaatctgtacaaccaactattctttaattattagggaagggcatgttccattaacaagcatgatcaagccttaaaaag

SEQ ID NO: 42954 - DNA, 750 bp, Oryza sativa
ttgagagattttaaggcgtgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttca

SEQ ID NO: 42955 - DNA, 13090 bp, Oryza sativa
  unsure (1)..(13090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctgggctttagtcatcacatatggagcatgtggagcagtgcatgttgaattcccatcatccttcaagtgtaaatttttccttatgcccatatcttctaaatcgagcctcgcagtaacagagtcctttgacttgcctgcgatgtcgagaaatgtaccaagaagggcctcacatatatttttctcgatatgcataacatcaagattgtgtcgtagctttaaattagaccaatatggcaaatcccacagagtcgacctgcgcttccagcattgaccttcttctaccctctttctctttttgttattaggatggttcccaggtcttacatgttccaccctcgccaattgctgcatcaactcatcctgagtaaattcttccggttgcgcacgttcttcagtctgaccattaaaatctttctttctcctccaaatatggtccactggaagaaaacggcgatggccaatgtagcaaatcttgttcctaagtcttttgtagcaaggatttttatcacaacaaacgcaagcatagtagcctctagttactctacctgaaagtgtgctcaatgctggataatcatgaatgcaccatatgattgcagcgtgaagatcaaattctttgccggtcaatgcatccaaagtagggacaccactccaaagatttaacaattcttcaaccagtggctgcaggaagagatccatatcctttccagggcatgtcggaccaagaataagtaggcacatcatgaagttggattgctccatacattgccacggaggaaagttgtaagggataagaaatactggccacatgctatatgaggagctcatcttcccaaatggattaaacccatcagtagcgaggccaagtcggacattccgtgcatcatttgcaaaccattcatactttctatcaaaatctttccatgcctcaccatcagcaggatggctaagctcattgtccactggtttcctcttcaacttgtgccattgtgcctcagctgaaagttctttcgatccaaacatcctcttcaaccttggaatcaaaggaaaatgccttagaaccttttctggaatcttccttcggctatctgcatccttccatcttgaagcaccacatattgggcatgcatcctttttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtcaaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgactttgttcttggtccatgattttgatctgggtacagatcctgtaccatacggtacatttgatcatcttctgggtcatccggaggctcattcgtctcaaattcaacattgcagctaacatcttcattcaaatgctcaacattgcagccaatatcttcattcaaatgctcaacatttccagtgacaatgaccaatggttctccatgatgtatccaccgagtgtatgtgttagacatcccgtacataagtaagtcatcctccacacgtcctttatattgatgtaaccgattcaaacacttacgacatgggcataatatcttctgactgccactcaaatttttacaaacaaagtccatgaactcagtgaccccctcccgatgctccttgctaaacaacttacaattcatccaagttctttccatctgttacatattgaaataagacaagcattgaatcaatgactgatcattgcccagactgctattttcctatttctatcacttcaaatctatggtttcagttcaaaatttaaaaccaaaacataagttcttctcatatgtacctttccttcctaattgaaggggatggggcagtctctggtcgacctcacccgccgtcggcagtgatcccaggctagagctcttgggggcttcctagcggttgagcccgtgaagcccagcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggatggggtggggcttgggatccagccggcggtgccgggctccagaagccgcgttgggcgaagggcgacggcgtcgagctccaacagccgggcgctacgttggggacagggtggggctacagcctgcggcgttgggctccagcgggagcaatgggaaagggcggcggcgtcgggtccagcaggcgcgatggggaaagggcagtggcggcggcgtcgggtccagcagccgcgatggggaaagggcagcggcgttggtctttgctagatgtgcgttgggattcttatgtctcccagcaatagtctacaagatgaaaagaatcaaagattagctcagtggtttgtctgttacctgggatgccagaggtcgtgtgttcgatccctcctcattgcaagaagcgctacatttttagtcttttcaagttaatattctaacttacacatgggtcccacatgtccacctagacatgctcacgtggctgtgccaaggtgttcttttttaaaaaacaaatgatttttaaattatgacaatcatatttattcacttttgtcatgaactattgtcacaaagaatgggaaaggcacatggtgacattttcttatgactaaattacaacttagtcacaaacgcttgtcatccaaagaaaaattgtcataaaggcatcactactgtgactaaaatgtgttttgtcatatgaattttgtcatagaaggccaaatttcttgtagtggcagggggcggcgactccgggttggcgaggctcgcgacgaggccgactttgccaggcgcggcatcgaggtagggcatcgggcagaggcggcctcggctttgtgcagccttgcagcgggatttgcgggcagggtggcgttgtcggcttggaagcgacgacctcggtctcgcatgctaggtacttgttgaaaagtccagaagggagagagaggaagaggagagaaaactgagattttgagggaaaattttggaataattacattgctccaaagcttgtgcaaattttactggagcttaatgtggtcatttactttatttggtgattttctgggatttttcgcatgtgtagattattttttgaaaattgaaagaagttttacgatttttatttcaatttgaacaaattttgatgttttctcctttttatttgagatgcagataactgattggttttttttgttctatatatatatatatatatatatatatatatatatatatatatatatatatatatatatatatatatacctaataaaaaaaatacgtaaggcttccttcattatttttggtccgtcgccgatttcccacacacgcatgcccccacccaaaaaaattcccaatcggaattcaatcatcttcacaatgggaattcaatgaaaccccccgaatcccaatcgcactaagaatcggatacgggacacaccttccaacatcggcacacccaaatcgcatgaacacaccgcaagaaaaattcaaccaatctttatccccaaaaaaatcatcccacatacatacatcacaaaactacacaccctcggccgtcgccgctgtcggcggatccatccgcggccgccaccgacgccgccactgccgacggatccatcgccgccggatctagggcgggagggaggcgacaggggaggagggagccaccgccggccatcagccgccgccaccgctgacggacccacctgccgacgccgccgacaccgccatcgccgccggatctggggcaggaaggagtcgagaggtgagaagggagccgccgccgccggatccacccgcggctaccgccgccgccgccaccaccggcggatctgccgcaggagggaggctagagggggtggagggaaccgccgccgacgccgcccctaccctcggatccgccgcaaccgccaccaaccggccgccgccgacccgagagggagaggaggagggggggcgccgccgccgtcgctttgagagaggggatcgggggcgccgctcgccggtcgctgctcagcgccaccgcagccgctcgggggaagaaggggggggcggcggcgccgccgtcgtcgctcggcgagggggggggagggacggggggaggggggaaatgaatcctagggttagggtttgggtatttttatttagcttaggattaatctggactgtccattcgatcggacggctccagctgctcccacgtcgggccgccggcctattgggccaccgaatggaggacgcaaaatagacttcaatggagaaagaaaacaggccagacacatagaatagacaaaagggagggaatataaacttttctatattcggcccaaacatagaaaggaggattttgatttttttttccaattaaataatttgttaaatgatttttgtattattaaaaattagcaattaagctctgataattccaataaattccaaagagcataactaatcatggagaatttaatcaaattaaatttaaccatgtcattttatttttcacacttgctttacttgtaaattgatttaattatacacctacctacttaaaaataccaaatattttaatgaattacataatgtaaattttttttaactttttctcaatttttttgttctgtacacttcccgttgcaacgcacgggcacctttgctagtatatatatatatatatatacacacacaaacacatatacacatgttttgtttttctcaattttaatttaaatatgcaaaaatgcaatgatgcgtagaaaatccaaaaaaaacaaccaaaataaattttcaccacaataaatataaatgaaaaatctcattatattgactttctaaggtttttgttttcacaatttgggtttgttacagcttggctgatcggcgagctatctaacgctaacgccttctctcctattctcccttaccctcgtctccagccttgctccctgctggtgctgtgggcatcgcgttgctactatcgtgaccagcgtaggacctccttgcatcccaaccaccggtgccaccatctcctactagcactgttgcctctcttcgcatcggctggtgtggctctgctcaaggtacggagcacgtgtgtgtcgtgaggaggaagcgcacacctacataatcgtcaatgaacaccgcatgagttaacttctgtggcaaactttattttttttatagtagtatataataagataagataaatcctacttcctccatttcaggttacaggacgttttaactttggttaaagttaaactacttcaagtttaactaaacttatagataaatataatatttataatatcaaattagttttattaaatcaatgattaaatatatttttataataaatttatcttgtgttgaaaatgttactcactccgtttcgaaatgtttgataccgttgatttttttagcacatgtttgactgttcgtcttattcaaaaaattttgtgaaatatataaaactatatgtatacataaaaatatatttaacaatgaatcaaatgatagaaaaataattaataattacttaatttttttaataagatgaatggttaaacatataataaaaagtcaatagtgtcaaacatttcgaaacggatggagtattatttttttaaagccagctcaaaacgtcttaaaacgaagggagtattctatccccccccccccccccccggcgcccccccccccccccctatcttgtacatgagttacctacatctcccgtgccccgcatcaattgtctcgtctacgagcggcaccggacgacaagcagggcggtccagtggcctcctctcgccgccgccgtcaacgactccttcccaatcccggccttctctctccctggtatgcacagggcacagcagcagtgccggcccggctctcaattctaattttgcccctgtctcctctttcctgcctccctcaaggttgctagctaatcgagattgatccaggaacggcccggggcggagaattttggagccatgggttttccttccagtttcacggcattggtgttcgccctactgcttaccttcctacagttttctaaggctgcaaacagccactatcttttcaacaaaaccagtgctttggaggcggccgacgtcaatggcaacaatagtgcggaaatcttggctgctccactgtacccggtgagtcatagttacctattggagattgctgttgggtctctgggcaaaactagacttgtcagcttcgacacagccgtcaacatggtatggctgcagtgttcagattattgtagggattgcaatccctcccaagttggtactagtactacgtattacaatgctagcatgtctataagctacaatcctctgtcttgcgatcacccactctgcggtgccggtgacaaccatgaccaacaagtattagctgagtgcatggatggcacatgtactttcaaagtcgattccttggacaataacggcggctgggtacaaggcattctagggtctgataggatatctatttcagaccatttcttcttcctttttgacaccaacatcatctttggttgtgccacggtagaccactcaaaatataccttagatcaatatggtagtagtggtgtggttggcctgggcctaggtaaatactcactcccacagcagatctctgttacgagattctcctactgcttgccatcctgggttaagaacgagcttttctcacctccctacgtgctatttgggagcaacgcggtgctgcagggcgatatgacaccgttcctcccagggtttcccaagtactacctcaagctcgaagggatctcctatggaattgttcgtcttgacatattcggcagcaatgccgctgccgccgaccaatatcatcagcaggcacaattttgtcgtggaccttaccttccagatgctcagttctatgccatgtcagtcgagtcggcaacatttccgctcatgctgccgagtcgcgcatacgagctgcttgaaaaggaatttgagcaagacaatcctcttcttatcaagtctcgcctccaacccatgaacacttgctacaaaggcagtgtcgacgatattgctgacaatgccactataacgctgcatttccatggtggcattgatttgcagttgtccaggaatgccacctttatggagatcacctccatgaatggcgaccaagaggagcgctatgtgtgccttatcgttgacaagacggtggatgggacagcggtactgggcttatcaccccaacttgaccacaacataggatttgatctggagaacaagcagatctcaatttatcgcaagatatgttagtttgtccccttattaattacattgttaattttcttctactagctaattagactcattgttactgtacttttctgcaagcaccattcatatctaatatatgcatgctgatgaaatgtaataatgactatgactctcgtagcttttatttttttattaatatcacatagcttgccaattcatgctgggcaagacatgcaggttgttacacgcattgttgcatattgtactacacaaacccatttgatactggatgaatttgatttgtgtggtgaattgagaaatccaaaaaaactctcacaatctttacagctgctgatgagcagtcaaaaacatacatagaagcttcttatgttttcaaccataaatcaagctcattatttcattaatagtaagaaggatatatatattctgtgtaactcaaaagcagcaaaacatatatggataaataatgcagcaacttatgcaggtctttgcaacatttatctgttaagtagagagacaagaaaaatattattgcgctactttatgcgtaagggcattgattatttgaactggaagcatgaacacagtgaaacactgggtttgttcatgcaagcaaaagacgtataccttaatttgctgcatggccacattcacatggaactcaaaacctcattcactgtgccgcatgaactccctgttcttcttcatcttctctagcaggtagggagccacctcattatcgaactgcctgatcgccctgtcatatatagcagcgatgatggccgctagtccgccaccaccggtgcatcgccgccggagcttctctatgaaggccatggccgcggtgtagccgtgtaggatgttagagttaatcttgttgttttgcatatttgtgagtcggtcgtatccagcattggtttgtgcaagttgtgtacgtgctcattatctcacattggttagtggccaagagaggcagccatgatgtgagtgtttgtgcgaccaggtgcttggtcaattcgtggagagtgcttaggagcaaatcagccgatgcatgcattagttagtttgatcacacgttggcttggagttatggccaagtcaagcgaatgagtcatggcgagaagagtggatcagatagctcatgcatgtagtgattggtggtgatctgcatgtagagataggtgctttgagtgtagaaaagtgaatagtggccacgggagaatttggccgagtcgtgcagccaaacgtggcaaaacctgtgcgtgtgtgtttattatttaaacgatgtaatcagaggtgggattaaggagtgtggtgaagaggtgggattaaagagtgtggtgaatagaagtgcagcagtgtgcgtgtgtacatttgctgctggtgtgcagtgccgagacaaatacttccattgtgtgtgtgtgatcttgtgttcgagctaacataggagactgcattgtatcctcaaacccgtgggatgccgtaggtttggtgttagatctcgtttttgccccagagtctcacgttgaactgtggatcatcaatagggcgacgtcgagaggtacaggcagggtttgatctatcggaaagaggaaaattttaagggtcagcgaaattacgaaatttctaaaattttggattttttttccggaaatttcatacgaaatttcaaacaaaatttgaatttgcacataaaaaaaattggggaaaattgacctacacctcaatggagtagcagagcgataaagggaacataggagaatgaaacagcgagatgcatgatgcgaggtcccgcccagcttggactgccgttatcatcgatgcaatgcgccggagagtgcatccgccgctgttcaagccaacgggcggtagagtgctgttgttgcacgttgccagatcgagagccgctgctgtcttcgagccggagcaagcctgctaatggtcttgaatccactccatatccaaacctaaccattcgaatcacagctgcttccccagaccaaaccaatccacccaccgtgttctgaaacccaaaccaattcaaccaaaataacatttcccccaaaccgaaccaacccattttatatttttggctgaaaccatttccaaaaaccaatccaactatcggaggcgctgccgtcggcgctcgctcatcctattgatgttgatcatcagacaaagaaaggaatgaaaattgatgaattgagttacatgtatgagttgtttccggacggcctgaaactcgtcgttccttgatgagcagagcatggttgagcaactcctttgctcgcatatcatccatcatattatctttgtcttgctctagcttcttctccacattgtcttggtcgagctgcttcgacgtcgcgccaagctccggcatcttctaagtggcagcgatggccgagctccggcatcttctcggcggcggtgatggcagccttggcagggatgcggctcctgctcattgggtagtaccagcggcaacgacggcaaactgtgttgagttgtaatccaaattcatttgcacttaataaagaccagcttctgccgtagtggagcggaggcccgtcgccgggaggcttgggccggagcaaaacggatcgtcatcccttttagggttccaccatatatatacctcttgtaagccgccgtgcggcgtggtaacctcaccccagatatagtgaagatattttgctggctggcgtccgtggttttttctctcctactttgggagggttttccacgttaaatctcgtgtcttctgtgattgatctattgttttctttatcgtttgttcgcttatcgtttcctaacaagtggtatcagagcttgttcccacattagggtttcacgatggcatcgatgaagtatgatctaccgctgctagactacaagacgagattctcgctgtggcaagtcaagatgcgggctgttctggcgcaaacttcggatcttgatgaggcgctggaaagtttcgggaagaagaaatcgactgaatggaccgctgaggagaagcggaaagatcgtaaggctctgtcgctgatccaacttcatctatctaatgatattttgcaagaagtgttgcaggaaaagactgctgcagaactttggctcaaactggaatcgatctgcatgtctaaagatctaaccagtaagatgcatatcaagatgaagttgttctcgcacaagttgcaggagagtggttctgtgttgaaccacatatcggtctttaaggagatcgttgccgacctaccgtcgatggaggtacagtttgatgatgaagatttaggtcttttactgttatgctcactgcctagttcatatgcaaattttcgtaacaccatacttttaagccgtaatgaactaaccctagcggaagttgatgaggcactccaaaacagggagaagatgaaaggtatggttcagtctgatgtgtcgtcctctaagggcgaagcattgcaggtcagaggcatatctgagcagagaacctacaacgatagcaataatcatgacaagagccagagtagaggccgttccaagtccagaggtaaaaagttctgtaagtattgcaaaaagaaaaatcatttcattgaagaatgttggaagctgcagaataaggagaaaaggaaatctgatggtaaggcttctgttgttaccagtgctgaaaactctgattcaggatattgtcttatcgtttttgctggttgtgttgctagtcatgatgaatggattcttgatactgcatgttcgtttcatatctgcattaacagagattggtttaattcttacaagtctgtgcagaatggagatgttgtgcgcatgggagatgataacccacgtgagattgtgggtattggctccgtacagatcaagacacatgatggcatgacacgcacgctgaaagatgtgagacacataccagggatggcgagaaatctcatctctctcagcacacttgatgctggaggatacaaatactccggttcaggtggagttgtaaaggtatctaaaggttctctcgtttatatgattggtgatataaattctgcaaacttatatgtccttagaggaagtacattacatagttctgttaccgctgctgttgtttctaaatatgaacctagtaagactaacctgtggcatatgcgtcttggacatatgagtgaacttggtatggcagaattgatgaagaggaacctgttggatggctgcactcagggtaacatgaagttttgtgagcactgtgtttttagtaagcacaagagggtaaagttcaatacctcagttcatcgcaccaaaggtatacttgattatgtacatgctgatttgtgggggccttctcgtaagccctctcttggtggtgctcgttatatgcttaccattattgatgattactctagaaaagtgtagccttatttcctgaaacataaagatgatacatttgctgcttttaaagagtggaaagtcatgatagaaaggcaaactgaaaaggaggtaaaagtacttcgcactgacaatggtggtgaattttgttcggatgcttttgatgattactgcaagaaggaaggcatcgttaggcatcacaccatcccgtacactccacagcagaatagtgtggctgagcgcatgaacagaaccatcatctccaaggctcgttgtatgctgtccaatgctcgcatgaacaagcgattttgggcagaggctgctaacaccgcctgctacttgattaacaggtcgccttctatcccacttaataagaaaactcccattgaggtatggtctggtatgcctgctgattattcacagttgagagtttttggatgcactgcttatgctcatgttgataatggaaaattagagcctaattctattcattgcttctatatctggtgggaggcgcgacttacaggtcatgagttatagaataccgacctgctgaacattctgagcatgagtgtggtgtcaatgaatccgttatgtttacccgacaggcttgcccacagattcataccaatgcgttctgataccgagcctgatcatgggagctatcctgcgtaaccgtggatgatcaggaaactgaaattgttggtaatgatgttaatgatactgtttagcactcacctcctgttttgcagccacaagatgaacctattgcacatcgcagaacaaagaggagttgtggagctccagtccgccttattgaggaatgtgatatggtttattatgcttttagttgtgctgaacaggtggagaatactcttgagccagccacatacactgaagctgttgtttctggagaccgtgagaagtggatctcagctatgcaggaggagatgcaatctcttggaagaatggcacatgggagcttgtgcacttgccaaaacagaagaagcctgttcgttgtaaatggatcttcaagagaaaggagggtttatctcctagcgaacctcc

SEQ ID NO: 42956 - DNA, 20784 bp, Oryza sativa
  unsure (1)..(20784): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagactttttgttccactgcttttgttgtggcgggtaaacgggcactcccgcgggaaatgggcatgggcaaccattcttacccatcatgtagtatgggtaggcactacccgtgcccgtcgcgcccgattgccatccctagcggccagtgagcttgtccacgtgaggatggtgggaggtcggcgacgaaggggcttcggttgtccgtagcaatggaggagaggagtaggaaagtgagggagccagtcgtccacagcggcgacgagaaggaatacaccttagatttgagatgggatgtaggccaatcatggaagaagctagttgcagcccccttcgaacctgctcacgcaccgtcctccgtgagactagggctcactcacacgagaagagagggtagcatgggtggactcgggaggaaaggagccccatcctgaggaggcgaagagatggagggggggggagtccagcggtggtggtggtccttccttaaattgcttcctcatcaccactccaggcgtcctgtcccgtccacgccatgcgcgcgcgcggttaacctactcatcggcaacgcgcgtacaaggaggtgaagtggaggaggggaggagtctggtgatggcggagactctcctcgccctgagtaacgagggggagagatagagaaagaaaaaggagggagagagaggagtgagagaagaggaaaggagggtgaggatgatacgtcgggcccatttttgtttttgtcatgtaaacgcctagccaacacaagtggaccaggtcaatttgccacgtccgtgaaacccaaaagacctaatttaaccatgttttgcaagttggtgtttaagatttttggtattgcagtttagggatgccaattaaatccggcgtaaagatgagggaaggtaagtggacttattcgcagataaaaaggcctactaagcccaccaaatttaatgggcagcacgtaactcgcattttatttccggggcaattgctcaaatgccactagggtttaccgtatttgtcattctgccactggtttttcatcaattggtagaatgccactggtttcacagttgggcacgccaaaatgacactctgtcgttaagacggttagtctacacgttagattggagcaattaccagtctgcccttattacggatttttgtgtttctttgccaaccgatggtagttggatataaatgacgcaagcttttgtgaagaatggtattatttcgatatttttttcctattatatttttgaggttgcaggacatttattttatttttttatatgcataattgtaccatggtccttacgttagatttattttgtattttttaacaggatgggtcattttgtttatatttaattaatgaataagatttttcaacaaatatgattctattagcactagctcaaatgtaagcgagcaatccataaacatacatgaatcaaacatcatcaacttgcacataggcacacaactggtttcatcagaacatagccaccatggttcaagtgacttagacattacataacaaaagcacatttttgttccagtacttaaagaacataccatggttcaagcgactgagacattaaataacaaaagcacattttgttccagtacttaagaacaaagggctccaagaacaaaacacagattagtttcatagactatcatagagcatcatcatctactgccacttttgagttccatcagattggaagacaacactagatggaatctggagttggtttgttccttccaacctttcttggcctgggaatgtttggagttggcatagcactgttcaaggtttgcaaacaaaagactaattagcactagagtaattagcacataagatgtagttagtatttttagtttgaataaatttaaactaacctagaagatgtagtgcaactgtcctttttagcccttcctgccttttttggtggcatttggacagtgatggaagggtcattgcttccctgccctgaatccatttcaggggttgagttgctcttagtcctgcatgtaataaatcattagactgaaatgaatacacttatgatgtacaaagaaatgaaagtggcatacattgtattccttttcttctttgttgcaacctctcctccctggcagtttttatctctatgaccaaatcctccacattctttgcatttgtgctttgtattttgtccagattcatctgaagctttgattctgtttttccttggccttccacgcttcctccttagtctaggtttttgtaacttaaagccaggatccacaaattcccattggtgtttccctattatgggcctaaacactacagagtatgctagctgcaacttctctacagagaagtacttatccacatatgtgtgcattgatgcacctctgattgaagtaatgaaagcaatagcatgtgtacaaggtttgccacacatttgccatactctgcagctacatgtttggctatctaagtctactgcataccttagttccataccttggttatcagggatagtcacttcagctgtagttagtgtgaccctactaactttatgtttctttagccctatgctctgtttattgagatctttagtcacacttggcagtatgactccttccatcttacttgcaatttctgctctatgacagaacttggacactatcttttgcctaatcttatcgatcatgtctacaatctgcacatctttcaagtcctttatccaattattgaaggattctgacaagttattgttgatatagtccaccttggacaattctgagaatttcgctctactccacaacatagggtggttgtcattgaggaattggattgcctgtggtgattgcatcttgatggcatcataatgcttgttgaatccagccattgtataactcttagcagctggctacatgttctccgcatatactgctccatggaacttctttttgaagttcttccaaaggtgcctaaaacactccctatgctcagctatggggtagacacttctcactgcattttccaagcccttgcatgcatctgagctaatgactaaacctgaaggatggccaatgtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaaaatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattataagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagtgcaccgttcccggatcataatcacccccttataaacaaggtatggactccccagcgacccccgtgggcttatctccgccacttctcagtctggtgctccgcaatgaaccatgctatacaaaaggtaaagccgttgcccacgctggcttatggttggcacggttaatgtttcacaacagtagctcgcgaaccggtccttaattgccatgagcacgaccttcaaaaccatgtgctcacaacccaccattaatcatattttagttggcaagtaattaagtaaccaatcacgattgaccatcgtgaactatcattaagccatcattaaataatagtgagtcataagttatcccaatagtgtgctaatgtttctaagcatggctaagcaattatatctaatatctagttgaaccaatatatataaagctcaactagtccaattataatcacccaaggtatcaaggaataaagtaatcaagaacaaaagggctataacaaacaataggttatttccacccaatgacattcgaaaataaatgcaatagttgaatagaaacaatagctttaaatgggatcaacatgctcaaagggttgtttgggatctgtgtgacttgccttgctggccttggaactcttcaaattcttctcctgcgaaaacggactctccggaaacgtcggaatctaaacagaaaagagcaaaaacaccaaaacagcacataaacaagcatgaacagtacaggtggatatttttaacatgtagatctcaattttagaaaaatttagagacttgaaccaactaaatccgagctaagatgaattagttatgaattttcaaagattaaatcggattaaatcatttatttagattttaattgaattatgatgcaataatgaattatttttgaaaaggaaaagggaattattgcgtcagcggctagggtttgcggtggaccgggtgcacggcggcggttcacgggtttggacggccgagatcgatccatccaaaacggacggccgagattgatcgggtctacggcggctcacgggagacgacgacgatgacgccagcgatgacgtcaccaccggcggcggctcgggcgcgcatgctcgccggcgaacgacggcgcggcggcgcgaacggagagcacctacgggtagcggatggcacggcgaactcaccggtgaccaaagcaacggcggaagatcaacggacggcgacagcgtcgaggaagaaacggcggcgaccttcggcttgacgacgacggcgaggctccggcggtctacagcaacaatgaaggggcggacgaggacggcgacgcgacggcgaccacgacggcggccttcccgagcgacggcgacgactggagcgacggcgacgcacggctggagcggcggcgctaggctacacggagctagggctctaccggcgacgagaggcgaaggcgagggtggcggcgggtagcggcgggcttgggggtccttttataggggctaggaggcggcggcgaaggcccacggcgaccggcgacggcgaaggaaggtctagggttcggggagagagacgaatccgattcgagatcgaatccacggatttccaaacgattttagccgacgattccaaaagagaaagggtagaaggggtcccggggatcaattcccctctattgatttcaccggaaacggaaaggcgcggctgaatttggaaggagacgacgacgacgcggcgctagggttcgggtggcggccggccggaggaagacgaagactgacaggtgggccccacctgtcagcgagcgggagcgcgcgcgcgggcggcggctcggctgcgggccgactttggccagggagagagagagagagcggttttgggccgactttcggcccaaagccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccctattttatattgggatttattatttaaaattagatcttttcaaggcttttaaaatgaattctaataataatttattaaataatttataaatcctaaaacaaaaaaaatcaggatgtgacacaatggctgattgaaggttttgaacaaaccaagtccaactttctatggattctgtctctatgacaccgaaagcaaccgggaacatccaattatttccatcaatggctacagctgcagcaagctgacctttattttttccaactaaatgtgtactgtccatggcaatatagggcctgcagcccagtaggaacccatcaatacaaggtttgagagctataaataaccttttgaagcacatctgaccattatgctcttcgatatcaatctgaactttacttcctggcgctgacttcaatagctcttccttgaaagtaaacagcaaagcatagctatcatcccatttgccaaacaatttctctagtgccttttctttccctttaaaaaccttgtcatatccaactgtaatgtgatatttccgctctagcctttcctgcaactcctttggccccaagcttggtttctctctaagcatgtcgataactctgtcacatacccaactgcttgaagccatgtcttctcctgacctattaacagatgaacatatatgttcaattttgtttctttttatctgcaaatcaaaatggcaagattaaagatgattgaaaggttcagaacatagcaaaattagattacacaaattcaattacctggcaaatcttggtgcctctcttgcatgaagcatgaatcctccacttgcaattctcttcttttgccctcttgcaaacaagaatcaaccttgttttgtccttcttcttagtaaaaaagccataagctttcagaactgcatggtgtgtaaaagcttttttgcattgattgacaatttggaaaaatgtaccctcatcaacacatggtttgtcaatatcatgtgtgtaaactacctcatcatcagtatcagagtcaacatcatcatttacttcagagtcctcagaacaactctctggttcatattcacaatctgagtcagatgaagaagaatcatcggcacttgtgtagctactgttactatccacagctaatgaatcatcgctagaccctaaggattcagcatctaaccctgaatttttagtgcccaagtctacatcaaccaacccatctttgacattagctgcagtctttttcttgcttgcacactttggactctcaagtagtgggcacttatttagtgcacactcattttttgcacactcatttggtgtacactcctgtgttggttgggtctgctcagctagcaaaggaatgcattgaggaggagtacatggtgtccgatcttgtgatttctgattttccaatgtgttttttgaaggtgaaacagcaataggaccctctaaatcatttacttgacaatgcaatcgaagcaaattttgtggtttatgtcgtaccaacaatctccacaaatgcttatctgttcgaacctcaatgtactcctcatcattacaatctggatcaggataccaaaaagaaatcaactgcctagaaccccagtctattgactttgctaagtcagcactcaaatccattaaggaataccgatctggattaatataaattggaatttctctgcgatctatgtatctcttcggcttaccatctggcatgctaaagaaagcgcggacgctaaccaaaattttcattaaattgcccctacatagcatggaagaaaacctaatcaaccaacccactggacggaaagaaagcaaatttacaagattagtacctattcggggctacaacttcactcgtttccattctgctcgatgaattcacagctcgatgtcagccctgttcgctaagctttgccgtagcaacttgctcgtcgagacatcgctgtagccggttgggcccctcgtcctccgtcctccaggacctgccacgcttcgacttcaggacgcaaacgcagccgctccgtccgctaggacctgctcgccgagaccccgccgcagccggacgcccaccgggacgctgccgtagccgctccgcccgccaagacccgccgcgctccgctcagctagctggacccactgcgctccgccctccaggacacagctgcagctccctgctcaccggaacccgccgccgacacccatcgggatgccgccgacgcccatggagggatcgatctagggtttaccgaaatgaggggaaatttaacggtcaatagaagttttatagagcagttaacggtcattgacggaacgaaacgacagtggcatctcaaatgaatttttgttcattctagtggcattggagcaattagctccttttcagtgtcatactgccaaatagggcgcccaggagtggcaaaacagcaattgttcctttatttccggcccaattaatatgggatacaccgaggccgcaattcctttccgggccagcatacatgggccgcactgaggctgcattcccgtccaagcccacgtaaaattgctgcggtttcttcggctcgttttcctttttcgtttttgatagtttcagcaagtattcttgagatcagaagagaggcaacaatgattattatacctttggctaaaaaagtgcccgctagaaaattacacaaacagagtttaaaagctagctaaaaaccacagttcgcttcaaaaatagtttttaaggtaaaaaggtggagagactctaccttataaccattaccatattttttttgtttgacgttggttagctcaaaccaacgtcatacatttgtgtaaggaggtagtatatattaatggtgggacagttttacaaagcttcagacaaacataagaagtacagacttcaaaaacaaagtgcaaagtacagaaaggtcttagactcttagttcagctcgatcatccatcatctgatgtgagcgcggtggctgctgtgtttgatgtttgcttcaaaatagctccagaagatgatcgaaagatgaacccatgcattcttttctttttctagttgatgaaaaagcatgcagtgcacttaacaaataattgtttttttatctgacaatgaattatttagtttgtacacaaaagaatattagcaatgcaagtattcagcacactgaaaatgcagagtatatacacaatacactcggaatgcacttgaggattggtcatcccacataatcatcatgtgacaatctccgaaagaacatcaagtgaataatctatgaatgaactgacaatcaagtgataatttttgtggcgcaagataaacaagaagactaaattgttttaaactttttttatataaagtaaaaattccatggtttaaagagtcaacaagcatgaatcaaatatacaagtatgaagatatatcagatttcaactataaattgctatccacatatataacgatgcggcgatcaaaaatttcaattggcaatgatcaaacttcaataggaaccgcgatgctatgcaatcctatatcaaattgaaaccccaaacacgcagtgcaagtatgcaatctttttcttgattacaccctccggccgttcttaaaaaaaaatcaaattctgaacatgtgcttcatagctaggatttttttttcttggacgaatggagtaactatgtagaatccgaataatggtttaccatctcttaccatcgcacaaaatctaccagaatccccataaactttcacaaattaaattaactgttcttttcctttatcttaacatgaaattaactgcgtgtgaatcaacgaataatcgacataacgatgataaatgaattctttcacctgtataatcaaaaccaaaataacaaaagcacaatggaatggagatcatcggcacggcaaagaagaggacacatcaacgatcgagcaggcatcaatctgactccacaattttgttttttccctatcaatttcttttctttcctcccaatcgacaaaatttttggaaagagagaagaacacagccaattgccaaaaaaaattggtcaattgcggctaaattaatcacaagatcgagttatctgtcttctcttttcccaagaaaagggaggagaaaagccaagaaaccaacaaccgtggtgaaggagaagaagaagagggcggcggcggcggcgccgtcgccggcggcgatcacctcctgtcctctcgttgtgaggggctcctccagaagccgccgccgtagaagctcgcccacacctccttctccatgtcaacgaggtgttcggccttgggcgtggccgggaaatcggcgtccaccttcctggccttggcggccgcggcggccagcgacctcggggaggcgatgtccatggcgcccgtctccttcggcttcgtggagcggacgcggcgtcggcgcccaccgcggacggcgcggcggcagagcgcggcgggagcgcggacggccgcgaggacgacgagctcgacgacggcgaaggggaagcagcagaacaccgcggcgcactccgccgccgtcccgcccgccacctccccgcaccgcggctgctgctcccgcgcccgccgccgctcccgctcccgcctcatctccacggccggcgacctcctcaccctcctcgtcgccgacaacccgttccccgccgccgctaacgccgccggagacgccgccaacgcgcggcggtggtggtggtggtggtggtgcacccgcgcgggcatggcgatcggtgccactgcggccatggcgggcggcgggggctgggttgccgttgccctccctccctccctcctcgagattcgtgcggcggaaaaccgacggccgagataggatgcgagagagagaggtgggaaagcggttgcgcgaccgaaccccatatataccatgacgggttcgcgggcccacccggattcctcggcgaggaacacgttaaaccgctcgaccgtttaccggtttgtggggcccacgtgccagtcgcaattacccgggaagcggagggggagactgtaaattcgttaaattatttttctttttcgttttttttttttgtttttgatcggatcgccactagtgcgccacatttttgcatggggcgtttgctattttagtgcgaagaacacggcggcgacgtgcgcgagacgaagccccccgcgggtttgatttgatttgattttgattttgatttgcttcttcttgggcgtctcggaggcgtcgcatcgcgatcgatcatggaggtaaggtgacgagatgggtgttgggtgtttgcgatcgcggggttggtggtggatgcagatgaggtgttcgatgtaacgccgggtggttttgtttggtgcagcagaaggacagcggcggcggcggcggtgggttggcgcggcggttgatgctggatgcgagcgggagggagatggactcgccgcggttcagggcgatcctgcgggcgacgagcgggcggcggaagcgggcgcccgacgtgaagagcttctcgcacgagctcaacattcgcgggccgctcctccacccgctgcagcagcggaagccgcgcgggtgcgtgaacagcccggaggagttcatcggcgccatcaggacaaagttcatcaggctcaaggaggaggtcgacgccgagctcggggtgttcgccggggacctcgtcggcgcgctcgacaaggccgacggggacgaggagcgcgtcgcgctcgaggacctgctcgtcgtcgcgcagcggtgcgccgagatgagccccgaggagctctgggtcaagtgcgagtgcatcgtccagggcctcgacgaccgccgccaggagctcaccgccggcgtcctcaagcaggcgcacacccgcgtcctcttcatcctcacgcgctgcacccgcctcctccagttccgcaaggaaggcggcggatacgtcgccgccgacgacaagcagcacgtcctcagcctgcaccagctcagcgacctcggcctctaccccttcaaggtcgccggcggctccagcgagctcggccgcaagagcacctccagcttgaccgagctcaaggagaggctcatcaggcggaggatgctggagcacaagcaactcaccctcgacttctcggcgggccgtgtcatttcgtcagacaccggcggcgattccccgggcagcggcggcaagatctcatcctggaagaagcttccatcccctgccgagaagaccctgcacaaggttacggaaccgacaacggaggagaagaccacccctacaaagaagaaggccattacgaggaacaaggtcgccgtggatgagatcgtcgagaggattgacgcggctagcattcaccccgacggattgtcatatcttggggactctgctgtgaagctcgaggttccatctgggttcccagaggctcagcagatcatcgtcgacgggaagccgaggatgatatgcaggatctgtgactttgagatccccatggtatgcgcagaagggcacttcatagtgtgcacattagctgatcggtgtgattccaagggcctgaatacggaccagcggctgcagagggttgccgaggtgctcgggagggttttgggttgctttgaatcgaagagcccgcaaactgcagaatgtaatcataatgagactgcaagaggtagcacgtcgagtttaacggaatccgatggatccatggatcatgatattctgtctcatctgttgacagtgccatcgacagagttgttttcagaggtagttgcctcttcttcctcaaacaatagtatccttcgaagaaacaattataactgctctgttttgatcatatggattgtggacattttgctggtgaaattggcagggagcactcacaccagcgtcaggcagcatgccacagtcaccattgctgacaccaagaactagccacgcagagtcacagctgactaaacacaaggcattcgtggaactagagaactttcagcaggtttgtgcatatcaacttaatactgatccttgtttcattaaattctgttcttgtcagaatgttagttggaacattattcttttgaggttatgttaaattttgcttcttcagtgatctagactggtagtttaccatactggcaggttgaaagcttaatgactattgctagaggcatcgagagaataaaaaactctgagtacaactcgcttgaggacttgagctcttatctagaagatctaaatgctgtcattgacacaagaaaagtggatgcccttgttgtggagacatttggaagaaggatagctaaattactacagtaagtgcaatgccagtttaattgttttacatgtgtttgtgccccttagcatcttcagatttatttgtccttagcagcgatatacgcattgctgtttcattactcaaattacactacctgaaaatatagccctgagtgtctcgttaacattatggcttctcagggagaaatttattcaactatgcggacaaatagaggactcaaacactgattcattaggttcaatagacgaagatggtcctatggagagtagtgtaagctcgagaacaagccagatgaatggtaaattcaaagatcgtacctcaattgaggactttgaaattataaagccaatcagccgtggtgcatttgggcgtgtgtttcttgcaaagaaaagggtaacaggagacctttttgccatcaaggtaatggtcattacactgggccttcagattcttatttgtgccaatgtagtagtgtccttctggatcaagtgcaataagagtataaacttaaaaataatcaattttggctttttaattctccttctgttgagaaaaggaaagtgtttgagatccttttagtgtgaattttgaattttgatgaaactaaatggatgctttgcttcaagattattagagaactcttcaaatgaatagactaggataattcgccggcccggcgaaaaagaatagactaggataaaaaaaatatagcacttacataattgaattgctagcttcagtggtggcttttatcctgatggtttcatcttgaatccaggtgctcaaaaaggctgatatgatccgcaagaatgcagtggaaagcatcttggcagaacgtgatatcttaatatcagctcgcaacccatttgtggtaagtacttcgaatgttaagtaaaatgaaatattggatttcatttaacttcaatctgtaatggacaggttcgatttttctactccttcacatgtagggaaaacctttatcttgttatggagtacttgaatggaggagatctgtattccctcttgagaaacctaggttgtttagatgaagatatggcaaggacgtatatggctgaacttgtaagttatgagtgtcttttatttcctgaaagtattttacaaacaactaaatcagaaaggtccatccttagccattcctttattttaaaagttttaatcgtaggcatttttatttctatctgtaggttcttgctttggagtatctgcattctatgaatgtgattcatcgtgatttgaagcccgataaccttttgatctcccgtgatggccatataaaggtaatactaccttcttatttcttttctttcaatacctattacctattaggttcttatgtgtttagtgttgttatcggtgactgatgattagattgtctgaggaaaattgttgctgtactttcaagtcttataagtatttttttcatgcaatagaatgaaggcggttgtctatttccgtgcagttgactgattttgggctatcaaaagttggtcttatcaatagcaccgatgatttgtctggtccagatgtcagcaatgttcttgttggtgatcatcaacctgcagatgcagaacaacgtgcacaaaagcgagagcaaaggcaaaaacaggcagctgtgggtactccagactatttggcccctgagatactgctagggatgacccatggtctgtttgcatctttttcgtagaacttacatttactttaaaatgtttaagtcagtactttagggtgttgaatttattacatataacttatgtttaccttcatcgaaaagtgaaaatgcatcttctattaaaatatatggcactcttacatgcaggtccaactgcagattggtggtcagttggcgtcattctctttgagcttcttgtgggaattcctccattcaacgctgagcatccgcaggtagtcttctatcctctctaaggctctgttctatttcttcaattccaacttcaacttcctcgttaaatgatgtatttttgacaaaaagtttctatatagaagttgttttaaaaagcaaataaatccattttttaattttttacaataattaatacttaattaattaggtgctaatgagctttcttgttttgagtgcgccaaaaatatctctcccaagtcagggaacgaacggggcatgtttgataatatagtgacaagctggctctaactaatttgttggtactactaacatgttggttgtctgttggaaccattctaagagagagaatttatttactgaagaagacgaatattagttagagccagtttgtcatttaattactccaatgtctcgatgcttatggtctatcaaaggtcttccagcagtaacataacaatgttgtttatttacagataatatttgataatataatgaatcgggaaataccttggccacaagtaccagaggaactgagtttcgaagcatatgacttgattgacaagtaagtcagaaaattattattttggaaataattgctatcaaccgtttatttctgttcatcggtatttcttggtgaatctgtagtgttaaatgtccaacaaatctgcattctacagatgctattttaactcagttaactttcatgtcaggttgctaattgaaaaccctgtacaaagattaggagcaactggtgctggagaggtactcgttttcctttttcgtattccagttatacctcttatgtacacaccactaactgacatatgctattagagcaggtaaaggctcatcctttcttcaaagatataaattgggatatgattgccagacaacaggttagaagctaaactaatgggcagtctgaaaaacaggaacctcaaaaaactgcctccaaagaagtttctgaactggattcaatttttgtaggctgcatttattccttctacagatgatgaatatgatacaagttattttgcctgtcgtcacacatgggacgaccaagtgaatgtagcctctaacgactacgacgatagaagtgaaactagtagcatgagttgtggcagtagtccacacagttgtgattatgaggaagatgtatgctagatcaatccctctaaaatcccccttctgatttagacatccaaatcattatgtagcccacacctcatacctctaaccttttctaaaaaacattaacaggcggatgaatttggtagcatggaagaattcggagctccatcactgtcagtgaaatattctttcagcaatttctcattcaaggtaaccctcacctgaagttcccacgatatttgaatctttttctcggttagtaagttttttttttcttttcctttgtaaacagaacatttctcagttagcatccatgaactatgatctgatcacaaagcataacgaggatcccctacagtcttcaaaatcttgagagtatgcactccctcgacatggtaatgtctcattgttgaactggtgtatcgtccttgataccttgatcctgtgtacagggcctgcaaatcaagctactaaacttaccatcttgggtcttgtcaggcaggctgcaggaaggagcttcctcaacagtgaactcccacagttttgctacaatggtttggtcgatgacaaattgataataggaatttcctcggcaagactggttcaagtaattttttttctcttcagtttctctccagtgagcaaagaggtgcatttcttcatggcaaatgcaatctgtaatcattgaagaagaatggataggtagcacaggaatcataggaaagaatggcacccactgttttggcaaaataggtatacctttctcaaaacttgtgagtggtgcaagattaagttgtttggtactttggtgcagtgtttttttgcatcaatagtagaaaaaaaagtttatagcatattttaccctattgtatttattctcatatttattttattgctgttgagacccattactagctgaatgatcaatgccctggtttagtccaatatatatgccaaaaatgcttgctgtgattggcaaatggaagttgcagatcttactctcaaggatgaattcagaataggaaaatactttacagctaattaccagtctttcacctacaccatccatgatcaaccacaaaagaagagaatccaaacgagccaggaaatcaccacacaccacaagaattaatctctatacgcacatgtcgcaaataccacaagctcagacacacagagagtccccaagaatccaacctctccaggatcagagacatcgcagatcaatcgaagtaattaattaactaatgtaaactgaatcgaaacataatccttacaggtaataataaattaactaaaaccaaaaccgatcaaattcgaagctgggagttgcttattggtttattgattattatcgcagtattctaaactcttactgctagctagaacgaaagctaagatacaaacagctagtagtagtgatcacatctagctgccactgccactgcaaactctgcaagcttcgtcttcttcctgcaaatccgaggctagctagctagctgggtgtgattgcatgacgcgtcgaggcctagcgaaaggcctagccggtggtgaggaggaggaggagttgcccatcgccggtgaggggcggccggcgacgtaccggcggcggtactcgtcgccgtcagacgacggctccaccacgtcggcggcgaaccgcaccctcctcgtcctctcccgcggccgctgcggcttctcctgctcctgctgctcctgctgctgctgcgctcgcgctaagaatgaaaaagaagttgaatgctagtatcgatttcgattggtctatggtgattttggttgtagttcgatcgatcgatctcaccgatggagagcttgaggtcggcgaggaagcggcggtggagggagtaggagatgatgatgatgccggtggacgcgagagccaaggcgatgagccccatcgagccgccactgccgccgccgcggtccatgcaacgccgccctccgacgagtgtgggcgatggctgctgctgctgctgcttgagcatggccgatgggggaggaatggagatgggtataagaggaggaggcgaagaggaagaagacgaggagggaaaagccgtttttagaaggaaacacacatggggaatgcagcataaaaacattctcttttagaaaaaaagagataaaaggcatgctggcatggaacaacaatgtatcagtgggcttgattggcacaaccccagctccagctccacctggagctcaaccaaacagtttcagttctatctaaaatgggagtggacctctctcataaaatgaactatagaggtggagctggatttaggcagctccacaactccactctagatccaactcctgaagctaaatttaggagttggagctctaccaaacaagcccatcgtggccgcttagctatgccttctatggtgtcgtccaagtttttaccaatatacacacgacgagcccgggatcggacgaagcgtacgtgatggtttttcggtgtatcgcaccggctggacgacgtgtaaggagatatggtggacatggtgtgcattttgtgtcatcttggtgttattgatgccgacacgaggcagttttggtgaagcgtgaggcttactggtggtgtgtcgacgagcgcgcagaacactgggtgatgatgtgtaagggatacatatgccagctctaacttgtgccggtatctttgttttatcgatgtggatttgagacctcgtgatcttttacaacaacccttttaaagttttcttgagttaatttgcttacgaaatgtgataaccaatgggtatgtagtcatcagataagatagagatgcataattacgtaacaggcaatagtagtattgtagcaagggagaaaacttaccggttgtggtgacatactgaacccatatgctttatatgcttatccagttgtttacttgtttacccagtggaggatggcgtttatttgataggttatcttttttcttgaggcacaaattacatagtttagttcccaaatcagctcagaaaaaaaatgcacgcattaaatcaacaaaaacaaccttctcagaacaaaaatataacagatatacaggggtaacactaacggtataatacatttggaaaaatatgaacttacaagtttttttcctcgataataaacttaagctatgcatatggaatttgtcatggggaatttttaggataaattgttccagatcctctccaggaccaacaccattatcctaggcaatagattcgttaccaatcttaataaaattgagggtacgaacaaaataataaaacaataaatagtaaaggtcacctgaaaactcgataaactatgtaaaaattaagagactaagaacataaacagacaaattagcattgaaattacattaaagggctataattaatatacattgcgtgcatcacacatatgggtaaaccatgcccataggtcttgcaaaaaaggaaaggaaaatcatgtgtgagggataaggtgtaagacccaaatcgtaacttaagtaaaatggattatgcatcaaactgtggtggatgactagtttgatacctcaggatatgtaaacaaatgctttgaacacatagaatttagcaaaacttgaaggagtttgaagcaacatcgtctagaatatatcttttctgcaagaataggtaagaccaaactaaaaagtatcggagtagttttgcaaagttatttttccactgccctctcctaataatcctaacactagcaatagcaatattagatgtgtttactctatttcaatgttttatttgtgattttgtatattacacatatacttgaatagtgattcaagctatatctgagaggaaggaaagataagtatgtaatcataagggttattcgaaagagctagctactgttgtcggtgacatggaaccggggtatcatgactagcggattgggcagccgcggtcacccacgtggcccgaacccctcgggggggtcgggcccgagggtgacgtggccacccctccctctgtctccccgaggggtcgggccgctcccgtttcggccccgagggctggggcgccccgaccccctgtgggattggcaccacgtgtgtgggttaggtgagcacagcggcgctcacctaaccgcatttactgcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagcctccaggcgctcgtccctagccggagccggcgtgctaacccctggagttggtatgtcagtcccggccagatacattccaggcttcatcgcaaccattgcaaggaagtcattgtatgaagaagggcagacgtgcagcatgctaaactga

SEQ ID NO: 42957 - DNA, 16765 bp, Oryza sativa
gtcccctgtgtcgggcgagtgacggcgctgagcctcactgaaggacaagctgtgatttagtttccgggcgaaggcgcgaaccaagttttggtcaagatagggtgggtccccatcctaaagaagagtaggtaggagtggtgcatgtggtatccccttgagatataaaaggaggaccttgcccaccgaatggggggttggttgattcgaactccggccacttggttccagagcctgaactctctctcgctctcgagctctctgtaactccttcatacacagatccaccaaaacacaggagtagggcattacgcttctcagcggcctgaacctgtctacgtcgcccgtgtcttgcgcgattcttctcgctgacatcctcagatcgacgagggcgaagaacctcacttagcgccccggtcgaaccggcaaaggggggcatgcgcggtctcccggtgaggagccccaagctccgtcatcaagcgcgccaggtagagggcgcgcgtgtcattcgaagccctcgtcctctttcgtgtgcgccaagcttctcccgctcagcccaatggccgaacgggcagtggcgcacagcctctctccgaacgctagtggtgacgacggggagcagaacccgcgccgtcgggctcgcaccccaccgtccccctctcgccgaaatcttgggcgaggggaggtgctcggagaggtcggaggatccgcgacttcgctgcccacggacgacgggggaggacggcgagacggggcgcgtcgtcgcctcgtctacggcaatggcggcacgccccagggcgcgctccaggctgcgggcgcactcctgcgtcacccgcccgtcgtccccgatccagagactccagcccgacgttggctggatgacgtggccgacttggtcatgatggcgcagcagcgcctaggtgccggcgggcggtcctccgccaccgggacctctggcgctgccgccgctggctccacgtcgtcgaggcggagggcgcggcgagcggcggccgtcgcccaccgttcgtccgccattccctcgtcaacgcctccgacccaagatgtgcgtggggggtcagatgcctggctcgatatcgagcgccggcgcgacgatcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcttcaaccccgccgagtttctccagatctacacgactgggatcgaggccgccgggggcgacgacagggtcatggcgaatttcttccccatggccctgaagggtcaggcgcggggttggctaatgaacttgccacccgcgtcggtccactcttgggaggatttgtgccagcagttcaccacgaactttcagggcacatatccgcgcccaggcgaagatgcggacttgcacgcggtacagcgaagggacgatgagtctcttcgctcgtacgttcagcggttctgtcaagtccgcaacaccataccatgcatccccgcacacgcggtgatctacgcgttcagggggggcgtgcggcacaaccgcatgctcgagaagatcgcctccaaggagccccagaccaccgcgcagctttttgagctcgcggactgtgtggctcgcaaggaggaggcctggacctggaactcctccggctctggcgtggcagctccggccgtccccgagtccgccgctcgatcagggcggcgggacaggaggaggaagaacaggtcggcctgttccgacgacgagggtcatgtcctcgccgtcgagggcgcttcgcgggccccccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggccgagcggacgaggaagtgggaggaggagaagaggcaggagcgccgtgagggcaaggccccggcgactcccgccggcaatcggcgaggtgaggccaaacagaaggcccccgccgaggacatcgacgatggcgacgatgacctggggttccaggagcccgaggccaccgtcgccaccgtcgatgggggagcgtgcgctcacgcttctcgccggagcctcaaggccatgaaacgagagcttctggccgcggcccctacccatgaggcgacgcggcgggcgtggtggtcggaggttgccctcaccttcgaccagaccgaccacccgccgtgcgttgctcggggaggacagatcgcgatggtggtatcccccaccgtctgcaatgtgaagttggggcgtgtcctcgtagacgggggtgcagctctcaacattctttcccccgcagccttcgatgccatcaaggccccggggatggtgctccggccgtcccagccgatcatcggtgtgatgccggggcacacctggccgctgggtcacatcgacctcccggtcaccttcggtggtcccgccaacttccgcacggagcgggtggacttcgatgtggcggacctcagtctgccctacaacgcggttctgggaaggcccgcgttggtgaagttcatggcggcggtccactacgcctatctccagatgaagatgccgggccccggtggccccatcaccgtccatggcgacctcaaagtcacgcttgcttgtatggagcagcgcgcggaccacctcgccgcggtgtccaagcccgcgggcggcgacgagaggctcagcacctccgtcccagccgccccgaggcagcggatgatcacgtgcgacgaggtcccggtcaaggaggttgccctgggcgatggcccgtccaagaccacacgaatcggtggtcttctggatgacaaataggaagacgcgctcgtctccttcctgcgggcaaacgccgacgtcttcgcctggagaccggcggacatgcccggggtccccagggaggtgattgagcaccgtctcgccgtgcggccaggcgcaaggccggtccggcagaaagtgcggcggcaggccccggaacgtcaagccttcatccgcgaggaggtggcgtgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccatagggacttattgttatacgacaatgcctttcgggttaaagaatgcgggtcctacttttcaacgtactactcgaatttctttgggtagccagctaggacgcaatgttgaggcctatgttgatgacttggttgtaaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagagatgtgcaatgcgtcaccggctgcatggccgccctaagtcggttcatatcgaggctgggagagaaggcgctacccctatttaagctcctcaaacgttccgggccgtttacctagacggaggaggctgagcgggccctcactcagttgaaggcgtacctcagttctcccccagtcctggtcgccccggagccagatgagccgttgctactctacctagcggcaaccccgcaggtggtcagcgcggcgttggtcgtggagcgtgacgaggacaaccctcactccgcgcatccccaccctgtgtcgactcgacccgggagagagcaggaaggagaggcccctgagccgaacggcggcccgaggcccccgacggccggagctggccctccgcccgcttgtccgacggtgctaggcgccccgacctccaggatggcctcggggccactgcgggaaggccgcgcctgtcacctccgaccccgaggtcgtcggcacagaagccgagtgcgccccgcgtggcctctcggacgaggagcgccccggagatgcggcccctggcgaagaggatcggccccgccgaaaggtgcagcggcccgtctactttgttagcgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataatcgagagggtactggacgggtggtgaaatgggcaatcgaactctctgagttcgatttgcactttgaaccacgccacgcgatcaagagccaggccctcgccgactttgtggcagagtggaccccagctcccgagcccgtctccgtccccaaggccagctcgggcccctcgtagctgcctcacaccgcctactgggtgatgcagttcgacggctcgttgtctcttcagggtgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtattaggcgactcccagttggtcgttaaccaggtctccaaggagtaccagtgctctgacccgcagatggacgcttacgtgcgccaggtgcagcgtatggagcaccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggtgcgacccgaccccctaggggagacggacgcgcctgaatggcccccgaggcccgtcggagtccaggcctcgggacccgaggggagcgcttccagctcccctagattgattgcttggatcactgagatccaggcatacctcgcagataagactctacccgaggaccgcgaagggagtgaacgcgtccggcgcatctccaagcgctacgtgctggtgaaggggaccctctatcggcgcacggctaacggagtcctcctgaagtgcattcctcgggaacaaggcgttgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgctagttccacgccaagcaaacccatcagccggcccaggccctgcagaccatacctctttcatggccgtttgctgtctgggggctcgatatcctgggtccattcaggcgggccccgggcgggttcgagtatctgtatgtcgctgtcgacaagttcactaagtggcccgaggcttatccggtcatcaagatcgataggcactccgcgctcaaattcatcaggggcatcactgttcggttcggggtgcctaaccgtatcattacggataacggcacccagttcactagtgagctctttggtgactactgcgaagacatgggcatcaagctctacttcgcctcccccgcccaccccagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcgaaggcggtcctcccatctgagctcaccctgaggtcccctcgggtcaccatgtattgcgaggctgatcaaggtcagcttcgccgagatgacctcgactacctggaagagcgaaggcggcgcgtggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgagcaccttcatcgcttctacccctagtgggggtcgggtgtcatgtctcgggctcgggccaaccccgcacccccccctcgggcgtacagggctggccgggggctaccacatgcatatacttatcttttttctcttccgtatttcaataaaagcattttcgatttcctaaggactgtgtctgtgctattgtttccttttgaagaatcttggcttgaattagcacgctcgtgctcgatcctgctctcggtggcccgggccggctaaaatcgccaaaaggggcccagaaccgagccgtgccccggggcgtggtgaactccgggggggaatcggcaaaggcccacaatcgggtcatccataaccctcggtcaccacgctcccggcctggccagtctcgacacgtggatctccccaggcactagccccgacccgcgccgcttggggttgggacctgggcacgagccctcgttcaagccaagacacagaaggaccgtggcacagaccatcctcgtatcatacacacaacaaacataactaacgtagaaatttcctctttatttgattacagatttaattacagattaagtcagtctatacaagaagggggccctaaggcctcggaagaagaaggaaaagtcgttaagattcgcgggggcctgggggctcactccgacgcacccgggtcgccggcctcgtcgtcgccgtcgtccgcgccgtcatcaccgccctcctcgtcggagtcgggcgcgaacgcgagtcgaggggccgtaccctcgaagctgtggacgatgtggttggcggcgtcccggacctgcgcgcgcgcgcctcctcggttccgggagggaactcctccagcgctgcccacggagagaagtcagggtccctggcctggtagctcgccaatacgagctccaccgccccccgggcgaggtccctcgaggatgacttgatcatctcctcgagctcctcggggagccgccagaggaccccggccatctctgagaggcgctgggcgaggcccccctggttggcggcgtacttcgcgcaccgcccgccccagaggcccgcctgccgcccggcgcggtctagacgagagacggcgtcccgaagcatgccgggccctacctcgttcgccaaacggagggcctcaacctccccggtggacgagtccagtgcgccttgcagcccggcgatggtgtgttcggcggctgcgaggcgggcggctaggtcgctgtcgcccgcggcagccccgccgctgtgcgctctcgcgttcagctccttcgctcgcgcctcgagctcagcggcccgctgatccagtgcggccctctcggcgcgggcgccttccagatcgcggcgcgcctgctccacccgcgctgcctcgcggagggacaggctgtccgctagccgccgcgccgcggcctcggcctcctcgagagctcgctcccgctcggtgagcgcgtcctcgcggaagcggagtgcggactcctcttcggcgcaggcggcctcgtgcgccgccagtgttgcctcccgggtggcgacggcggcctcgcggtccgcaaggtctttctccttcgcgtccagggcgcgggcgcgctcctccagcgccgtggcgcgagcctcaagggcctcttcgcgctggcgggacgccgcctcgttctccgccgcccgccgctcccaggcagcggcggcgtcgaggactccccgggcggcgtcgcgcttcttctctagctccgccgtccggctcacgtattggaggcggaggtcgtcccgcgcctcgtcgagcacggcggcggcgatgagagcggtctcccgctcctcctccacctccctggcgatctccgccaggcccctacgacgggcctcaagctctgaggcgtgccggcggtgtgccttgcggcccgcctccaccatggcctcgaccgagcgccgcccctcctcgacgcacgcccacgccgcgtcgagctccgcccgctctgcctgcaggacctccatctgggcacttagcccgtccagcaccgtggtgttcacggcggccaaggcctgcaggaggggctccgcgctcagtggggcagcggaaggtagaggggagagccgcctcggtgtgggtgccgcgcggctcggcccgccgatcgacgtgccggactcgggggcgtcccccgaagctggctcctcccgagcatcgcccgaggggtcaggcccgagcggcgcgctcgcggcctcgtcgtgggtggcctcggaagtcgtcgtcgcctcgggcggagtcgggtcgggggtttggcaggccgcctggcgtgcgcgcgccgcctcctcctcccgggcggactccccggcccggcggagtctggcctcctcccgagcggcctccttagcctgacgaacccggacggcctcctgggctgcctcctcggcttcccggaggtggtctgcggcttctcgccggtcagcttcgcgcctccgggcctccgcggtcgccgtctcctcggcctcggaccggccggacttggaatggcgggggggggggggggcgatgggatctcgctgaggcagaagaaaaaccagaaggcaaaaagaaacgggtgagtgaaaactcgccttgggagatggaagaacgaatatggccgcgatgggcgcgggaacgaacctgcgaggaggtcagctaaacgaccaccttgggggcgagatgaggtcccccccggcatggctcggtcccccccatcttgcggagccgcttcttctttcgctccccctcgggctgcggcgacggcgcggcaccctccgggcgcctgctgctggcacgcaccgccccgccccctcggggaggagatgggggggcgtgccctccagcttcctcttcccccgggcgtcggcagggcggctgccccccgggcccccgtcgcgaggcccagaagcacgaccccttcccggggtagattgttcccccctacggctcccgcccgcgccatcgtggcctcggagggcccgctcccccgacgccccgaccgtctgcatgatggtcaggatgctggcgcgatctggatcgctgtagagggggaggataccttgggggataagggatgcctccacggagctgagattcagcacccgttggaccactatcctgaagtcctcggagtcccagtcccattggcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcgaaaacggcgtcgtagccgtctcccagatctaccgtcgcccgccagctggaggcctgcgccgggggctggctcggaagtcggaggcgcgcttcgtcggcgaggggggtgtagaaccaatcgcacttccagtcgtcccacttcttggggaggacgcagggaatgtagcgttgcagcacctgcccccgcggttggaagtagcagccaccgactaccgtcggcggcgacaccggctgtacggtgaagaaccaccggaacagctggagagatgggcgcaccccgatgaacatctcgcacaggtgcgcgaagatggccaacgtcattatcgcgttgggggtgaggtgcgccatctggagatcataaaactccagaacatccatgaagaaattagagaatggcgggaccagccccgccattgcgaaagagaggaagaagacggaccgccccgggtagtgtggcgccgggcgtccctcgcccagctcgaccacctcccggccggtggcagattccggcatgaattggcgcggcagcccggcctgcctctcgctcacgatgcaggaaggcggcagcacgctaccgtcaagcagtgcggagccccgtgccatgacgccggcggaggaggagcttgagagcgagtgagtgcggcaagggtagggcacaggaaacgaagagttagagctcaaatggcggaggcaaggggaagaatggcgagaggaaggaaacgaatctcttcctcggcgtctttatacccttgccaacgctattcccggctcctcgtttcccgcgcctactacctcgccccctcgtttctcgcgcccacgcctccactaacccaactcgtccgtttgcggcgcacgaggcagatgtgcggccgtagcagttgagatgggacagatcgtgcacgcattaatcgcgctcgccaaacgcgaagatcgccatcatcatgtctccaggcgaaacgaaccggctcgtcccgattcgcgcgctgctcgagtaatgtagcggtcttgaagagaccacttattattgtcgatcggttttcccttgccgatgtgcgcgatttgcgaccgctgggtttctgcccgcctgaagagaccggccccacctgtcaccagacctaaggagtggcgtcacgaccgagcgtttccctccaggggggcgatcgccctggcgtaacgccgggggctactgtcggtgacatgggaccgggggtatcatgactagaggattgggcagccgcggtcacccacgtggcccgaccccctcgggggggtcgggcccgagagtgacgtggccacccctccctctgtctccccgaggggtcgggccgctcccgtttcggccccgagggctggggcgccccgaccccctgtgggattggcaccacgtgtgtgggttaggtgagcacagcggcgctcacctaaccgcatttactgcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagcctccaggcgctcgtccctagccggagccggcgtgctaacccctggagttggtatgtcagtcccggccagatacattccaggcttcatcgcaaccattgcaaggaagtcattgtatgaagaagggcagacgtgcagcatgctaaactgacgtgcggtggacaagaatgaccggtttgtgactggtctgacgccggtcacgtcattggcaggcaaccatgctcccacgttgcatctgctttcagcggagtggaggtaggtatgacccatcccatcggagggtcatccggacagcggccatcgcaaatcttcgcccattaatgaaggaatgacagggttgtcccctgtgtcgggcgagtgacggcgctgagcctcactgaaggacaagctgtgatttagtttccgggcgaaggcgcgaaccaagttttggtcaagatagggtgggtccccatcctaaagaagagtaggtaggagtggtgcatgtggtatccccttgagatataaaaggaggaccttgcccaccgaatgggggtttggttgattcgaactccggccacttggttccagagcctgaactctctctcgctctcgagctctctgtaactccttcatacacagatccaccaaaacacaggagtagggtattacgcttctcagcggcccgaacctgtctacgtcgcccgtgtcttgcgcgattcttctcgctgacatcctcagatcgacgagggcgaagaacctcacttagcgcccccggccgaaccggcaaaggggggcctgcgcggtctcccggtaaggagccccaagctccgtcaactgtagtagtcaattagacgtggttgtagctaggagggtggtagtggtggcgagatggacctggggagggcagtagtggtgacgaaccgaagtcatggaaggcggtcccccccggagcaattaggcaagcccaacgggagaggacattgacaccgtaccaaagctccgccctctcctgccactcccccatcggtctgtagtgcgaagtgcacgcgtcctcgaagccaactaaagacggtgctggtgggcaccctcacgaatcccaaccccactcttcctcaggttcgagacggaaggaagcagcacggagatggagctcctaggctcaagacgagaggacaacagtcgccgtttgttagggatgacatgcccctccccactgttcgtcttctctcacccttcctcggctccgcctcaccactatcgccacccttcccgggctccatttcttttggaaggtgatagaggaggaacatagagagagagagtggaggtgaaaaagaagatgagatgagtaggaagtcgctgacatgtgaattccacctgttgacctatcgagtcaacctaccatgtcaacagaaaaaccgtttcccgcaccaccaaggatgcgaagtagacttatttttcaccacactacaaagctgagtttgaaactgacctcaaaagtgaatgtacatgcgtgtgcggggtcgcatgttcagacagccaggcctaattcccggcccaagttccggcccatccccagttcactccgatgccagccattatggcgggatgcgtgaaataccaaaatatttttttcccatctccctcgcgagggttcaaactcctcccccaaaatccaatccccaatccgcgccgcccccattcgtctccccttcttttcaaatcccctctcctctcctctctcctcgccgccaccgcctacctacctccgccgcaggaagcttccagaaggttccgggaggccgcggcggagaggcttcaggtgagctctcccctttgccttcctctccagtctccatccggtcgagatttgacccctcgctgccgagcccaccgacgctcgccgccgtcgagatcccagctgctcgctcgcctcctgggccgcccagccgctggatcggggtctttgctgttgatttttcttttcatgccaaatgcgggggccatggttagggtctagtgcccaatggcggcgcgccgcggtttgattcgagggcactgcactgctgcgagttgcgcagctcagatccaatcctctcacttgcttgggatttttatgaactagatccatacccaacctgctagtgcaactgctagtggatagtaacaaatttgctctaacttaaacggttttttttttttggtcacatggttcttcctttaggggtacaggttgagggagaggaaggtatggtttggtgagtcacaggaagggatgcggagctagaagattggaggctacaatggctcaagccgctgttcaatcttctctgaatggtgacttgttgattgggagggccgcgggagttccgaggatgaagaggaagaccccctctgaactcagagtaatttgcctttaacctttatatgtgtcaactatgccttctttattttcaccatgatgtgatattagatgagatatttggtgaaaatgtgtgtgcggtttcaagagatttccatttgataaaaaagtattctctaatactgttctgttccagataccaagaatgcacattaactatactttgtataagcaaacctgcaatatttaaggacaattcatatccttgcaactttccatggtgcagccctgatgcaatgagcatgatatgttatgccatatgaaaagactgacgaagaccattcccaacgcatctcaaaaaattactatatcattttactgcatcaagtgatatttgttttacttagctaatgctagagaagagtaataacatagtcacttcaaactgcatttaggataacttctgttatatatgcatgtttcctttccatggctgaattgttaatgacaattagttcaatggaggccagtgtaagcacacacattacttattgctgctctcttgagtgctgctttaggcataaaacagtacagctgcttatgaatgctgaaaatgttccgataattacttattgcagggagagcaattgaagcggcgtgcttctgacaagcctgctaatgaccaatcactccattctgcggcatttgataggtagctaatctgcaatctgttttagtgatgttccactttgcttgtatgaaaaacttaataattctattatcgcggtgtagggcaagcaatgggtttcggaacccagagcaatcaaaaatatcgaaatacatcagtactcgtgttacagaggtgttcccagtaaaaaaatctagaaaccttggaaaggaaaacttcaaggtcagacattgtgacatcattcacttttatggaccttaaattgttcagtgctaaatgccacatcttgaaactaggatgctttgcagaataatgagaaggctcccaagtctgctgatgctgtgacaacttctgattttgcatcaccttcactcccatggtaattatttgactggataattttatgtacttgatgttttgcatcgtgtttatgttcttatgtggattgtttttgcgaaaattcagtggttatggtgactctgctaagttggactctgctgttccatcacatactgaggcagctaaaccaagttttaggaaagttgagaaatgcagtgaaaatgctttgcggagtgtatctgagctccatattggtgatgagcagcagtctggcactaataaatttgatatggtaaggagcaccaatctatctagatcatcttagtatatgttgtttgtgtgctaatatttctaatgctttttgataggaaaaagtactcaaaggttttggagctcgtgatgcttttgtggcctctaagctcactgacccaaacatacaagttggtgttgtaccctcgaaatctttggatttgtgcccttctgagatcgctgttccaggaaaaagagctctttggatctcaccctgaagactactttgcaatttgtttcatcatcttctgtaaagtggtgggtattttactctttcttgccctttcagcttgtcagttggatgacatatccatctcaaagtaacagttgtctgtttgcttgaattggtagcatatcttaaacctgtaactataacctccttgaaaacaggtttcattttaggtcttaaacatggcatgctaatatactcatagaacaaggaataacaacttagttttccgcgcacataaatctaacaccagtattatatttaacccaaaagaaagatgacaggcatttgcaaaattgaaattatatatatattttttaaaaagcatctggtttgaaatggcagagtatttggcaaatggttatgcaccattataatacctcaaataatattacatctatagtagtcccaatagatggcatctacgaattaggggaatggaaatcaaaacttctgcttttggagtgttatcatgaaatgtggctgttttcatttgaggttttctgcatagaagtgaaaaattctcctgtcaataactcttgtatgttacaggtgtcacaagataagtacaagttttggtaggagcagcattgtaggacccattgcccaaagttatcatcatgggtgtcaaaattcaggatgctcaaggcctgagagaaacaaggaattcttgttctcaaaggcactacaatcatgggtatatccacaatccttgttgcctgcttccatcatatctgcaatggtatcatcaactgtacgaggaggtaatatcaaaacctgaaacaatcctgtaatgttttgtggatgtaactaaaatgatatattcctctggtcatgtagaaagtgattttctcctcaaaaggcatcaggactgggaagattcatttcagaatctttactacatgctccggaagaatctgttgaatattttttatggtattttcatgctccttgaatccaactgattcatagtaagctacatagttggaaaaatgtaatattatggcatttgtttagtgtttcacatggtctgcttgcttttgtgctgttgtgcactaaaaaaattgctgctgcaaggtttttatagcaaaaagtttagttggacacgatagttatacaataagtaaaaacaccatctatctaaggaaaactatgaatttaaatttagtgccaacacatgtgccttttgctcaaggcctcatttgcagttttcaaatatgagatgttttattagactatctctgaattactcattaattacaatgaacatttgctttattgttctagtttatacgccacaatttgttgctctcttcatcggtggaaattgtttggacaagaagcagacctgtaatgcgtacctatcacaatcaacacgtgggatacgatcattgctgcgaagacatgtgagttctttctgtttctctatgcaattacaattcgcaatgcacacattctcctcttttttttttcat

SEQ ID NO: 42958 - DNA, 1460 bp, Oryza sativa
caggtttcattttgccctcctatcatttcccttgtttgtgttaacggggttgcagctactgactggttgtcaataaaattgtccaacttgcaggcgctccacattgacgctatgtctgaagtcgacaacaccacacaatcgcttctttcatttgtgggcaataagagtgttcatggtttatatgacttcttgttgaactacaagtaggttgcttaaaacctttgctgatcatcctattacaatactcccaaaattttctagctgtataacatgttcttgttgttttcaggtcattcttaaattctctatctgccacagatatcccggtgttatattccccggtgccgtttcaaaatggctgcctccatattccagaggtaatttgactcgtttcatttctgtcaacttaaaatttctccctgctatcatatggcaagtttcagtattctcattttttgtaccagttcacttcaagtattttcattaaaacctttctgaaaactatgtgtctaactgtctaaaggttgccctgtacaatagtaaagctgatttagaggtctgatcttctgagcacgcttttgcaggtgaaatgcaaggagatgaggaaggcagatataggcctggtttcaggtgggtttgatgcaggagagcctggatctactttcgcttctttaacgggcaatatctgctatagcatggaaataaaggatcccgtacttcctccatgggttgtttctggaatctgcgctgcaatgagctctgatgcaaatagcttcgatttaatgtacgtgccatcatcttccccgatgcagtttctccacctcttgccatgtgttaaataaatcattctcatttcctctttcaggatggcaacagagccttcgtcgatgggcttaaacgctgccttgagctgcgtaagctcaaattcccagtccaaggcacattcctctgaaggctgtgaatcattgggcatccctgaggccacattggttccctccttgcgatctgcatcttctctgcggcgcctcagctacaaggatggcgagtacatcgcatacacaacggtgtgagctacaacgcaacacctcgaagccatagctgggaagcaagacaagtactcctattccagtcaagtgcagccacttttgatgttctacgactaccaatgggggttctatctggttgagctcctcccgtcaagaagcctcaatgcctcgtccatgagacaagcaaggcaggcaggcagagaagctgttagctgctgctggttttgtggttttttttgcaaggcaatgtgtccagtatctggaatcatctaactgtttttgggtgagcctgtagattatctacaggacaatgagctgctcttgaatggtgcagtaatttatgggattgtacagtgtatttgatgcccttgacagtgcatccttcgatgactgatgggggggggggggggggta

SEQ ID NO: 42959 - DNA, 4771 bp, Oryza sativa
aacttgtaaatattactggatatcattgggctgttcagcgagaaaagcattctccatttgaagcttccatgatcacaaacatcatataaacaatcaaaatcttgttaaaagtttttctcctctttaattaaattgaccaagtttccaagtataaaacggtgaactacattacagaagtagacatgtgtaactaactttaaaaaaacagtgaattactcacgttatatggtcatgcacagcaacgaacatgtgcaagcattgggtccaggcatacatataagtttcacacaattacatggcacattatattaaactacatgctcccattgattttgacgagccacattatatcattgggcatccctgattgcgatctgcatcttctctgcggcgcctcagttacaacgatggcgagtacggatgacagtgtccctctaacttttaagttggaggagctccttcctggcgagtacatcgcatacacaacggtgtgagctgcaatacaacacctcgaagccatagctgggaagcaagacaagtactattcgtgtcaagtgtagccacttttgatgttctacgactacaaatggggccatgggggtcctatctggttgagcccctcccatcaattagcctcaatgcctcgtccatcagacaaggcatgcaggcagagaagctgttagctgctgctggtttagtggttttctgaaaggcaccgtgtcaaatatcatgaaatcgaccggtctgaacatatggatgatttagcccacacaacaaatcaatgcaatgtggcatttgattatttggttagtattcactattcaggtgtatgcattaagtctcatgttatatgtaggtctaatgatatccattgcttcttgataagtactgtcgtaatccaaaaatgtaagacaattggtgttaaagttagaatgttgctgcagttagatgatattgccttcaattttctgaaattactgctatccccatgaactggtttatttggcccactacacaaatcaatgctatttggttaatatttagtaaatacattaagtgtcatgttatatattggtctaatgatatccattgttttatgatattttacaggcgtactccaaaaaagtaagaacattttgtgttgaagaatgttgctgtcgttatgttgcttgggttttgtgaagttggaaaattaagctcctaaatgtttttttgtgtactattgtctttattataccgaagttataatgttcttgaatagggcatacgcagattgaggatttattttcattgagtaacaatatttttattgtacttttgtccacgcataggggagtgtggagttgctattgtgaaattattcaaatccagattagtattacataaggattttacctattcttgatatgtcatgcctaaaattgtaaggaaattgtattgaagagcttccctgtgcagagctcattggtgctggagtttgagcgatggttcttttgctctttgagatgtatgttgccttcgctgctgcaagctaatttttttcttccaaccacaatgataaagaaatagcaatttaattattatgtttttttgtcacttggttttagtgccatctatgaacatatgtctctcttcctccaactctccatggaatcaaactcctcacctgctagccacagctcaaagctggtgcattggttttctccctggtagaaaatacataattttcttattgcattttgttgtttgttgaccactgactaacatctccattgctgccgagaacaacatctaaggtttgcatgtgtactcgcaattcatccttgaaaatgtcttgatcagaagtctggtgtgcatactttcttgcggtatactgatcttaggaatttgattagagttttgatgcatgaaagtaaaagtgagatgaaggtttatgcatgaatatatttggtcatcttaatttgttttcagcattgttaatatgtatgtatgctgtcattttctcctgagaaaaactcgcatagtctcggtcgccatgtatcaagtatagatatatggtttttttttccaacagaagttttgcgtacattttgttcagtgcagttttcttatattctagctacttcttgcatgtacatcttattagcttggtttccctttagcacttgaactgtaattcagtaagaaaataatgccttgatagttattctcttttacttgcagtttcccttctagctgaaattgtgcaaagtttgatcattaattgtttgcattaaaatggtagcaatatcgcattgtataaattgtgcttgacccactaaatacgtttagctttcttggtaaggaagtagtgattcgacagagtccaaattgtcagcttagtatagtctatatgaaattgtcttagtaccataagaatttatgtggagtgcattgcatagaaatgattgcatagattcttctttgtttgctaatatatactgtcaaaacatgtcttgcatgttgtcacgtccagaaattcacgaaccggaatttctaagctgaatgtgcattaaacccctatccgggaccagccatggtacacaaacgataattgctgacacacagatccacgtcttacaaaaataggaaagattacaaatgcagcggaaaagataaaacgagctagacttaaaagcttgactcctgcagcgaggcgactctactccacaggcatccttgacggcagcgacgaaaccaacttcaacaagacaacttcaactgggaagatcttcagctctggcgtgggggaagagagagcaagactgagtactacccactgtactcagcaagtcatactggaagaggaggtatgatgcaggatataaccaaaggaggctaaaggttcatttgcgtaaagtaggcatttaaaacagtagttgaaaacagtaaaacatttgtaataaattaatcaatattaaccaatcaccgctcaacgctacaccacgttgagacaggtccaaaccaccacctgtactaaccagttccattaaactaaactaggggtgagactaatcacggtgaatatgtttgatcgcccataaccacgggcacggctattcgaatagttttactctagccagaggtgtacaactgtacccacaagacacgattccacacatgtcgccaagccccgaagtatcaccatgatactgcaaagggggaaatcgtgacaagaccattcgcataacccgcccctaaccatccacaccacgctaaggtttcacccccacctcctaccccggaggtaggcagcccccttgtgcgtcgcggtgaatccgacagctggacaaccggacaccccggccgacccaactccatcacgcctgccctcgccaccggtgcctaggaaatggtcgagctatactacaagtcaagcagttacccactcccgcttgtggtaagcatggtaagtcttccagggtttcccgtgaaccagtccttaactgccatgggtgcgaccaacaaaaccatgcacccacatcccaccatttagtgtgttttaattaactaacaccattgcagtggcaccaaaccaaagtcatactaaaagctaatgtctacgcattaatgtgattccccatttgtgtactagttgaactaagcttggctaagcatttcctaaaccaatatctagtcattttaatacccaagttatcaatggcataaggtaaacgacatatggctgagtaatatgacccatcccacgtgacattgtaaaataatgcaacatttaatagaaatgcaggacatttataaattgggtacaatatgatcaattgtaatgcatgacttaccttgctctcgcactgatgagaccacaacaacatcttcgaggaaccgcggatcaacgaaacggccgaaatctatgcgacaaacaaagcacacaagcaaaacatgctataagtctactgaaacaggaaataaaaaccattttaaatggattatttgcatttttctcgatttactgagacttgaatggacttaaacggagctcggatgaattagttatgacttttagaatattctctgtgtttttactaataaagaaaacccttatttgatttattgcacaatatatcctagggctgacgtcagcggcggggggttggggggggggggcgacggcgccgacatgcgggcccactggacagtgactcaagggagaggggagggggcgcctggcaaagcgggccccactggcagcggctcaaagggggagagaggggcgccggctggtggctcggcatggctcaagctggtcggccatggtgaggcggcggcgcacggtcggagcggcggtgcggccaaaggtggcggcgcacgtgggacggggagaaaaggagggggagggattcctcatcggcgaactcggaggccggagcggtggatgaaggcggcgatgacggcccgacgagcggaggggcggagggacggcggcgacacctagaggaggggaggagaggggttaggagcggagaggacaaccacgacggcttacatcaccggtcggagatggacaaaaatggagggctcaccggcgaggcgagggaatcggagctccgacggcgattagcgacagccgagcggtggccgaggtagctcacgcgacggcgaagctaacggcagcggttgcacagcgcagcggcgaccctagaagcggtagcgcgcggccggagagtgatggcgcggcggcggtagggggcgcagaaggaagcggcaagagcggaaa

SEQ ID NO: 42960 - DNA, 5032 bp, Oryza sativa
gcgggggatagaggggtgggattcgaaatcgaatcccgcccatttgcggtgcgcgcgcgagcgggaaaagcgaggcgtgggcggcaacgtgggcgtggggcgtggggatgcggagtggggcgtgggagagagcgagcggcggcggttggggcggttgccgccggccgggcgcgggcagctggagcttggggacgacccaacaggtgggccccacctatcggcgtcctagaaaggagggagggggcgcgggccggcctagcaaggagggaggcgcaggaggagggttaggccgacgacccaacaaagggaaaaagaaggaaaggagaaaaaggaaaaagggaaaatgatttccagggatttatattgcggataaatgaattttaattggttaaaattattttcaaggctctgaaaattccactaaaaatttccacgacgctgattccaattattaattgcatttattaattagggaattagctctaggttaatttaaacaatttcttctggcaatttattcaacaaattttaaagcaagacgaaagggataaacttcagggcatgacacacgtgcaccataactaatagattctagttgagaagatggatttttttttctaaaaatatacgtttttttgaccgaaattgcaataatatattgagtagggaaagatttaccaaaatataccgttgccgcgctttggttaagcaagaccgtgatatcgctgaaaggattaacgaaagcgctggcgttgtcactaattgggaaagcgggagtgctaatgcatcggtatcgctcttcaaaagcgtgataccgactcggtctcgcacatgagctacgcgataccgcctgttgtctgacgtagcgcgaggaaaagcggtctcgcactttgttagtgcgagagcgcacttggtatcgcacaaccatagcgcgataccgtagcgacgtggcccaccgtgctaatcacgtgcgtgagcgcctaacggcgtgtggggacggaccggtctcgcacaatgcaagcgcgatatcgcgcgttgtggggcccgcaagagcgaccgcttcggtcttgttctttcaaatcacgagagcgcgtgcagtatcgctcaacgagagcgcgataccgatccactaattgtggttatatttcatgcgaagatggttgatatttcatgtgtgattaagccattgctatggagagtaaacgtttatttcatgatttttttagttatatgtgcaatatatatatatatatatatatatatatacatatatgtatatatatatatatatatatatatatatatatatatatatatatatatatatatatatatactacttcagacaatatacactgttcaaaaacactatttattcggctgaatactattcagtttactgtttattcggctgattactattcaaaaacactattcagtttactgtttaaattactgttcaatactgttcactttcagagatattttaactttaggatctttgcagggtggcgaatcctatttagacagcctcagaagcttgcttcagatgatgtaaagtcctactcggtactcaccgtatgcctcacctatctgtctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttccctttcgggaaacccgaaggtaggtacaagcaagctgttcttaccttacacagcgttataacacaactccttgcttcaatatactatgcaaggtaggctaaagtcactactactaagaacggtggaatggagggtgagagcgcgcttggaagctttgctctgaatggtgtcttcgttgttgtcttcctcagctgggcaggcccctccttttatagaggtcaggggtggcgtcgcctgtgcctcctgcttatctcttcgctactgtggattcacgagagcaggctaaagttgaggcctttcctgccgaaagttttattcttcacagggatatgtcattcaccgcaccctatattgttcctttatgcttatagggtgtccttctggattccttcttctggattccttcttgagtagtcttctgaaatcttcgtttattcttcttccacgcccaaattattgatattctattatcaatatatattgagaaacatatttagcttaaagaattctattcatctggctgcccatgaccaccaagatctatagtgtccagatcagaaaaagaaacttctaatttctcatctactgccttttttatttgttcaaatttctgatccatctcttgttttaattctttaagtatttcctcctttaattccttctttaattgtggggaggcttcttcaaatttttctattattttccaatcaatatattccccatctaatggatccactccttttgttaggcattccttgtatgtgggttttttagaatacccttcttcttttatagtcgttttaatgggtatttctggagtcttctttcctttagcttttttgcatttttgaatatattcttttgcagcaggctctagataataatttattcctagtatttttctagcctggcttaatgcttcatcaatgtctttatatttcttccaagatattcctcccattaatttagcatctatcttttgggccacaatttcttcaaaagatatatagacccctgggagctttccatcaaatacgacatatataggcttctgttggattatttcatgatcttcattagctggcattaataacccgtttattaagtgaaaatattcagagaggctattcaatattgataacatatatcctttttcttcccttttattattgtattggtaccaaaaattatccaagatgcattctttcacttcatctaagattatatggtcttttggcttaaatttatatgaatttggtgggaatattctgagcttgttgtcatctccaaatgtgaagcattcaattccgctgtaattcattgatcttttcatacctgcaattcaggtaaacgagaaagcatgtcaggcaaattattatctttccccttaatatgttcaaatataactttataaccgtttcctgttataatatcttcaaataaaacccatcttctagttgagcttttcttgctatttagctgattatagtacctacaaatggcttcacaatcggttctaaccgtgaattctttaaatcctaagtacaacctaaaggcattgattgcattgattattgccatgatctctctatctgtattattgacagtttttaatttataacttccagaagcatatctacatattttttcttctgatttagcggaaaatttagtaggtctttgctttaatatagcaccccaaccgtattgtgatgcatcagtttcaatgataaagtaactttcttctaatggtaattctagaggttttaattctttcaccttctcttttattagtcttactaatttaatgtcttcagaattaaaatatctctgactattttttcttaatttagcatataacggtcctgctaactttgctaaattattgatgtaatttctggcataatttacaagtcctaagaattgctgtaatttctttttatcattcatagcatcaggaaattgtaaaattttcttagcaatatgttcttgcaaatgaattttgccctctcctatttcatgtccaaggaagttaattttttctttgcatatttccattttctttttggataatattaacccattttgttccacctttctaaagaatatttcaagatgagcaatatgttctttgtaagtccttgagaagactaacaggtcatctatgtagactaatatgaattcttggttttcgttaaatatattctgcattttcctttggaaaattgctggtgcattttttaatcctaatggcataacaagccattcataatgtccttgaggacatgtaaatgcagtccattctatagattcttgtgccatctttacttgccagaatccagctttcaagtcaaattttgagaaatatttactaccttgtattctattaatccattcttgcttatttgcgatattataggcatcttctatagtattatcatttagtcttttataatttatgaccatcctagatttacctctaacttcttctgcatgatttcttactatgaacgctgcagacctatgtggacttctgctttctcttatggctcctagtttcaacagttcttctatatgcatcttaaattcttttatgtctttcggagttgcttctattgggctagtcttaataatatactctgggtttattatattaattttgcactcaatagcatttttttcccaatatttcataggaatttctcctataatttggatatcttctaatctttgaataattttttctatatcccttttagacttaatatccctataccaatttggtgcaaatgcttgtagtcctatgcactctatattggaatttgatatataatagttgtctatattctcactaagctcatattcattaattctttcttcagactcaagattaggtacttctaagaattaatgaatatatatatatatatgtatatatatatatatatacatacatacatacatatatatatatatatatacacatatatacatacatacatatatatatatgtatatatacatatatatacatacatatatacatatatatacatacatacatatatatatatatacatacatatatatacatacatacatatatatatatacatatatatatatatatacacatatatacatatacatatatatatacacat

SEQ ID NO: 42961 - DNA, 10724 bp, Oryza sativa
ccttcaacctctcccagacgcgtcgccctcgtctccacttcatttccacaccgaggaagccagggagagagcttcagctctccctctccacctcttgctcgtcgtcgaccgccaagaaggaggagctcgcattcatcgtcgagccatcgtcatcaccaactctttctcgttccatattcctcacttcatgcctaccactttaccctttgacaccatctcatttcatccattgcagcgacggaaacgccgccgtggcccccggagctctgcgcaccgccgcagccgacatcgtcgtcgttccgaccgctgtagaccaagccgagccgagccatcacgccaacgtcttctccttgaagtcctcttcaaaacccctcaataatcccaggcaatggcgcagcaagtacggagatcggccaccgtcttcttcacctccggtcgccgtcgccattgtcgattccgcctcctccggtgagccattgtccgattcttcgcgtatacactatccctgggacctcactaacctcatggacacacatgcacgctagatcttggagtcttttgagctgtcgccgtcaacccgaaggagtttgccgccgccggacctgttcgcgagctattacggatgaccaagcttcgccaaccttttctagaatctcggtgagcatcctgcagcctataaaacatacatgcatgcatttctttgggtagatcaagtctatagcacgacatgcaccaccacccgaaaacgttttccgcccggactcgccgccggcgttactccgatgtccactaaccgagaaaagtagagggatggaatcgcaataatatgaccttcattttgtcttttggtcgcaccctcaaacgagccaccgtttgtcgctggcaagcttgagatcgagctcggccatggcctgccctgtctctgcccgactggagaggaaggcagggactttgttttgaaaatttgaacaatcatagggttaaatatgaaaacatacaaaccaatgacatgtggatccatggacctaagtgaacttcacatgaagggcctgttcactttgttgccaaaaaaaaaccttactaaattttagcattttggcaactgtgcagctaaaattttggtaacttgtcaaaattttgacagaatttcttatatagttactaaaatttggcagcaaactaaatgtagccatttttttgacaactttaccaaaatttggtaaggttaaaaatggcatcaaagtgaacaggcctaaagtctagggacttctttgaaagatggtaagagactgacagtggaccgcctggagataaaatctgagaatatacaagagagatacctagaacttgtaaaatccatataaaatcaaatatagattattttgagatgattcaaatttcagtgaactcaccagaatatgaactttaaagctatgaaataaaaacttgcactcacggtacaaatttcacctctaaaatttatctaagttaaatcagacataaagcatgcacaaacttataaaatgcatagaaaattaatttcaactcaaattgaagcaaacttagtttctacagatacaccaacatattctctaaaaacaaagtaaaataaaacatatacacactttatatcaaatgcctctaaaactattacctctaaaatgactagttttagataagctgaactttagaagtttatataaaattcatcttagatcctttttgagtaaactcaagttctgtagaatcaccaaaatatttatttacaagttataaaataaaaatatatacttgctgtataataaaagcttctaaatatttatataaggaataaacaacattagagcatacgttaatttgtaaaatgtgtagaaaattcatctttagtccaaatggagtgaaccaaatttctatagaaccagcaaatagtaagcttcaacatagtaaaataaaatatagcaccttttgtacaggttatagctctaatatttaaatagataacctagaagttaatcacctagtaatggttaagcaaaaaaaatgtgtagaggtatttaaaatgtactctagctatgaataaaccaaaacagaacttgttagaccagagaggtcatatttccagccttagttcccaaaaacttagcatacttaactcatataacaatttctaggttggtatgttaagtaactaacatagaacatccctaattataaaatgtgtcgtaaaataatataaactctaaaattatgaactaagattagattagtcaactaaaataatcattttaaacatcactagcaggatggagcaagttatggacctaaatctccaaagccatgtacacatagcggactatatgcctagaacacgttataacttgcaaaatacataaagaattttggaaatacagatgagtcgtataagaaatctctgtaaaaaagacttgcatgataacttgacatgattttctagaaaaatatatattcaagtgaattctcatagtgaactaataataagattaaaatagccttcactcgttgttttttttgcatgctaacttgacatgattttgtaaaaaaatatacattcaagcgaattctcatagtgaaataataataagattaaaatgcggaggggggagacgggtatgtttttttagttactagcaataaaataaaaagcgggtatgtttttttttttaaaaaaaaagcaaagtggggggggggggggtttgggtttaataaaatgcagtgtgagagatcgatccctagtcggctggatgtaatggcaactcacccaccagcatgctaatctggttgttgtgaaatataatgaacagttaataaataatacatagaatggtggaccgggaacgtccggcccgagtccgagtaactcggggaaccgaacccaccaccggttcaactatgtattggagttgtattagctttggtaacatccacaacgtactatttgaagtgtcaagccaaaccaaaactagccctaaaactcaagggtaccccaaattccccatcgccgccgcccccgatccggcgatgccgctgcgcccgccgcccccgcctcagggattcctcaccgcgtatccatccgcagctttccctccggtgaagcggccgcatgaggacgacctcggcgccggtgacgtgctgaccttcaggttccactccctcgccgtcttgaaattattcgaccgcatccgcgagtaccgtctgcacgattaccggtaccaggcaacgcgaggctggtacagctccgggacggcgccggaggatgctcttcttccctgtgcggttgctcgaccaccgaggatgtatgggtgcgtgatcggggtgcagcgcggtcggacggtggaggtcgtcgacacctccgacatcttgctcgacaccgaccccggaaccctcgaccgcgacttgttgaagaagaagctcgagacctgtaagttgttaaaccctagctaggactttgccggtgcttaattgtttgtgttgtgatgtacattgtttggttatgcagacaagaaggcgttccctggcttggccattcttgggtggtactccattgacactcatgtgacgaacaccgatatggaaaccaaccaggctgtgagtatttacagccattcatttaattcaactatatttgttcaactgcttaatctgtcagactgtcatttggcttagtgtttggtcatattatgaagaaatgttgctgttggtatgtgagacgttggtcatattatgaagaaatgcaaacaatttttttcccctaaggttgcattcaaagtttaacattggggataaaatgttcactgactgctgtacgaatgaaaactcaaaaatgttgatgaggttacaggacattgggatatagttttagcatttgcttgagctcttatagaatctgagtaatatttggttttaaacttgtacacggaatgattatggctggtgtaacagccagcaataatagacaattagatatgctatgctgggatgtgcactgttcttaaactttatgtaaagctctagcttgtttgtgtggatggatggaatggttgaaatttggttttagcttgagaatgtattggaaatatttatcaaatgtatgtctgtgtgatctgtgctatacattttgattttactccttgcatgacatttcttcccttgtactatttttatccagttgatggatgctagtggaacaaccttttatcttctattcaatcctgcaatgaacctttccctgaaggatctcccagtgactatttatgaaaaaggtaagtgaagtttgaaatcgttgaatatttcctaccgtgtaaaccaccaagtttagcactcagcttcttatttaattgctatgttcattaacttaactgtttagagcaataaatggttgttgtttagtgatatgaagattaacttttttgtctctgcaatttttcaagtgcactctaccaataggagtcccactccgttaatctttgtccaaggcaaatataaaactgaggttggttttctcccttttgtttgttttgttacaaatgttatgtacttatgtactaaattacaaccttctttgacagactgtagaggcagagaggatatctttagaccatacgtgtcctgtagtttctgatgttagtgtgccacctcttgttggaaaagggtaagtaaaaaaatctttttcctttttctgagatgacttgaatcacttagagataaatgtggggtatacaaaatcacaaacaaaaaaaataaatgctgtaactttggttttgcacttgcaggcaacatgcaaatattatgcagacttctggatttaagctgatgctgtttgaaattccttctggtttcgcgatgtttgaagtttcacaggaactgattgcacgccctaaggtactaaacttgtcctccaccaccctaatttgatgtaaccttaacttgtcctccaccaccctaatttgatgtaaccttatttctcataatcaatttttttttttgcaggacatatgggcacgatttgcttatcaggatgacattacaaatgtacattttacttttttcaatgctaatgtgtttatttctgttctcgatctcttagtttttaggccatattttgatgtgtttcttgccatcctatttgcaggttattgttaccctgggttctattcagatccataacaaatctgttgctagggatattattgttggtcctggtgacgaactgaaagaatttatcctaagcttttgcactcacaactacttaattgttcaagatgtagagcttaaagatgttatcgagaagaaacttgtgagtttatttctatcgattttgctaaatctttgtcgacaaaattctcctttgaaatcacttgatttttccacctccaactggtgttgagattcgtgctaataatgctccaaaaaattaaaggtagcttacccaccaacatcggggcagtaggattcgattcgatataattacaatgtaacttctatagatatgttgataagttactagttcagcgttcttttagtagtgtcatggtttcgagtttttggctgtccacgtagggtgcctgttaatctgaacctggacgttgcttggtagcgtcaagtagtttgtagatatataattcatctattttagtctgaacagtacgctgcttgttgcatgtttggtggttacaaaaatccgggtgatttgattggaaaaaattgtcgagtgctatatagctagtcccatttctataactagttgatacccttgtgctttgctgcgggatatgggatatgtggatgaatgcatattatatattataaaaatggtagataatgaattgacattgcttcatattgagttctgaaaatacaataaaattgtaaatgatatgtcatgtttgcatgatatttataataattgctagtaggtcataatgtggcatacttacatatgatttaaatactttaaataatgattgctaatgggtgatgatgtggcatacatgtttagctttaggagttagtaagcatcaactttataatcagatacttatgggtggatgtgatgatgttttgggatggagggagtaggattcttttgttttttgtggaataatcattgtttacctaatatatcatattcttataatttttcagaatatctattgttactgtaatccaactgttgtcggtgaattgacatggggactgaactatgtcctacataagttgttacctcaagagcaaagtttaactcatgagccttatcttccactaagcaaggcaatgtctaagcagataaaagaatatggattcaaaatctcgccacgagaggtaattctcttttctacgatagtttcattttgattggtgtgacttgaggtctagcaaatatctaaatatctaaatatttcagtggcggatccacaggtgggtggggcttggtgcgcaagccagctccatccctttcctctaattagcgactaacgactctaattaattagccattagatgtataccagtacggcaaagaaactagctgaagcgctcattgtctaaattacgttgcaagtgtgaaatatgctcaccatacaaattgttcataggtatgtgtgaatataatgtatagctgcaaattaaaacgaagaaattataagcaataggttgtcttttgatctaatgtgttttgggtttcatctaataatatttgtttggtatatgttagtttgtttcaatcacataactatttctatacacgagctcctcaatcacacaactattatatatattaattgatgtctcattatttcagattgacagagagttcctaagagctatgagttttttaaattatttggggtatatgtcagagcgttattcactgctgctagatcatttgtttggacaatatcgtaagaataatatgtccgacattgaatttgctaaatcaattgcatctcatcttcattcctctgaggtcagtgggcaataaactgatagttaactgaagatttaatttggttattggctaatatgatttattttctttgatttaatacagggaattgtaccaagagatgagagatacactagagcagagattatggagttcattgacttcataattgcagctcctgaaaacagaagccggacgctatcgttcctgcggcgcatcgaggcagcttctattgatgattctcctccaccgccttcactgccaggagggatgggtgtttcgttgttgaagcgtcttcgtttggattggataactgtttgttgtctaggatgtgcagttgctctttaccctttctaccgcagagtatgaatgactttgttataaaattcactatgttttgaggacaaatacatattctctgacctgcttgattagtaccaaattaatccttaatcaaagaccattttatgtagattgcattttttttattctggccctagtattaattaatttggtgctccaaagcatgatcaccgtttgcattcaggctatatgaacttctaatctgtttttccttgagacggaagatccataaaaagcaaatttgtctcctagtcaatctccacaaatgacaaacaaacagggcaaacgacgtatataaaggagcagcatacatactgtacacaagggacgaatcatcaattaattaaattaaagaaataataattaatcaattgctaatgacgctaattaattaattaattgcgcgagtttgtgaggtcccgaggacttgccgtattgcaccgttgccctccggtggtaaacaatggtatatttatgtcatttctttctaaatgtgtatatacctataaaatcattaaaaaaaggtgtttttttttgaaaagtaggagagatgaacaccaaacaatttgtggctcgtcaaaatcaatgggagcatgtagtttaatataatgtgccatgtaattgtgtgatacttatatgtatgcctggacccaaatgcctgcacatgttcgttgctgtacatgaccatacgagtagatttagtgccataaatatcgatttgaagtttaaagagttgtatgaaaaaaatcgatttttgcatgtgaagcttaagtggtccgcatgtaagaatgctcggacctcttaagagagctgcatgcgaaaatcgatttttacatacggatcttttaaggatcggccttgaagtttgattggcctcccccttccctctccacccgttcaaaatttcaccccaaccttatcttctcctcatctcctctcagtcctctctctctctcacttattaatatggggcaattataaaatttaccactgctttaaattgttattgcaagactgctactagaaaattgcaaaaatgccactataactgtcattcgagtggcatctttgtaaaattgaaaaaaccggtggcaaatttgcaaatacccctaataatattatcccctctcacacacttgctttctctttctctctctctcactcactcacctagaacggcatggctagagatggcaacggggaattcaccatcgagggtcacatccgcgtccccatccccgtggtgttaaaatttcaccgtccccgtccccgcgaatcaccacggggctacatttcacccacccccgtcaccacgcggtgaattaatccccgtggttacccccgtagagagaatcagagaagggacgacagacggtggacggcggatggttggaggtggccggcgaagcgatgacgactagaggcggcgggcggcacgacgaggctggaggcgatggcgccgcgacgagggctggaggcggccggcggcgcgacgaggactggatgcagtcgacggcacgaggatggctggaggcggcgtgctcgtcgggacctcgcacgtgcgagaggatgcggcggcgtgcgcttctggagtggcggtggcgcgcgcgcatcttgagcggcagcgacggctatgtaggcgtcgtggagctttggaggggagagggagatggttgactagggttggaatctctactattataaaaattgaagatgtttttgtctgtactttggtacgtcatccgtgtttgagtcgatttttttaattttgttgttctctactaaaatttacgttgtctattaaaaagaaaaaacagtccgactcaaagaggtaaaaaaagaaaaaaatgtgtccgactcaaaagcgattaaaaaaaaccttctgtcgtcactcgtcagtaaaaatagaaaaaaaaatctagagtccgacttccgtaaaaagtctcgccacgggtattttttccgactttttttttttgcatgcgaaagagtttttttcgcacgcacttacgctcttggtttttttgtccctttttttaatccgatcgcgcctcccgggcgcttttattttttttcttttgtcaatttttttgtcaccggttttttctcccgtgcgattctgttttttctcatctgtttttttaatccgatcattcgccgcacgcctcccgagttgaacctgggcgccgtgccgccaccatatcgattgtgcgttttctcctccaatttgattgcaaaaatcgattcctcattcctccctcatcattttctccattattttccctttcgattcggttttaatttgtcggatttaatctcctttaacaattgcgattcctccctcatcattttttccattattttcccttccgattcggttttaatttgtcggatttaatctcctttaacaattgctgatgatgacggcaatcttcctcgatcatttttatcccaagttttacactatgattttagaaaaaaaaatgaaaagaggagatcgtggatcaaaaaacctcaaccaattttgggtgatcgaaaaagatttggccggatttccggatttgatggggaaacaaagagttttacactctgattttggaaaaagcgggaagagaagatcgagtggattaaaaaccctcaaccaattttaggtgatcgagaaagattcgaccagatttgatggggagatttgctccggcaaccgtacggccacgggactagcaaccgtactgccacggatctatcttcgggagactggcctaaggctaaaatggaaggaaggctattgaccctaaacccaggaaaaattttcattaactttttcaattataatgtatatagcgatcccaatatttcaatttattactcagctcttaatatatcagtaaaaaaacgtctttacccgttacaacgcacggacattttttctagtatatatatatatatatatacatgtggttattgggcttcaatttgttgcgccaaaatgactataaagtctaaaacatgtccctagctactgtgaaatcgggtcactgcggtggacggggacagggagtggtgcaccgtccccacctccgccatccccgatggtgatgggttttagacctttagattccccatggatggtagatatcagccatgccatcccttaatgtgtgaattcaccgcggggaatcagtgatcgggtccccattgccatctctaggcatggcgcggcgggcggcagcggcggcgtggtgggcgacagcgggcgggagcggtagtgggctcgatggcagaggggagctcgacctagagcgatgggcgacgtgcgtggatcggccgcccccacctccctccgtcgtcgccggcgccagatcccccgcgagaaggccggcgg

SEQ ID NO: 42962 - DNA, 9844 bp, Oryza sativa
ggtgacgatgacgacctcgctgacaacaacgaccttggcgacaatgacgacctccggcaacgcggactccagcggcggcggtgggcgagggccaaggtgggggtggacgtgggcgacggcggcggccctcccccacccggatccaccgacggaggcggcgactaaagggcgacgacaacggtgggcggtggatctgccgcggcagccgtggcagcggtggatctgggtggtgcggttgtaccagcagctggcgacggcgatgtcgatgacaggagtagtggcggcggcagcagcgctagtttttttttctttttttctttttggaattttttttcgtgattttttctcttttgcatgcggttgtgatggccgcatgcaaagacggcgattttcgcagacctttttgtgcttgtcgcccgtatgcaaaaacctattttgtagtcgtgtcttaaaacaaatcagataactccatttttcaagtttaaaataattattttttattaattatgcgctaataacttgtcttgttttgtgtgccgttgaaaatcaaaagcaaaacgctggaacgaatgggcccttgtacatgaggtattcttcatttggaatttggtttactagacattttggcgcacaagatgcgccctatcgatattaaaacccaaatgtatcaattcatttagacgaatcgtgtatcaaaacaaaaatgtataaaaaaatattacaaaattctccagtagtgaatgaaattacttatcacatcactgtaacagcaagttgtgcatagacacaatgtcggcggcttaaaatcaaacctgtagttaataaaaattgatcatcacattattgtaacagcaagcaccatgaacatgatctagttgttattacaaataacactgattctcaatgtcacttaggacaactgcttcattataatagtaagcaataacaggatacaaattttggtgcaaaatatataaaatgaattgattctcagcaatgctttgctaattacactaattttgatgctcatgtcaatccaatgaatcttgagtagcaggttgaatttgaagtcaaaagcatagaaataagtctgattggtcgcatcgatgaaatacttccctcattgaattgttgaaatacgaatttgatgtcatgaaagtggatcttattcttgaccatatactgcaagaggcctagtttgtaacttgatgtagcttcagttctaatctagaatctttaaaacaaaggcatcattgttgacctggcaactacctgttaaacaggtatgtttttccaacgtaatcataatgttaattaataagagatgaaagttagaaatggtaggagctagttggaccaaaatttcaaaataagaaaatactccaaaaacatgttaacttaccaaaatttgggaacagaaaaaaattccaggttatgttctaaaagtaaaccaaatcaaagtatcaacagttgcaaatatacgttatgggttgtaatatgcattctaagcctgcagggaaatatgtttcaggccaagactacagtccagactaattgtcactttgtcagcataatgttcctgagacatcaaagtaagcagagcgcacaagtcaggacatcggcgaaatgattctatggagcaggttagatgcagcaaggcaaaaatgagacataagttaggtccacaaaatgtttaccaaatcagttgttatgaacaatgaaatgcaattttctacttggctgttgtataagtacatgcttatcaggtcattacatcgttactgcgtcatctggagaaagaaccaaatttctcctagccatcctaatcagttcatgtgtaacatatcattcgaaatctgggaacacattatgatatatgaaggctgaacggttgcccagatttatattgcaggagttgcaatgccagcttcatttttttttctcattggagaagaaaatgatcagatagcattagaacatcaaccaacacatcctcccatctttgacagttccaattgtgcaacccaaaaaacagtaggatagataataggagttcctgtcatttaacataagataaatcagtagattattagtacttgtttggtgattaaatgtcgcagcacacaacacagcagtggtaggcagccaacctctgctccagcagcacaaggccaagtcttgtagcttgcactgagtgacattttttaccaaatcgattgctccattccagccacaaaccataagagaatcatttgaggtaagggaaagggaagaaagtagacctgacattttttaaccaaataccatcagaccggagtcaaagcacaagcggatccaagcaaaatccactgcctagatgcagtgctcttgagaatgacatcaagaacgaacaagttccaggcagattcactccgccgcagtgaccgccagctatctcctccttgatctgcaacaaagcatcaagacctaatagctcagtcccaagcccatcccaccaacacacacgcaccaaaaagagaaaaagaaaatcatcacctctcttggccagcatcctcgcacgaaccggtgctcttcgcgggcgcggccgccgcttgcttcatatcggttgaaccagaggtcaaatcgggacgaggagaaatcatttccgatccgcaggagaggggcgatggaggaggaaggggactggtcgtcgacggcggagaaaagcgagcgatggccggccgccgccgccgtgagggcaagggagagagcaagaggggaacagcagtcgagtggcagctaggttttgggggaggtggagcctggagggatgttcggtttcgcaaaaagacccctcactttacgcttttcagagcgcactcctgttttctgaattttctcttcttagcataagatatttcatatttaagagggccggagcgtaagaatacatggctgaggaatgtacgtctagggatctataacaaattatgggtaaaatagaggttttttttgaaaaatgaccagatcccacagcccggcgctcgctcgcgaaatctggctaccagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggaacgcccgcggcccacgggccgttcggggcacggcggcccgtgaagcacagtgtttttttttttaaaaaaaaggaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacggacaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcattgatgtggtcacctaccctcttcatgccagtcttaacaatcaaattaattatatgacatgcacaacgctgatggagtagaaaagattgagcatacacacaaaataaaggttgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctgttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccactgccacgtgtcgccttcccgttggaccgccgcccgccctgtcacgcgccgccggcgctttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctactggctacttgggcattcaggggcgacgtggatagcgcggcgatcgaacacgcgactccaaatcgctgtgggagcttcaatcggggggaggtattaatataaccgattgccctgcatctcgtttcatactcaagtcttttttttttcctaggtagaggtaacgaagacgaggagaagggagatggaggagaagaggtggctggaggtgatgaacaagatgatcaggcattcaggccggtctggaggcacaagtcgccggagatgaacatgtactttcagtttctgaatcttactggtttctgaacttagtgcatgttgacgctgaactctccgcacactgcatgatgctcaacttagtactccagggaattgtcacaacttacagtttctgcatgatgctaaaccctgaacttgctcttgcagtatttgtatttactggtttgtcaatttattctgaactttgtagatttgtttgttggccatgaaacttagtactccctccgttttacaatgtaagtcactgtagcatttcccacattcatattgatgttatatatatatatatctaggttcattaacatcaatatgaatgtggaaaatgctagaatgactttttacattgtgaaacggagaaagtagatatgtttcagttacagattctagtgactttacggtttcaccttcagattctagttgacttcacagatgttgaacttgtagatttggccatggaacctagtagatcagtttcacttcagtaaattgttctgcctgctgaatgctttgtgtgagcctcttgttactcagtaaaaggtgttatttttagagatgcacattggggaatagcagagatcttatctgtaacatctgagaaatttgttcatcgtcaattcatattatttactagtttcatcatgactagccacataagtcgtgcgttgcacgactcttaatacctgtttcaaaagtgtgtatatgtgggctgtcacatgtgtaaaagagggaaaggaaagcccatataacagctactatacatggtgggaattatctcaaaatactgcttgattatgaattgttaggatcaatactgacagcaaattcaacatgttgtttgtcagtgttccacaagataaaaaactattctggagaactaaagaatggtagtcaaaatgtatctattgcttttcagcattatacagtgctatattcaaggtgattatgctttaacatactgcttatccagagtcagagctcagtgcaatcattatctacctctttaaatctaatgaatagaagtttacaccatagtaaaagaacatatcgcaagctgttaagcaacagaagtctgaaacatatttcaaggaacatatgtgcagtctccattgcaataaggaactttctttcttacaataaggatgccaaaataatcgtctccattgcaatgtttatattgatccaagaaaacgatcataagcatagcgttttaccgttttcttggatcatcttcgagttttatctggtttctttcttttactgagtgacaagaggctcacacaaagcatatcagcaggcagaacaatttactgaagtaaatagaagtccacataaaaggttaaataacaattgatgatcatgatctctctcagctcttctcgcttgcttgttcggctattggattttccggagtgttcagttcgaggcctcctgaagaatcatgaattttcttaaccatatttgaaccgctgctcaaagatcagaaggctagttttgtatgttagtttgatccaacggctgtaatattttaagtgatgtggctcattgtggtgatgagaaagattagttctctcactactttagacgagcttgggctgcgacggcgctagttttttttttctttttttctttttggaatttttttcgctattttttctctttcgcatgcggttgcgctggccgcatgcaaagaccgtgattttcgcagatctttttgtccatgcggctggcccaaccgcatgcgaaaatgcttgtcgcccgtatgcaaaaacctattttgtagtcgtgccttaaaaaaaatcagataactccatttttcaagtttaaaataattatttttttattaattatgcgctaatagcttgtcttgttttgtgtgccgctgaaaatcaaaatcaaaacgctggaacgaatgggcccttgtactatgagaagatattcttcatagaagatatttcctatatcttaaaataagatgaagaaaaaaattcaaagcaaatatttaacctcttgctagaagaaacttcatggatattttctggttgtggttggttttggatgccacatggcagtaatcgagttgataagtaatactagtaataagagttataagagagaaaatattaagaacattcctagctcgttctcgtcgatagcgttgataggaaataaatagtctcggtgaaaaaggaagagaagatggaaggcgaaggttcggaggacaataagaacagaaaggaaaagctgaccggtaggttgctttcatggtcacttcgagttttatctggtttctttcttatcttcttcctttatttcagaatctcaaaagcgagaacgcgatgtcaaaaattcagtggagacgtatttagaacgttttcaaaagaggcaccccgagatggatgaagaaacggcaaggagggagctaacaaagcttctacaatcaagcttgaagccactctaagataatgacttagagtgacttagcgagagagttgtgtgataagtcttagaaaagcactcgtggattagaaaacatttgttttaaagaatgtgcaatttgaccatcaaagctcaatctatctctactgatgtttatgcggctttgcataatagaaatagctaccaatctatcaagtgtgaatgtgtgatttcctgcacatcttaatttgcaataactaattagacggagtaaacttgtctggaggacatatacctctctgcaacacttgcagattgctatgaaattcaacagtagtaaatactactcctatacttagccagtaataacatagaagacttcaaactgattagaatttctagtagccatctgcgacctgcattatgagaaaaaaaaacctctaagggttgaaattggagcatgcagctcgttcaaattaaaagatggcaaaccatagagggaaggaaaaggtacgaattactccctccaccccccctccccgcgaactatcacggtcgtccaaattacccccctaaaccacaaaaccagacatcgctcaccctcaactttcaataccggacaaattacacccctcgacccaacccagagctgttttggtctacgtgacatacgcgtggcagtctagtcagcattctatcttaaaaaaattgtgcgacccacatgtcatacacttcttcccatcttcctctctctcttctctctctctattccactctctctctctcggcagtcggcatgacagcggcggacggcgcgcacggcggtgcgggcgacggcggtgggcgcgcacggcggtgcgggcgacggtgcgggcgacggtgggcggacggtgcgaacaggcgggcggtggcgaacgaggcggagaggcaggcggctggcggcggacaggcggacgaggcggacgaggtgagcggtggcggagaggcgggaggcggtggataggcggaaaaggtaggcgaggcgagcggcggtagagaggcggacgaggcgggcgaggcgagcggcggcggagagtacgggcggcggcgg

SEQ ID NO: 42963 - DNA, 12932 bp, Oryza sativa
  unsure (1)..(12932): unsure at all n locations
ccgcgacgccgccgtccgccgagcgcccccgtgcgccacgcccgcagccgccgtccgcccccttcgtcaccatccgccgtccgtcgcccgcccctccgtgtctctcgccgccgtcaatccgtgagagacagatgaagagtgagatagagtgagagagagaagagaggaagagtgagagagaggggaaagtggaagagaatgacatgcgggtcccataatttttttattaaaaaacgctgattaggatgccacgtagaccaaaaccaccgcggattgggtcgagggggggtaattcgtccggtttgtatagttgggggtgaagaatatccagttttgtgattcaggagggtaattcggacaactgcgatagttcgggggagagggtaattcatactttttcctagagggaattatcaaagactaaacacaggaaatgcctagttcagaacataataagccataattatacgatgttaaattaaaatgctaagcgaatgatggtgccactatctatatgccactctcccaaaattttttacacaaacaccacaatagagatatttttccctaattagtgtgccatgtcagcaagagtaacttgagatggcctttttgcccctgggtcaaagtaatactactcttctcgttccaggctttttttttttcctacgcaacagtttttggtttccagcagctgtttcatcaagtggccgagcaagcaggcaagcagaagcagcggtttgtgaatgaaacccacgcgccatatgcccatattcatggctgatcctgaactgaattcaatgtgccccacagcttagcactagcttatcatgcatccatcgatccagtcagtggcggagccaacgatgccatcgagcccaagtgacgatgtatatttcttacaacattttacaagtattttcgataattgacaatggcgatctgatgaaaaaaaatcagctttagttgcagcttttctcactaagatattggaactgtaaaaggctttagttagttttttctctcatattatatgaaaccaagggcaaaatggtcattttaagtctctcttgcagacatggcatactaattaggaaaaaaaattctctctcttgtggtgtttgtgtaaaaatttttgggagagtggctaatctagcctcggcaacttaatttggctctattggttgcttctcgctttagagatcccaccggtatcagccaaattgccttgccagattagattagtcaaggcgaatgagagtctattattgctatttgaaaagtgcctagctctttgattgtttagactctaagtttctttacacactttgagatgcatcatccctagtaatgtttagaaccctaaaaactaacctggaactagtcataattagaaatagtatcggggtttcagccgatcttacatgatatgcctgtttctttaattgttacaagtgtatctgccacctatacaggtgggcctcgctataacctcatgtcggaaccggagtactagccggcacgttatcatcttctttgctctgttcttccgttatcggcttatctatataggtgtgtgtcggagtactagccggcacgttatcatcttctttgctctgttcttccgttatcggccgatatcttgcttgcattgtcctgttttacacgtttttattcttataggcagtgctttggccgatagggtgttcttagggcattattgctattatcacttattatatccagtccacagccggcccaatcggttagggactaccaacgatatgctatcggccgatcgactatcggctgactaacctctcccctttctgtttccttgctgatggcaagatcaaatcagctggcacgcccttagcacttgaggcaagccttggacctgcactggagttaagcagatctctcaggccgcgcgtgtttttccatcgacacgtacttaagtgacactcgctctcaagtttaaggaccggcaatgtattttactcgtaatattttttaggatttgttaaaaaaaaagttactaaacattcaattaaacaagacaaaacaccttactttttatttatacttaatatgttacacacattttgtatttaaacaaactaaatctaacttcataatgaagagatcataaatgattgtttatatgtattaaatactatatatttttgaaagctaacaaaaagtttgaaaaaagttatctaagcaatggcaatgaagaaaaattatagagaaacattacttttgaaacatgacaggtgtcatgcagttaatattctgcctatataaaattttcaaacgcaatatttttatataaaaggtaaatttgtgaaaaaattctgagataaatgacaattcatttgttttaagggagtgttcttttcggcccatgggtttttgtagcacgcaaaatgagaaatatgattagcatatgtttaggtaactattaattattaaaatcttggaaaatgggatttgtttggctttttaagcaccttcgtgtatagaaagtttccgcataaacctattgtttaacaatttgcgtgctaacagaaaacgagaaatagctaagctcaattagctctttagaacatgggctaatttgtcatggactaatcgtttgttccagcaccaatcaaactaataagatagtaaaaaaataagtttgcttttcattcgctccatatatgggaacgtaaaagcaataaagactataataccttcacttattgagttccaacataattttatgtatatctcatattttcataactttttgctactggaaatacaaaacaaatgtcttttgagtaaatggttatttaagtttgtcagggttatggataacacatacccaatagtaatcgactaagctcggcagggcccaccacatatcatgtcttatatggaaacaaacatcgtaaatagagggagttccggataagaaaggacaaaatatagttatacatggaaacgataaggactactcggattgtatccgtattggtctccctagttttacatggatagggggtacctataggtataaatacaagccccctaggaggagagggaacaagccacaaggcacaacatagaagccacaagacacaatatagaagccacaagatgcaagccaacacaccccaccagatatcgacattaaagattagtctagacaaacccaatcggccaatccagtacctacggaggctggcaagagggatctagcgccatctcttatgtcgatgagatcatattcgaggaggaagactaccctgtcatcaactacgagttggtgttcatgccgccaagtcgacgacggttagatatgttatcccaattgttgtactatgtggttttctatatcaatcccatataaacaggatgtagggctattacctgtcagctaaggggcccgaatctgtataaaaatccctgtctccatctcttttacctcaatctcgcatataccctggtaccgacgattcccataccatcaaaataccctaatcatgactatcaaacgttgacagtggcgcgccaggtaggggaacttggtgcttcaaggtttcgacgagatgggtttaagagatggattctccaacaacaagctactcgacgacttcggctatggggggatccaacctaaccgaagtgcgttatctggcggaccgggatcctcgccatctcaagcttcatcaaagcagcggacttttcgacgagggatacttcaactactttggacctgggaaatttgacccgaccagagtacattccctgataagatcggaaccatcgtcgttaacaatttgatctatcaagatcatccaagcctcaagatactcgacgtatcgaaagatgtcagattatatgatgtcaaacgagtatgtaacaaggtaattggtagattggttttttaatttaatctactaatttcatagatacatccggcatgtatccacataggtacgcaatactctatatgtgatttatcgtacctattcttcaaatcaatacaatattgtcagatgtatgatttattatgtttacctagagcatatttttatacaatatctacagtgtgagtgtttccagtgttagaccgactacggggctcgctctttcttcttctgtataaatcatgcttgttcatggtttacataatacccaatatttaatcttctcattatatcctgataatactagaagattcatgtagttttttgagtacatactcgatattctctgctatatatcttgtcttctataaaatattcttcaggaacaattgagcagtgagcactcgagtaggatgtggtcgagtacaccccattatcgaaaacgttctcaacaaatgttgagttgtcgcacccaacctaccaatgaagaccgacgacttatctcatatatagcgccagctacggctggattatttgagaaagggttgttaatggataattcctcatgaacgttgtcggcttgatcacccgacatggttgcgaacagacatccggatatgctacaagttgggtatgtgagtcatgctggccacatgagatacacatgtaatcagaaactctagcgcccctccaggtgatatacgcctacacctggtcctcaaccagtagatcgtagcgatctctcaccacctaaaaattcatcttcaggtgatcgagatacgcctacacctggtcctcgaccagtagatcgtagcgatctctcaccacctaaaaattcatctccaggtgatcgagatacgcctatatctggtcctcgaccagtagatcgtagcgatctctcaccacctaaaaattcatctccagctgatcgagatacgcctacacctggtccttgaccagtagatcgtagtgatctctcatcatctaaaaattcatcttcgcgtgatcgagatacgcctactactagtacttgaccagtcggttactgcaatctctcgacatctaacacgacaatcaacattgtcgtgatagtgacaaccaagaccgactagatcgccgttgtcaccaggacgacgtccaagactaacgacatcaggacgacaatggacaaggttaacgacatcacatgacgacgacgaaactcgagatcccagacttctagagggcctgagaacgagttagtaggtcgaggagccaaacctccaactacgataattattccttgtctttgttgtcattaggagacagttcttgcaggtcacgagaacgtcgtcaatccattactctggattcccttcaagtggttgaggtacgactacgactagtcttcgattaacaatgtagtgatcctcgtatcacgacttctaatggtcggggtatgactacggctggttttccaccagcaaagtagcgctcctcgtaccacgacttataatggtcgaggtatgactacgactggtcttcgaccagcaacatagcggtcctcgcaccacgacttctaatggtcaaggtacgactacgactggtcttcgaccagcaactatacaccaggtctttacccggtgtggaagtcatctcatcacttcatatacgtcaacttctgtaagtgtttatatgtgcaatatttgtctggtgatcctcctttcttatatcaccttcgtcttgaagtcagtcctactgtccctttacgatgttctaacaaacctccgagaaacctaagggaatttcggctggggacgcccagagcagataaggtcttgttggattataagagccgaacaaccatgtaaaacctggtcatgtaagaatgctcaatggatgcgtattaaccaagccgtgtaatcggaaattgacttttccaacttcacggccggaggctaggatttgtcaactttagcttggtttgttataagattcaagctgtctttgtggaaaatagtttttccataaaaaacagttgggggctaggaagggtaccaaactccgtttgctgagggaaactctagcgagcgtatttttttattgccgcacatatattcaatttattttcaatttttccatacatattgccctttgagcgttcgctcaggggctatttctatttaatattctgttctgagaattgatttcaggaaagtcagacatcaaaacagtcaagtcagattttcaaggctttgtcgcaaactttgcaccttctcgattactcgagaacggttgatggagcttgacaagtaatatggaatgaagcgatggtgtacccgtcgagatggaatttcttgacttcaatccaaattctcgattacggcaagacaggagacttagtcgcatgctccgtaccttctcggttgacatcggagattaacctagacaaacccaatatagtgcctacaaagactgataagaggaatctagcgttatttctgatcacaccgagaacggtcaagcgagcacgacaatagttattccaaagtcttcgattgagaacatcaactcgttcatttgtattgaagttgggggctactgtcagggttatagataccacatacccaatagtaatcgactaaactcggcagggcccaccacataccatgtcttattatatggaaacaaacctcatacatagagggagttctggataaggaaggacaaatatagttctacatggaaacgataaggactactcggattgtgtccatattggtctccctagttttacttggacaaaggggcacctatgggtataaatacaagccccccaggaggagaggggacaaaccacaagacacaacatagaagccacaagatgcaagccaacacaccctgccagatatcgacatcgcagattagcctagataaacccaatccagtacctacagaggccggcaagagggatctagcaccatctctgatgtcgacgagatcatattcgaggaggaagactaccccctcatcgactgcgagttggtgtttatgccgccaagtcgacgacggtaggataggttatcccaattgttgtagggctattacctgtcagataagggacccgaacctatataaaaatccctgtctccatctcttttacctcaatctcgcatataccctagtaccaacgatccccataccatcaaaatatcctagtcgtgactattaaacatcgacaaagttaataaatgagcaagcggtttggcaggacttattgaagagaaaatatctttataatcagtctataacccaagttgataggaaacaaggtgattctcatttttgtcagatctcatgaaagtcaagagtactttcttaaatatgggttattggattgtgaataatggggaaaaaacaagattttggaaagataggttagggaacttagcttttaaagataagtatccttccttatatactattgtcagaaggaagaactcttcaattgctagagttattggttccgttccgcttaatgtttctcttaggagggcattagttagtcagaatcttgtatcttggcataatttgtgtgcttctattattcatatccagttgaatcaatcttctgattgttttatatggaattataatcagaatggatggttctcggttgggtcaatgtatttagctttgattaataatggctgtatcgagagaaataagataatttggaagcttaagatgccgcttaagattaagatcttcatgtggtacttgcttaaagggatggtattaactaaaaataatttggctagacgtaattggaatggtagtttaaggtgttgtttatgtatgaaaaatgagtctattattatctttgtgcaaagtttatatggatagcagttcaattctcttttggtttataccttcctattagcatatctcatattttttataggtggcttttaggggtggacaggaaaaagagtaaacttctgttggttggagcttctgcaatatgttgggctctgtggttgagtaggaatgatatgatttttgacaaatcattatctatttcatatatgcaggtaattttcaaggcaacatattggctccggtgttgggtacaattacaaaggtatgatgaagatgaagaacttctaaaagttacatgttgtaagctcgagacgacggttatgcaactttttgccaattatgaatggagattctcaaacttcaataaatatgtactccttttcatataagggttattccttttattagtttgttgttttcaatttatttgaattacactagtttcttagtttctagagtggtagtttgtaataattggttgtagctcttttaagcacagaccggatgttatatttcattattaaaaaaaaaacttaaagccagcttattttaggaaaaaggaagaaggctaaaaatgattattatgcgacgaagggaatgccatttgaactcggagtctcggacgatgaaagctactttactgaaacagtaaaagaaaaaaaaagaaagtaaaatcagttaatgaaacaagtactgtagagagagagagagagagagaggaggggaatttcttgcctctcgctcagatccgttcctccggcgaaaagcgacggcgactttgttgacgctgcggcctcttcccgaccgcgcagcaaaggtgaatctcctcccttcctttgttcatcctgcggtttcctctctccctcttggctcttgctctcttctctacggttttgatgtgcgcgtgccctgtggtccatttgggtgattttgaatcgggcacgtttggatccttggcaaaccaaatcctagccttgcttcatctccagcgcagtgccttgtgatccgctgggctgctgccttgtcagatcccgccaacattgcgccgctgttctgccagatcttgccgtcgctgccacattgcgcaaagaagccgaaagcccttccaatctggccggccacatgctgttgcatgaagcaactggcagaagatatttgtgtttggaattttggggatacttcaaccgaatgagcgagctatcgactgtcttggactaatgagagaattaaacacattttttaccctacacattgttttgtgactattaatcttcctcaggcacatttagtttcaggtcttcaaccaaacagaaccaactcagatatgcctcatcaggcaacaaacatcaaaatatcacgaaactctcaggcagcactttttctcaggcatagctcagggtagcaatcaaaatcagtaacgaagtaattttcatgtaggcccatgataagtgataagtttttagatcaaaggctcaccagcccggcttttatagaaagccaaaatggcaacatgtcatcccgataagtgccaagtgcttatacgggtgcttagaaaatgatcaaagttaacttatccttacctggctaagcaaggtgggagaaagatccaaacgtacacatctccctattgctccatatgaaattggagtattttttaaatcttgcctatctttttttccctatctaatatctattgtttgcttacgatgcagatttgaggtcaccaatggatgattcaacggatgacgattcgtatcatccaagaaaacactatgcttatgatcgtcaggtttcttcaagcagatggcgtaccagccgcgagtatatcagaggtcccggccccgaaactcatactactgagagtgctcaagatggacaggatccacctgctggagtatattcctatggttatttttctggcagtggtaatgatcctcaagttcaaggacactttgttccggagattcaaaagtacaacccttacgtgattttcaaaggtgaacaactcccggttcctatatgggaactgccagaggagaaggtccaagattttcatgataggtactttattgcaaaagacaagagtcgagttgaagccaggaagactctgaataggttgttagaggggaacatcaatacaattgaaaggggacatggatataaattcaatattccaaaatatacagataacatggagtttaatgaggaagtcaaggtttctctagcaaaagcaggcaagaccataagccgttccttttgcaatgcgaatcagcgggaagttgcatctaggactggctataccattgatctaatagaacggacacttggggctggattgaacatctcgaagagaactgtcttatacacaaacaaggatctgtttggggatcaaagtaaatcagatcaagcgatcaatgacatctgcgctttgacaaatatcagaaggggctctttgggtataatagcagctgaaaaaggaattgtagttggaaacattttcctggaattgacaaatggcaaatcgattagttgttctattggagtgcagataccacacaggcttgaccagatcaaagatgtttgtgttgaaataggttcacgcaacatagagtatattcttgttgtggaaaagcatacaatgttgaattatctactagagatggactatcacaccaataacaactgtataattctgacaggatgtggcatgccaaccctccaaacaagggatttcctcagattcttgaaacaacgcactggactacctgtctttggactttgtgatccagatcctgaaggtataagtattcttgctacgtatgctagagggtcttgcaattcagcatatgacaatttcaatatttccgtgccatctatttgttgggttggattgtcatcctcagacatgataaagttgaatttgtctgagaccaactactcacgtttgtctcgcgaggacaaaactatgttgaagaacctttggcaggacgatttgtccgatgtatggaaacgcagaatcgaagaaatgataagttttgacaagaaggcctcttttgaagctattcatagtttggggtttgattattttgcaaccaatttgcttccggatatgattaacaaagtacgagaaggctatgttcaggtatatttctcactcctatagcaacttgtattttttttatattactttgaaattcgtgatccatgagcacactttttcttatatatcagtgtatacattctttgctaggttcaagagaaaaaagagcctcaagacactgaagccagtgaggactgatttggaggactctaatgcagctagagattcagatccataagtttctacaagtaaaagttggagcagcagattggaactgcatgttgatttttgtggatgctcaagcttcactcgtatgtttggcttctgataagtctgtaatagcttagcagcacaattattatagttgtcttctaggtgatcgatctcctaaatacttgcaccactattattgtagttgtcttttatgtgatcgatctcctaagtacctttctgtctgtaatagtttagcaacaccattattatagtactagttatcgtctaggtgatcgatctctcctaagtgcttgcactattgttactgaagttgtcttctagcactattggtactgcagttgttttttcgctgatcgaacttctaagtgcggtattattgttaagagtaaattgcaacttgtgccaccttttcttaccactagtaatcatgcacgtgcaatgcacgttttccatgtcacatctaacatcaaccttacattttatggtctccatacgtatacaggatattcattttcatttagtggtgaattaaagttatccagcttcattttatttccattctagctcgaaatgaaaaagaaaaatacaacatattattgcattcaactaataatacaactaacaataaataaatcactaaaacaaagaagaaattaaacctcattttatttccatacaaaatgaagattaaaaagaaattcactcattacaaccaaaacacaagtgcacatggaattctaatgcggcgatgaaattaaaaaaaaaacaaataccctccaaggcatattacttttttcagcgaaaccaaggacaaatcaattcattctgtgtagagacaaaaaaaaattgtatggatacatgcaaccaataagtaataatatggttgcccaggttctaggacatttaagtcttagatgtatgaagaatgcaaatatgcccatcctagttgaaaaaaaaaatcagaaaatgaaatatggatggagggagtacgaccttacaaccgagtgaaatttgaatgagactaatgagtttcggaactaatgagaatataaaattataaatcagtgattatttcttatgactccaaacaaaagttcatcaagatcactttaaattgatcaaatgctttgaattcttcagtttgaactgaatgcttcctgaacttgaacgccaattcatataaatgggacccatgtgaaacatcaatttgcaaaatccataattaaggaacttacttatatttctacaaatattataacttacaaaggttgaaaaaaagttaggaacaggaaaaatagaaatatatagcaaccacatgctttagacttatttagcaaaacaatatgctctagcatattccactttgaatgtcctgcttcacttgggctgcagagaagtgaaaaaggtatattaaaaactattaaaagatggtttgaccataattacacaaataaaaaggctaaggcatggatcaacattaatccgttcctttgagtttagcttcagtggtgttttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42964 - DNA, 15027 bp, Oryza sativa
ccaatgaaaagctttttttatagtaaccctgaacatagcgagatttcatcaacatcataggttcttgtagatgttgcacatgccccagtggtgatatgtccgatattcagacaggcacttaagtttctgcacagcctgactcggtggctatcttgcatcgtctcgtcctggttctcgggctggcgcaggccggcaaccaaacgggcttctgcatggcctcatacgaaccagacctgatgtagacaaatccaacataaccataataggcaccgagctgcaagtagccatccaactgtagattgtctgatgagtgatgatggtattcagaaaatgctccaaaacttcatgatcaaatgactcatcaaacatgtcgttttataaagttcaagttcggagtgattccacacacgcaatctatgtgtgaaagcaactgctgaaaatcacagaaccaagtgaaagctgaagaacttttacgctatgcagtaatgtagacactcttaaggcctcatgttttgctttggcaaaatttgtttttaccatgatcacacttcccaaactgttaatgtttttttcataaaaaaattatgtagaaggttctttaaaaataaccaattttcaagtttgtaataatctattgtattataagaccgtcttgaatccctagcacatggtagccgtgacactgagagctgctgctaggtcactactccatggcgatagactgttgttgcggctacgacaacacatcctggtggttgcgagtggttggaaggtgagagaggaggaagaggaaacgggaagagaggagagagtagagagaggcgatgaagatgatgaggcggaagtcgctgacatgtgggtcccacctatcacgtcaactgaaaccgtttcccaaaccagcagagaaggcagttcgcaccagtttttaagttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcgggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagtctcctcttctaatattacttatttttttaattccaaatttccactgtttctaaattgtatttctatatagactctgccttttctttttctccgattaatgtgagaatttctaggctatgagagtgaatgtggaggctcctttttattctaaattttagttagttttaaattccaatatggactctatactctatttctaatattccttattttttaattccaaatttctatttttttttcttaattatatttctatatgtactctatactttacttctaatatttcttatttttaattccgaatttctattatttcctaattgtatttctatatggactctatactctacttctaatattccttattttttaattctgaatttcaactatttctaaattgtatttctatatggactttagtctcctcttctaatattccttattttttaattccgaatttcagctatttctaaattgtattttgatgtggactctgctttttctttttctccgattaatgtgagaatttctaggctatgagagcaaacgtggaggctcctttttctattcctttaataatataatagattgtgttcaacatttaaccgttatcttatttaaaatttttatttaaaaattttatgagaaaattttaaaaacaaatagtcacgtataaactactatttatattttatcatctaataacaacaaaaaaactaatcataaaaaaattaaataagacgaacggttaaacattggatatgaaccgtgtaaaattatacttattttggaacggagagagtataactcaatctaaaaaagacagattcttgctacgaatctagacacgtatgtgatcagattcatattaaggattatgtctttttctttttggaaaggagaggtagactaccttaattagatgaaatttagtactattaattatactccatatttatacaacaaccagtgactcatcaattatcgcggtggagaaaattcctatcttttttcttggagtaggattaggatgtaccactacgtcttcctcgccgccgttgcgctcctcgccgtcgtcggctacggggtcaagaaccgacgccgtcgaagcgccaagctcccgccatcgccgccgtcggtcccgtttctcggccacctgcatctcttgggcccgctcctgcaccgctcgttgcacgagctgcacctccggtacggcaccgacggcggcctgctcctcctgcagctcgggcggcgccggacgctggtcgtgtccacggcggccgccgcggcggacctgtacaggaaccacgacctcgccttcgcctcccgcccgctcgtcgcggcggcgcacaagctgtcgtacggctccaagaacatcaccttcgcgccgttcggggagcagtggcgccgggcgaagaagacggccgtcgtccacgccctctcgccgcggcgcgtcgaggcgttcgcgcccgtgcgggccgccgaggcggcggcgctcgtcgccgcgacccgccgcgccgccgatgccgcggcggacgggggcgccgtggagctgagggacctcctgtacagctataccaacgcggtggtgacgcgcgcggcgaccggcgccgcgggcacgacggcggagaagctgaagcagctgctcgggaacgccacgtcgctggtggccggggtccaggccgacgacctgctgccgggcatggcggcgaaggcggtgaggtgggctacggggctcgagaagcagtatgacgcctcgatggaggagtgggacaagttcctctcgccgataatggcggagcacgcggagaagaagaagaagaagcgagaggacatcggagcaggggaggaggatttcatagacgtcttgctgcgtctgaaagaagaagacaccgagctcacggacactcacgtcaagagccgcgtcgtggtgatgatctaagctatcaaatcattctcatccaaactactctctcaacaaattttcatcaaattaatctctcgattcttgcgtttaaaattctgcaggatttgatcgccgccgcaaccgagacgacgtcggtgacgctggaatggaccatggcggagctcgcggcgaacccgcgggtgatggcgaagctgcaggaagagatcgctcgagcgaccggcgggaagccggccatcacggaggcggaggtgggcggcatggagtacatgaaggcggtggtgaaggaggtgctccggctgcacccgccggccccgatcctcgtcccgcacgagtcgacggcggcggcggccgtgcaggggtacgagatcccggcgaggacgtcgctgttcgtcaacgcgtgggcgatcgggagggaccccgcggcgtggggctcgccggaggagttccggccggagcggttcttggccggcggaccggcggtggacttccgggggaacgactaccagctcgtcccgttcggcgccggccggcggatctgccccggcatcagcttcgccgtgccggtgctggagatggcgctggtcgccctcctgcaccacttcgactgggagctccccgccggcatgcgcgcggcggagctggacatgagcgaggcgcccgggctgaccacgccgctgcgcgtcccgctccgccttgtccccaagcgcaaggcgccgcttgcctagacatatttacaaacgaaatgtaattggtgaataaaacttgggtatagctatatttattacgctatatttttcatcaaaaaatagtcggcatgtatttacattgtaagtccctaaattacatatgtaattttagtgtatttataatgtaagtctcaaaattacatatgtaagcactaaaattacatatgtaaattcgaaaattacatatgtaagtggggtgtaaatgaggtgtaactactgtgtaagtggctgaaaaaaatcgactgtagcatatggcgccatatttctagcaactccgataaaacttttatatacgtgttcttaacaattaaaagaaaggtaaattggaaccatgtcattataattttgtgaagtttgaaatatgccatcggtatctcaatgacatgtaggacccacatgagtcaataacatgtgggtcaagatggtatatcttaatttttacaatattataatggcatggttccaatttttctaaaaataaaggcggaaaaataagcttcgatgaaaaatctttaaaatcggtttcaaatttaaagttaaaaattaaaaatttgactgataaatgtaagcctacgcgaaaagatagtttgttgtcgtgggctcgtcgtccgtgctgctagtcgtagatgcattgtatctggtcagtgacacggggatcagtcgtagtagtatgctgctacgagtgtttctcatctgctctgatcagagtggtgcaatgtactcctactccattgttgtatctgacctcattgtcagcaaatttgtcgatggatggaacacgaacaaatgaccacaaaattgttggaattgttgtcgttgaagcaccgttgttacaaatccgccgccgcggccgccgtggacacgaccagcgtccgccgccgcccgagctgcaggcggagcaggaggaggagcaggccgccgtcggtgccgtaccggaggtgcagctcgtgcaacgagcggtgccggagcgggcccaagagatgcaggtggccgagaaacggaaccgacggcgactgttcttgaccccgtagccgacgacggcgaagagcgcaacggcggcgaggaagacgtagtgatacatactacttcaagcaaaaggatttggatttttctccacctcgagaattgatgattcagataattgtgagctgcaacgatatcgtgtagatatgctttctccgtcagaaaatgttgcaatttatttcctccgttttacaatgtaaatctttctagcattaactacattaatatagatgctaatgaatctagatacatatgaatatggataatattagaaagtcttacaatataaaacggaggaagaattttacatattctaaaaaaatctggacagaatttgtttaggatagatctaaatctcatcctaaatacaacattttgagacagaagaagtagtgtgctcctgtgttggtaacttggtatcggtagctgcgaattgggatcagagaagacaagtcggctcatgagcctgcttgacagcgatttttcagacaaggaaatatcaggtccggtagatcaacgtctggtcgatccgagctctgatgtccccgtcttccttgctcctgctggtagccttgggcaataatgtgcacgtagtctttgtttgagagctgcataatgtggcgccaaatttagttttctctctctcaaaatttagtacagaaacacacacttatatacacgtacacacactcatatgtaaagacacatatgcatattatttttttgaacatctccaaaaaaatattttaacatatattgagattgaaatcattgtaggtgtttcaatgtcgactcataacactccgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatgtggaaaatggcaaggctgacaatgctgatggtgttccggaagtgaatgtagttgccattagtagagataatagtgcggaaaatgaggctgctgcagctggtgatgatggcgcagatgaagagggcattcagatgaatgtgctaaacacaactagaggtgagggtgaagaagatgatgaggctgctcaaaatgttgttgaatatgctgttgatggtacagaagaactggaaactataggcctgactggagatgataaggcggaaaaagaagctgccccagctggtaacaatagtgcagatgaggagggcatgcagatggatgcggttaccacaactggagctgaagatgaagatggcaaggctgatgaaaatgttgttgaagatgatgatggtgtttcagaagaagctgtggctgacacagttggtgaggatatccctgaagaagatgcagtgcagatagatgaggacgaggatgatgatgacgtgcctccaccattgacaaggaaaggcggggggcgccggaagcgaggtcgtgcatcttccaaggctcaggttgtggtgaaaccacctgttaggaagaaggatgatgaggaagtttgcttcatttgctttgatggtggtgaccttgttgtgtgtgatcgtaggttcgttaatgacatggaatttcattctttccatatcccaaagtatattgctatgttacaattattaatggttatttctatgtcctcatactcaggggttgtcctaaggcttaccacccttcttgtgttaatcgggatgacgagttcttcaaatcgaagggtcgttggaattgtggtatgtgggacttagtctgaacaactcgcagtgcccttgcttagttacttagatggtttactttggaatgtggatatgagtattcatacttcatttcatcaaaatccatgatttttatgggtcatatttgcattgaacctactctttttacatgcagatagtgggatgccggtaaaatataaatataatagctgatttaaatttttttccattttgtcctgttatatcatatttatttgtttattgttctttactttgaaaactgaagcttgtgaaatctgtgtaatactgagtaaaaattgctggagataaatgatgctggactgtttctctgataatgatgagatttgtgcttagtccacagataatatcttccttttttttttgattttgttcaatctgcatcattttcccagggtggcatatttgtagcaactgccagaaacctgccttccatatgtgttacacatgtacctattccttatgcaaaaaatgcataaaagagacaaaattcgtctctgttaggggaaacaaaggcttctgtgagacatgcatgaatactgtgatgttgatagagaacaaggaggaggctactgagcaaatggtaatatttcctctgtttcttggcttaccttaatctatctattgtatttctatagtatcatccagtatctttgatcttttcatcattttttagtttctgtatatcatttgtgacaccattttatccttttgtcattctctctcatctaagaaacttaggtggtgtttgaaactcatgaagatgaagataaagttggtgcacgtaaaacgagataactattagcacatgattaattaagttttaattattacaaacttgacaaatggatatatgtgatattttaaagcaacttccatatagaaagttttcgcatggaacataccgttcagtagtttgaaaagcgtgctaacggaaatcgaggtaatatcttaattcataagaaaagaacagggcaaggcgtaacaagttttcgagatattcatgctcaataatcattttgttaagatgtaggccctatgtatcttggaactgttaatttgcacttgatttgtctatttgattagtaaactcaaatgagctaaccaacctgctgcctgcaggattcaaaaggtgtaacaagaactattttctgaatgatgttgtccaagcattgcagcttgctaaattgttttcacgaaatggcatttccataacttccaccaacaccttctatgcgctatgtctatgttgtacacacctatgatcattattgagatacagagttgtactgatttcagtactcacttacttattaatcaacatcaatattcttaatttgtcttctcatttcccgttgtgctttgctccataccttgccaaagtgttaacctagtatacttgtacaaatttgcttaacaggatgtagattttgacgacaaaacaagctggtggtatttgttcaaggattattggttgaatttgaaaacaaaattaccattgacgtttgaagaaatatcagcagccaagtctcaaaagaatggttcttctttggttattcgtgacaatgatctcagtgaaccacatgatacaaatgatgaagaagagggtaattcagacagctcatctgtgcgccatctagaaggcaattcaaagaggaaaggaaggaagcgatcaaagcaagctgctaacgatgacagttctgtagttaaagatagcactaggaaatctacaaagcgaggcctgacaggtggccgtgatactaaaagttctacagggagaaaggttagaaaattgtccaagcgtgctttgagcagtgaccatcgaccaagagaatctgaaagcgtagggacatctacatcgtcagctgaagagaccagttgggcttcgaaggagctcttggattttgtagcaaatatgaaaaatggtgacaaatctgtgctgtcccaatttgaagtccaatcccttttacttgattatattaaacgtgaaaacctccgggatcctcgcaggaaaagtcagataatttgtgattctatgctcaaaagcctttttgggaaagcacgtgttggtcattttgagatgctgaagcttcttgaatcccatttcctcatgagcgaggtctcgccagttgaaattgatgacaaccatggtggtgttgtagaccctgatcctagtctggatgctgatggcaacagtgaagcatcaatggtgatgagctcagaaaaaaggaaaaaatctcgcaagtatgaccagaaagctctgcaaacaaaccttgacgactacgcagcaatagataaccataacatcagtttaatgtacctgcgtcgcaacctgttagaagaattgatcagtgaagttgacacatttgatgagaaagttcttgggtcatttgtgagaataagaatatctggaacaggtcaaaggcaagacatctaccggctcgtgcaaattgttggtaagataagacactttcaagctaatctggctggttttagcttcatgatgctgactttcccatatctgtgtgcaggcacaggaatagcgccagaacaatataaatgtgggaaaaagtcgactgatataacactggagattctaaacttagacaagagagaggttattactattgatataacctcaaaccaagagttcactgaggtattatcattttcagcacaggcacttttactgtttgcttactgtttaccgcaacttggtagagttaacacttgcaagcttatatttttctaactgtgtctatagttttatttcctttcactttgtatactgttagtaataaatttgacacaacctgatcatgttactttagattatgtgtacaagcattctctcaacaagcaaatctgctgctttcttttgttcacatgatgttcatttcctgattcactgttgcttttcttgttctaggaggaatgcaaacgcttacggcaaagcataaagtgtggattcattccaaggctgacagtggtaatgttattagttattattacacaacgttatatgtgcagtttttttggcatatgtgcacagtttcgctgtttctaaactatcttaccattcagggagaggtttatgagaaagcaaaggttctacaatctctcaaagtcaacgatgtaagcaattagcactgaatggatgctcagagttttctatatagtacatctatcatttcttaattcattattgcctattgcaaaaattgcagtggattgaaagtgaaaaatgcggcttgggcatcttcgtgaccgtgcaagcgatatgggccgtagaaaagaatatccttcttcatgtcattcttttatatctatcaatatttatttatccttatatttctttaagtcttcactatgggattttaatcatatcgtgctggcaaaaaataagtatattatattacgcaagtattcacaaatccagtggcattatttttgtataaaactcgttcatgcacttttatgcatattattacttaattaattttgcaatggcctatatctatgtggacaagtccttgttaaatgaaaatttagcttgtttgtcttaaccagtatttacgcttagagaatgtgtagagaagctgaagcttctaagtacccctgaagagcgtgttcgtaggctgaatgaagaacctgaagttcatgctgaccataccatggatccagattatgaatctccagaggaacaagagcaggatactggaagaagtacttgattttattttgcttccgccccataatattcattttcgatccatgcgtgctcatctgacatcactcccttttttctattgtacaggcagcttcaataagtcaagaggatctttctctaagaaagataataatcctgtatctccaggtaaaggagagggtaggagtcctgcacaaagagatttaaaaaccaactgggagtctaatcgaaacacatggggcgaatccagtacacatatcgagtcaccccttggacgcagacctgcattttcgtctcacggtgaaagtgctggttacacaagtaaatcagatagcccaaacatcggtacacacgcagttaaagtgggagctactgcaggtaatgctccacatggtctatctggtgtttcatctgaaactttaggagccaatatagggtcagggggaacacatgcatcacagtcagttattaatgagtctgaaaaaatctggcagtacatggatcctaccggtaaaatccagggtcctttctcaatagtgcagttgcggaaatggaatggcagtgggtacttccctccgaatttaaaaatatggaagtctactgagaagcaagatgattcaatattattgacagatgctttgctcgggaggtttgagaaagacctaccgccgtgggaaccgccagttggaagcagttcagatgttgatggtaggccccgtaatgattcccttcttgaggaaggaacaagagctggagaacaaccttcaaaatcagcagttctaagtagcacacagtctttctcaggaagggctggtcagggaaacgatgcggcaaatcttggaccagccactatccaatctagtacacaaggttattatggaatgcaaaactctcaagcagcgtatgcagtccaacaatctcttagtggaagttggaacgcctcaagtcagtttggaactgcaataaatcctgtgacactttctcagcctgccatgggtagctttgtagttggacaaaatgcagctttaggaagtgcaggtcagctaactcctgtaccaggtcctgcgacagtgagtgcagaagtagttaattcacagttgcagtcccagaaccagatagcatcttttttatcacaaagtgatggcagattagctgatggaaacgattcaaagttgggggaagatgcttcgcgtgaaaggatgaggtcatcgggtgaaggtaggctctttgcgaaggtttatatcgttcaatgtattgaggaaacaaatacttaatatataaaaaaaatgtacaccgtttctttaatgaatggtaataggctgagaattataaaatcgccgcgaagaagtatttcaatatggcctaaacattcttttttggttcttcacagatcttggactatctggtgcacaacctggaggggtgcaatcaaatactcaacaacttgaaggtattgctcaatgcttgttcattgtttatgccattgtcttctcttttactgtattagcatctgttgtttcacaaaggaagcttttaatcccgaagcaacttttgttcaatgaaaattatggtttaaatacctaatgaaactgatggcattacctgcagatgcaaggaaccagttacaaactgatgcttccaactcggtaaagccatctcagctgatatcaacaccatctgctgaagcagtgcagccctcgtccacagccatggctggtggtgataatcaaaacactgcttgggcacaattggcaagcacatctggccaatctcagcctcaggcggctggaaatatgacctggggagctactctccagggtaatgcaaacatgggctggggaatggttggacagaacaacatgaacatgtcttggggaggaacagcacaaagtgccacaggctacaacatgggtttggctatgcaagcacagccaaatgcagttccaaacatgggctgggttacaccaaatcctggaaacaccaatatgaatatgatgtgggcaactcaaggccaaggcactccaaatgcagcagcaatggtgggaactcagatgcaaggagttgcaatggctccatggggggccattgcacaaggaaatacaaattcttatcctggttgggggggccaagttggaaacatgaaccaaaatgttggatggggtgctcccatgcaggttaatccaggtcccagtactggaaatgggacaggccaagataataacaatatgaactggaattcaccaagcgggaacccaaattggaataaccagcagcgagacaatggaggcaggcattctgggcatggtggtgattttaatggcggtgactctggtgggaggtcttggaggtcgcagtcaggtggtgatggagggtcgtggaggcctaaaaggggagtctgctattctatactcgacaagggatactgcaagaatggtgagcactgcaacttttcccattcaataccgaatgatggatatccatcaagaaacagtcggcacttcgataggcaaaattcaggtaacgagagacggtacgacaggcaaaacgagaggactgatcggcagtttgatcggcaatcgtcaggcaacgagaggcgtgatgacaggcacaacggcaggga

SEQ ID NO: 42965 - DNA, 2185 bp, Oryza sativa
  unsure (1)..(2185): unsure at all n locations
tcctcccttttgttgtagttcctcagtagacatccatatcacatatgcatgtttctgaacttggtgcattgtagcgagttgcatctcctcagaattgtcatgtagaacagttgtagttataaatcatgtgcatcctacccttctgtttcttgcttcggaacaagcagtaatacattctgaataaatcctggtgtcaggtaggaaatgggtactaaagcaccccccctggtgatatgctccaaccttttactgtgctggatgtatgcttgttgtacacagtaattctgtctcatgtagcctgttgattgtcctgcttcttttctgtattgagattcttgtatcagttctgggattgtaggccatttcaaatcttctgtttgttctgcttgcaacctggcgtttcagatttttttttggtgctgtttatcaggtcttgattctgatataattttcacttctgtgtatgtacatggtcttgttaaggagtataaatggaaaccataattcgacttttgccagaattgagaattggtaacaaccatttgatttttttttatgaattattcgtaccgattcgatcaattgaaaccaacgccgtgtttagtactaaaataattctaaaagctttcaacttttttatcacatcaaaacttttctatacacataaatttctaactttttcgttacatcgtttcaattttaaccaaacttctaattttggtgtgaactaaacacagcccaattgtgacaagtatcacggcaacctgaaattaatcctacagtacaaatcaaaattttaaaaatccaaagaagtaacgtaactactcgtgaattgtcttgatcctctgacctgactggtgggccctctagtcggcgggtacgattcgggaacccaatcgccgaggttggcgggcccacatgtcagccagcgcaggggaggacaaaatttgacgacgaaatctcttcgtcacggggagtcgagaggagaggagaggagagaggaaaagagagcgcgatatgggggaggaatcgccggcggccggcggtggcgcggcggcggcggcggccggaaaaccatcgggcacggcgcttccgaggagggggaaatcctgcaagggctgcctctactactcgtccatgctcagatcccgcggattcaaccccgtctgcgtggggatcccgcgctccatcccccaaggtaaaacgaaacgaaccctaatctccccccccccccccccaaaaaaaaaaaatcgcagcgcgcgatcgatcggcgtgcgggttttcaatccatcggcaaaaattgtctctatcgatttctggtggttcgggttcagattgatcggagaatctcacgaaactgttgttgtttggttcggtgctccagtcccaagctacgtggtggacgagcccagagaagaggcggcggcgcaggggcatgatttgaggcagttcaagtacgcctgcgctggttactccatgtttgtggtggataacaaagacggccgaagcggcgagaaggagggcaagacgttgttgccatattgccaggggcttgaggttggtttccatctcgtagttattaattacagtatggaatctcaattcttttcgtcgatgttgatatgaggttggtttccatctcgtagctgcagtatgaaatccttagttctctccattgatgttgattggtaatcacaaacatattaatgccaatgaggcaatgacttattatgtaggtagtgaatcacaaaacacgtgatcataggaatctcctacaagaaggaattagagtagtagatgttgatcatactatcttccatgatctttgcattagttttaagacttatatcaaatctcaacattttttttatttcagacaaaaatctatgtttgcctaagcactgtaactaaatgtgatagacctatcttacgattttcgtgtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42966 - DNA, 17966 bp, Oryza sativa
atcacaaacatcatataatccatccaacatattcattcgcaaaactcataacccattcacaaattaaactctcaattcattaataaatcacaatttcatcacaaagagggagatcacatagaggagcacgaaaaaaaaatccatgaccagtgagagctgagctagatatggatctagatcgtcgaagaaggagtgagggaggtcggtggggagggggggaggggccgaagcttgatctggatcctccttgtcgccctacattaggtgtgcaataatctacaacttgttgttttgttatgcttaatacacgtgaaatgagaagctacccattgcaacctgatcaaccaatcaaattgttctgcatctagggatgagccaaaccgggttcatcggaggagtagtaagccccggtgcctcggccatatctagatcttgcacgtccatgccatcagggagctcccaatcgaagtggtacaacaagctagcgatcaccatctccaatcctggcaatgctaagatgatgccagggcacaacctccggccagccccaaatggtatgaacttatagtcgttgcccctgaaatccactgcactgcccataaaccgctctggtctaaactcatccggtgtgtcccacgccgcagggtccctcccgatcgcccacacgttgatgaaggcgatggtcttggccggaatgtggtagccttggatggtggtcggcatcgttgagtggtgtgggatgagaagcggcgctggtgggtgtagccggagtacctccttgatgactgcttttaggtagtccaatttggttaggtcctcttctgtgacggttggtttggagccagtgacttgtatgatctcgttttgtagcttggacatcacctgcgtgtttcgaatcagctccgtcatgatccattctagggtcacgaacgaggtatcggtagctgcacccataatgtcctgcaaaaagattaaaaagaattttgtattcagtttgaatttagaaaaaaaagacccttttttacctataaggtatcagaagtagattctctcacgttactattcactgtgactaccacatgttagccaccaaatcagtgggaagttacgtcaaaggatctcaatcctaaggtatcaacagctgcaccaaaacgtcggttcccaaacatttgttttccttaccaatcggggaaaaatatgacttttttattgtgcccgtaagtatcaacatctacaccaaaaatttgtaaactaaatgaaagtctaagatttgccatgttattatgataaagttcttactcctagtaataaagaatttactcacggttaaatttgaaaataaaatttttacttacagttttattactcgtgctgacgtagataatcttatgctttcaaattttacgatagttttcagttttgcactgtatatttcccccataatcctttacctgccacgtgggtttatcgccagtagcggaaagaaacaactcactatattgacttttaaaaattttaaattttagtaaaatttgttcggtctttctctcatccctacatatggcattcaaaaccctgggtttttgtaaaacaaaactcggacattcgatgctggacaatggatatatcttcaaaaaatggtggatttttttcgttaccttgataatagccttgacgttatcctccgcgagctcgaggccgccggcggcggcggcgccttgtctcctcagtcgcaggagcacgtcgacgaagtcctcctcctcgccctccgccttctcgtcgtcgtgcgccgccaggatctcgcccaggaacctgtccgactcgtcggccatgtcgtctagcttcttgttcaggcccgtcagcttcctcgccgcccaccccgccgcctccggcagccggtccacccactggaacccggcgagcagctccgacgtgtccgccatcatcttcctgaacctctccgccgtcgcgccgctgccgccggccgccacgcgggtgatgaccccgttcgtgtaggcgtacaggagctccctgagctggacggcccgcgccgcctccgcggcgcggcgagcgcgggcgacgagcgcggcggcctcggcggcgcgggcgggcgcggcgaggggagaggaggtgcgccacggccagcttcttggtgcggcgccacgcgtcgccgagcggcgcgaagaacatgttgcgcccgccgtagaagagcctctcggcgctgtgcgacggcggccgggaggcgaaggcgaggtcgtggcccctgtacaggtcggcggcggcggccgccgtggacacgaccagcgcccccgcacggcccaggcggaggaacatgaggcccccgtcgctgccgtagcggcggtgcagggcgtccaacgagcggtgcgggagctccccgacgaggtggaggtggccgacgaacggaagcgacggcggcgacggcggaagcttcccctttccaagattcttgatcgcggcgacgacgacgacgacgaacacgagcaacgctgcggcgacgacgacgtacgatgacatcttggtggattttgccacaaaggtttggatttttactctgaatagcttggtgcttataaatcaatcagagcacaatgcattccatgtccttgtaaccaatcaacacggtggctggtggtggctatcagatcgattgcgagtctggaatattctatgatagatgttttttttttctccaaattggatttttatagaaccacatgtttgatgaactcttttgccatgtagttggggatattttctgaagatcatcataaatcatctccagttggatggctgctttctggctatagtgcacgtatgtttgtgagttgtgtcaggttgatctagaattacattcagaaatacatgtcaaatatttgcgttatcaagcaccagcattttgtgctgtgaagttccaaaatactctgtactgtttacagtcaaacacctttcttataatttttcaggtaagagaacctttcatataaaacacaaagtacaggtttcttcaataccacctgtattagtgcagtaaaattgcactttgacacatccacacaaaattcagtgcaaacccaaaaacagaagagaaaagaagagaacatgggaagaagctctcattattgtatagacccccatgcttttcaatccaatcctatgaataggcagtgccatcttaacacaaacctacttcttacattttcccctatttataacttctgtccctcatctatatctagatgccaaattattcaatctcaatgcctgacatggccttggcctggatcaggattgccaacaaggtaagcaagaactcctaccaatggagcattgatgtaggtagttggttcagatttcctgaaatcggcacggtcatcctcataaacatcatcctccccaggccccccaacaactgcgccaattaacgggtttgggttcgggctagatgaattgtagtaaggcgtgccgtcgttgcacgcaatgcgctggggatggctcttgatcgaaggcaacgatgatcctcgatggtgtatccgttgaggataccgatcgccgtacccgaccatgtatgacattttcatcgggttatctcctaatatataatcagcctgcaaataagtaaataagtacaatataatgttcagagtttagttagtcaatgttcctgcatttcatatttggatgttatgtaggacaattcagtagtcgctccctccaatataattacttttggatcttgacataatctttgtgatgctactttgacaaaaagttattttaaataaaaagagttgcatattatgacagtttgtttaatgataagtctagtaacatcattcttacataatcagtttataatcttttttattaataattaaagtttaacatgcttgacttagcattatttcaaaagttagttatattttgggatggaggtactacctgctttctggctagctgctgaagagtggcaggaccaaccgaaacatttccacagttgacagtgcgcgaggaattggagaggtacttggcataagtcaggagcaggaacgaaatggatgtaacatgctgcatgttgctgcctccaggcttgtagatcatgcccccgggcgtgtacgtgatgtgcggagacgacgactccggaatcagtgtgcagatgaatccatctgcaaactccttgtaggattgcagagatagcacctcgccatctatgaactcctgtaaccaaatttggaacccattttctctttgtgtcagctactgatgtttctctgaatttgttgcagctgcagaaggtgtgttcagaaactggaggagattgatggaggcaaaccttggagacaaggacattgatgccggcatgcttgttgtcccagccgaattcgttggtgctatcctctgctccaagggtcttgccgttgttctgaatgtagtcgaggtaggtgccttccttggaggctctccgtagccatgctgctccccacagcagctcatcctgccaagaattttcagtcgtgtgaactttgagatttttattcacccccccccccccaaaacaaaaaaaaaaaaaactatgtgatcaattatgagcttctgatggttgtgaagttctaattctggagttcgtaacaacagcatttgacgggttcagttttttttttccagaaatactagaaaacgctattaccgttgtaacggtttagtttatgtttgatggataaggtatcaggtttgatacctctgtgtatcatgtatttgtgtaccagatatggaacgtaatagattatgatgacatcagcattgtaactatatactagaactcgagtatcattttttttagagaagggtttttacccggcctttacatccaatcggatatatgcaaccgattatgatgacatcagcattgtaactatttactagaactcgagtatcatttttttagagaagggtttttactcggcctctacatccaatcggatatatgcactcattttatattaggaacttagcctatcaaataagaaacttagcccttaaataactcaatctgaaattcgttcatatggagatttgaactcaagaccttggggtgctactcagatcaatacaaccactaggctacatgccctttcgcaactcgagcatcatgtcacactgttctccggccaacttgtttttcaggtgaaatgacggcttcagtttcacatatgcctattccatgaaaccatgtcgcaacagttgcttttgccccaaagctcataaatagattagccctgtgaacaacctgaatttgtggagtttcagaaatagaaactttaatgttcccggactagataattgtttaccccttcattttggaaagaaattatcgtgtattcctagtttaatatccctgtaaaatagcatttacatgtacaatggttatcaatagtggtctcttagcgttgctaattaggaatacttgttgacgtggaagaaagaggagagacaaaacattgttgtcatgcataacaacggcttaacaacgactcttaatcactacaatatggaaatatggttgcatgagggtaaaaaaatagaaagaatattaataaaataaatattttttgagttaatgattagagtttttatcgtttcaactgttgtaaagatacggtctctaaataatcttatattgtttaagaaactatactcgtctctaccattgaatatgcccttctttcttttttttttccttgaccttacctactggaattctcatgctaaacttataaagacgtgcaatgtcagctggtactccatgaagcaaggcaccaaagctgctttgtttcttctgaacagtttatttatcgtttatttttatatgcgagagatatctaagcagcgtttcagttttgatgccaactactgaattgccagagcagcagctagcattgcagcaacagcatgcaaagctttttgtttctagtgacaaattaaagcagcaaaacacaaaaaaactgaagaaatttaagaacaagacaagaattaccctgacctgatatccatcgaagtcgcagtagaacgggcagccgccggccctgagctccgggtcgtcgctgtacgcgcccttgtgttcgtccgcgaactcgaacgcgctcctggcgccggcgagcagccgcgcggcgtacgccgggtcgtcgtcgcggaacaccatcgacgccgcggccagcgccgccgccgtctccccggccacgtccgaccccggcctcgccgcgctgatgttgtacaccgtcctcgctgtgtccatgtcctccggccgctcccagcacccgtggtccttcgttgggtcgcccacctgcattgccatcgacgccgcgctcacatggtcgtcgccgtcgacgaggaagacgacggtgcgcagtgcaatgtgtttgtgtgtgtgcttgcctgaatgaagatgacgccggggtgggagatggtcttgaggaggtagtcggtggcccagcggacggcgtcggcggcgtgggcgcgctccgcgggcggcatggcgtcgccgaactcgacgacgccccacgccagcatcgtggcggtgaacgccatcgggaagccgaacttgacgttgtcgccggcgtcgtagtacccgccctccaggtcgacgcccgccgcgccgccgtccgacaccgccgagtcccctcgccacgccgcgcgctgccccgccgccggcagccgccccgaccgctgcccctcgaagaacaggatcgacttggccagcgcgtcgccgtagtcatgccccgccgccgccgccgccgccgacggcgccgcgagcgccagtagcaagcagcagcacactagcaggacacgcacgcgcgagcggcggcggcgcacgggagccgagaggagcgccatgtcgtcgaacactcgccgcctcactagagcatgcacgtgacgtgagcacactgagatagctatagctctcgtggggcttcgtatttatagcacgcattcttcactagccagcaaacggcaagcttagctcacggctggattatggctccagatatatacgtaattaacacagatactatattctgatatgcaattatgtacgggatttttatatagagaaataataaatgctttactaaattcgtctcaaaatataaattggaaatatatgtatatgtctagatatatatatgactaaaagttagaaatatatatgtctaaatacatagtaagaaattattacatttccaaatatatgtgtccagatacagaatgagaggcaaagtgagtgtaactcaactgactatgtttctagaggtggaaactgtctatccaactgttcaaattttatatctgacataggtgctcgcatttacagctattttttaaagaaaaatggtaactgacgtttctattgacaacaaatcgtctgtagtgagtagtgacttcatgaatcttaaaatttatcggaccaatatttgaaagcgctcacagggatagggcgtacgtgttgtgtgctcatatgagtggtgagcgtgcacatgcttatataagtgtatgcgttttgtactttgtttttttttaaaaatggaacaagaagtagttgtatcttcggatgggggtacaagttatgctgatatgtcctaattattactcccttcgtattataatgtatgacaccattgacttttcgaacaacgtttgaccattcgtcttatttaaattttttgtgcaaatataaaatatttatgtcatgcttaaagaataaatatgataaatcaagtcacgataaaataaatgataattacataaattttttaataaggtgaatgtttaagcattaataaaaagttaacggtttcatacattaggaggaagtagtacaattttggagggtaattagagagaggttatggtgggacaaaatgtaggggtcacgggagcggtggtaagacagaggtgaggccaaaggtatgttttgatgggttacacgggcaggcagacattcagaaacaccttctgtgctcggtgtggtgtggtcacatgcagcggttacccaagagcatgagagaaacaacaaggccactagaatgatacgtagcactaggacccaagatgtaagatccacgagtaggctgtgttctaaagttctcatggatgactgagtttatcgcaattatttgagggcagagatgcaaaagaattaaatattagaaagttaaacaatcaattttataaagttatctaagaaatactctctccgtactcataaaggaagtcgtttaggacaatgtttaagtcaaacattggaaatataaatcatgaataactcttaaggtgttgagtttaaaaatgtaaaaattatatgaatagatttgtcttgaaaaatactttcataaaagtatacatatatcatttttcaataaatatttttatagaaataaggagttaaagttgtgtttagagaccgtatcgctgtctaaaacaacttcctttactagtatgaagggagtactggtttaggagtttcagtaaatgtgcccgtgatgatttataatatgtaaaaaaaaaaaggaatgtgtcctgaattcccagttattgatagggattatgatttttctactagtaagagaaactgaaccggttgatcccggttactaattatctcgtcggttgatgaaagctgagcagaaaaaggaaagcattgatagtatttattccgaaatggtaaccagatagtgctctttttttggggaaaccagataatgctcttaacgctgatacttgctggttggatatccctttttgacagattttaatactccgtccatttcaaaataagacacaatcaccttacaaaggctaaagacaatctccctagtttagatcaccctaataaatattttctctgttttaggttatgagactttctagcattgcccatattcatatagatcaatagatgtctagattcattaacatctatatgaatgtggtcaacgctagaaagtattataacctaaaacggaggtagtataatacatgcacccaatataattagagatcttaaaagtagagaattttaaaagataataatttagtggagaagatgggctaattaattgcatttgtgtatgcacaccttatattataaaacatcttgaaaaaaaattgagttgtgcattatattatggaattgagggagtattgtatagggaaatcatctttttaaatgtgcacatcaagaaatttaagactaaataaaaaaaatgcaaatacttattagtccagttattacttggagaaatgagtatacctccagataaattatttaagactaaatcaatttcaaggatcaaaatcagtgcacatacgtatctggcgaccgatacactcaactgcaacaacgccctcttcatgccaatctagcaagaggacaacacaaaattctcctgtgatctgcctgaaagacagcatgttctcttcatttctctttctctctcattgtttgagacatgtcaaaaaaagccaaaatgtggcgaatctatgtgatcgagaccagtgactctaagtgagaagcttgagcaccgaccatactgatgcgtacagtttgctgtgtttccctggaaaaaaaggaagctgttattgattatcaacttttggattggtgagtcccctccggttcagagtttgaggctggtgtagaatggaaatgtgaagcaacaaatttgagagaattgctgtggatggggactcctgtctgttccatttaggaatgtgatgtgagcttcctgtgcagcacgcaaactgaattttgggagcattcagcaattttttgttccaaatataattatgtgtagtactaaataacttcaaaattatttccatatatattactcttaacgaatttggtcctttgctcctgagctaatggtagtaagatgcgcgcttcccgatgcaaaaagccagatttgcaatgcatgtctttttggttgattcatctaggggtggaacttcaaccaatattgtgaaaaaaaaaatgaaagttcccacattgttttgccaattttaggcgtacattcgtaaatcagttagatgaagtgtacattattactactcagcagggtttacaaaaaccaataaaaaccagtcggtttccctaaaaactaaatctccctggcttggctcgggaacacaaattaaaccgcttggttttccattcaagtttaacaaaaaaatatatattcaaactggattttaaatattttacaaaatttgatcatatttcatcggcagtcaacaaattttaaacggttttcacaaaataataataataataagcattgatccggtttttgtgagtggttttcccgctactcaatactactactagtagtataaacttcagagacctcgtactccaagtccaacctgcttgaaacctccattttgctcctcctgtaagctacccagtgagcagaggaatcacatgataggtctccttggacggatcaaatcaatcttcctccttttcattatacatttgaggccacagaaaaagatggcatgcaaaagcaacgatccgttgcactttctgctgcatactgtccctgttccattcttcagttacactgatctaaacctttttgcagaagtgatgaagtagtagtttttcagagttgtgtctctggcaagtgacaagacgataatctgtcgctaagtatctgtgaccgtggctagctgtagatggtgaagtttcaacaagttctcctgattttaaaaaatgttttagttttatagataatctgacccttgatttaaaagatgctatatccacctattataataattgtaaatcttcatctgaatttggcgaaaatttgtggattaaaacttgatgatacgaagtgattaatgtctcactcggattaacctgaacaataaataagatccaaagttgagcttagatacacttcggtgtgcacactgcagaaagtcaggaggacctgtaaatcgttagattgcaggatgcactttctcaaggaagatcacacaattttgcgagacatcatgcgtggcccggatttttctttcttcgacaagttgtgggcttgtggcagctctttgcgtgcgagagtccaaagcttaagatcccgataatgatgatgatcaagagcaaagccgaaaagaggttatgcgttcttcagatatcttcagagaggaaaaaaaggaatagtgcatgtattggaaggaatagtgatcgatcgattgataggtccagcagattaaaatgttgaaaagttttacactgtcacagatcatatagtcgatggcaccgacagagacatcacaggtccccttattttttaaattctctggagggaaggttctcttattatttccatataatttaaataattatatttttttgcaagaatttaataacataaactaatcgtaatacatcactccataaatatataaatttaattatgacttttacaagtcgagaacaaaagcaaatatgattttgaatatgcacatatactactccacgtttaatttgtttttttttacaatatcaagaggttgaatttaaatttacatgtttgagaggtgaattcatcatggcatgctgtgaataggggtgaaaacgagccgagccttgcagtggctcgcaacaaactagacttggatcggctcgacttagttagggaaacaagctaaaacttgagcttggctcgggtcgtttcttggctcaagccagctcaagctggcttgcaagtattcttgtcgaaacacctcttcatatatattttataattattaaaaaatgcaagaataaatcattaacatgtaaaatttaaataagtttatatatatatatatattcaattcttcaaaatcttaatgataaatttcaatttgataaataataacgccacaaaagataaaataatcgatataaatacatgatggcctaggctcgcgagccaaaacaagcggctagcgagctagctcggctcggctcatttcagcaacgagctgaaaaggaggcttgggcttggctcgtttggtttacgagccgagccgagccaaccaagctcgagccaagcctgagctgagctcacaagcctgagtttttttttccacccctagctgtgaacaagaccgcatgtccgcaccacgtggtgctgaaggggatccaacggctgcgagtgcgtcgcaaagtcgaatgggccgcaccgctgaaatcccgttccggcccaatttaagtaggcccacacgtaagtaggcctaatttaagctagatgggccacatgtacatcggaatcccaatccgtcccaaaccgtaacgggccgcatgtacttggcaaccacgttacagcccaatatggataggtcggggttccactgtggcccaaacgtatcggtcctgatgtgcgtggcaattttttttcctagaatgactgaaggaggtcaatcaatgtgattaagattgaagaaaaaaaggttacctgaaaagttttacatcggcagctggctgtcgataaaggaagtgcaccagagcacacaccccgaaccatgtgacaaccgcccaaacacacgttacagagagggaagccgagtactgaactgaccgtcgcactgtgcatggaaattgtattgacccattttgtattggcccgattttgatgttagagtattaaattttgggggttttgatggtttcaccattccggcagatgatgtcaatgagggtcggagttttaatctccgaaccccttgggccttggctaatgtctgctgcatgtccgtttgttcctacctttggggtcatgcaggtttcccgttcaattctcaattaagacactctgaagtgaagtgcttgtatgagacgatcatgccaaaatcttcaccttgattcttttgatgcatccaaaagaataactaatttgaggtgaaatcctcctcctggaatggcttaaatttacagcaccgaaacccatcttgttcaaaacattattctccgaatccccttgatcagtattatttgggatgaaattctaatcttcgaccaccctttgctgctgctgtatcatcgtcatgccagcagcagaatccggttgtctgtcatggctagcagctgtagatcagtaggcagtagatgataccagcagcaatctttggaagagttaacaggattaaaatcagaagaaattgttcgaccagtaaatcaaagtcagtaacgaggaggagtttgcgaaggagacgagcctgtacgaaccctctttgcaggaagagggaatatgctctgaatcatctcctgctaaacttcatggacaaactattttgtttcagcaatcgccttctccatcagagaagaaaaatgaataattacgcgtgcatgggatgggtgatcgatcgattgatacgtccagcagattgaatgttcagtaattttcgttcgtgtaatgtttttgtttcaacaaatcgattacacaatcatcgcagcttgcgctcttgtcgattttttttatattttttgtgagaagggtatttttgcccagcctctatatccaatcggatatatacaacctttttaaattaagaacttatcctatcgaacatgaaacttagctctcaaataatccaatctgaaattcgctcttataaagatttgaactcagaaccttggggtgctactgagatcaactttcactcttgtcgattataaagaaggattaggcatgtaaaacattgtaaattttggccttttaaacgggaggaagcagagagcgctcgaggacaattcgcgcctgcaacctgcgcatctttccccgcctccgctcgtactcacaaaccctggctaccactgcagtcatcgctagcacgagcaggcccccaaccaccgcgttcttgccgtcgccgtggtggtgttcgccggcggagaggatgccagccacgcccaggcacaggagcagcgcgcccacgacgacgtcgaacgccgcgaacgccatggcacccttggaccaggcgaaccccgagctcgggcgggacgtcgtcccggcggcggcgatgtccgccgcgatcttgtcgccgccgcgctcgtccagctgccccgacgccaccagcctccgccgccactccggcggcatcgccccggccgcgaacgccgcctcgatctcgtcgtcctcgaagatgttgctgctgctcatgacgatgacgatggtgagagatgctgctgctaaggtttggttgcgatacctccgccgcgaccgggttggaatatatgataactccgtgctgccagatcgaactcgggctcggactcgttacaactcagaaaggaaatgagatacttctactccggcaaggctagtaggctacagagattaatgggcaaaataagggcatgttcagattgtagccaaaataaattttatcaagttttaacaatatcaaaattttgataagatggcaatattgcctaaattttggcagaatttcttatatattaatcaaatttggcaacaaactaaatgtagagcatgttcactttgatgttattttcaaccttaccagctaaaattttggcaagaaactaaatatagccacttttttagcaactttaccaaaatttggtaagtttgaaaatgacatcaaagtgaacaggcttgtaaacattttttttgccaactttaccaaaaaaaaaatggtatagtagaaaatggcatcaaagtaaacatgccctaaacctaaccaaattttggctatgtcaaaattttgataagatggcaatattaccaaaaatttagcatgatttcttatgtaattatcaaatttggcaataaactaaacttagacattttttttagcaaatttgctaaaaaaatggtatggtttaaaatggtatcaaagtgaacaggccctaaatgccacgagaaatcttgcacatcttcgtatagaatttcagtctttcgcagtgaatgatccctgacgatgtcatttccatttcgaagatgtcgaaatgtcgatcaataggatttaggctctatttgattcagcttagaattattgtaatctgaattattaggagtaagctgaaacaaatagatagcttattatgatagattattacaatctataagccaaattactataatctggtaagccactataaaggtgctttttctagattattggatggctaacaactaacaaacagctaataatccagataaacaaacagctaacagcttattctatgtcgacttattataattcagcttatagtaatctaattctataatttagattataataatattaagctgaaacaaacagggccttaaatgccaaactcccttcgtttgtttgtgttcgtccagtgatcgcgggtgtaatccggagtctgacactgatacagcgtcatggccgtcagagctcgacgaggatggcaatggcggaggcagcggcagagctgacgaacgctttggaatatggaggggtggtgccgtggtaggtttctccgacgagcaccgcaccgagcacgtcgtgtcgtgggtgaccgatcgagacggagaaactccaatcgaggagcatatgtgccctctttgcacgaagaggggaatatactctgaatcatcttgctaattttcatcgccaaactgttctgtttgagcaatggcttctccattgtcaagatcaaagtcgaaattaaagaggttatacgttgttcagatatcttcagaggagcaaaaagaattgtgcgtgcatgggaagggtgattcacccttgcaaatttactcagggcgatcgattagcagaataagtttttagtaattttacattgttcacagatcagacaggagatcagatcacaagttgccgcttctagccttctacaccactgttttgttttgtttcagcaaggccgatttcagagttcagaagaggtgcagtgtgaaggaggtttcagaaattcagagttaagcctgatatagcatttgcactttgctgttctactcctattttgctatcggtggatttctgtagtcgctcgctgttctgctgttatctgtatcggatatttagatgacgagctagcactgtgcactcggcaaatgggacaaagctgtccttggattgatttttcctttttaagcagcaggtctctgccatgtccaacttcggcagaattggaaatgcaaactgctaccttctgaagaaaagagaagtatttctttggaagagtttacagtattaaattcagacaaagtattcgttcatcaacgaagaggaatttacaaggagatagccctgcgctctttgcaggaacgaagagggggataatctgaactgtcctgctaattttcatcgctaaattgtttcgtttcgtttcgtttcaacgacggcttattcatatgaagagaggtgcaatgcaacgtgggggaggtttcagagttaaagagtgatatactgcttggtaagagacaaagaccgagattggttccaacaaataagtatctggcattgactaagttttactgcttgacatcactgatggctggatcacaacatcatgttgtaaagttcatagtgcattccaagtccaagatccgagagaattgatgcttgttctaacatacttatctattttgtcaaatgggcatgctcaagtatcatacaccgacaagtcgacagcagcaggtcatgagaaatctaacacatcttcatataggcaggaggtccaaggaggcatatccttttgggaaaggaagaagaaaggatcaaactagtgcactatttatccgagaagatgcctcgttacaactcatcacacctccatgttcatgaatactgatgcactaattacaagtaatatgtcctaattgcttattcttctccttcaacagccggtaggccttccttgaaccatgtgtagagtcctccatccagatggaacacattcttgtaaccattcaggaccaacaagtaagctgctatcagggacctgccaaaatgaaacagatgagatgagttagctatgttccagaggcacaaacatagtcacctttgtaaaacaacataaaattcagagctaaggtgaagaaaggagtgtgggcagacaacaagtttatagttttacatgaaatgaaacaatacagatgttgggcaaacggggtaaattggaactcagatgaacgaatagtataatccccttctagtttgcatatggcactcggatgaactaccgctcagcaacatggtagaaatttcaagctggtaatatcattcaactgggaaacattgttgacaaaagaaatgtgaaacaaaaccaccagtagaaagaaacgaaagatatccatactacaaaataaaattccaccaattaagagatgatcatgacactacagaaataccttatgcaaatattaggaagaatatcaatgccacaatatgatagacccatttctgatttcaaggaatacagaaaagaaaaaaaacctcatttgcgacagtggtattaagagactgtatcagcgctttcgtgtcagttagaacatgaatgttaattggtaaaaattgaatcaagtttactgataaagaatactaaggtaacatggcatacctcgattgcttcccatcaggaaagttctgtgttggtttcaatgttcctcctgtcgaacatgccacaataatctttgcatctttaccaagtttctcatcaacaccttcgtaaagataatatatgtcactgattgtaaactcatactccctccgttttttaatagatgacgccgttgactttttctcacatgtttgaccattcgtcttattcaaaaattttatgcaaatatataagatataaatcacacttaaagtactatgaatgataaaacaactcataacaaaataaattataattacataaattttttgagggctgcagg

SEQ ID NO: 42967 - DNA, 53496 bp, Oryza sativa
cctgcagccctaaattttttgaataagacgaatggtcaaacatgtgagaaaaagtcaacggcgtcatctattaaaaaacggaggtagtatatgagtaaccatgaagcagaaaacagaataaactaccatactttgtatgaactcaggattctcttctgttccagaaaatatgccaaagaatgcaaatgctgcccgtcttgcaatatcccatgctgtccattcctttatcaatctatatatttgcacattaacggcaccaggtggatgagcctgcataagaatgaacccatatgatggcatttgcaacaaaatctaatgaatctaagtatcaaacaccacatagtatgacagcaacaaagtttgagatacacttgcacatcattggaaataattttgttaacaaaattatatccatttttcaccgactgcagacctttttttctcttccaaacaaaattactcctatttctcagacactctaaaattgcgtaaagtcagaacctttggttcaatatacgatatttctaagggaataaatgccacaaaagattataattacatattaatgtaaagcgtaacctcaagttattgtgttaaacctaagagctgcattatggtgcaaaaaccgaagataagtggagaacaattacaacattacctctttaaagtccgctactggcctgacatcaagaattgcaaaattgttttccttctgaagacgcagtgcttccttcacatcaacactacggacctgcaaaaccaaacaacagaaggaattctaatgtaaatggaagccgcttagcagagaaggctccccacgggtaattaacatatgaaatcaacaaacccagggaaaacaagtccataattccaaaacagagcaatatgacatggaatctatggcttatctactcatatatgtgcaatacacactctctgaagaactaaaaccaggtattcagtaagatacttcatatatggagttgataacaaaatagctaacatttggaaatggcaggaaattaggaattacccgcttttctactagcacttgcctcttgatcttccattcttcttcagctgtatataaaaataaaaaaaaatacagcaaattaatatcatgcccagagaattactagctgctccaaaccaagaaaatggagagcgtattcgcagtacctggtgactttgcaggctttgtggcagtacaggttatctgcagcgagcgcacagctcgtgtccggcagagttttgcagcctctataggacgccaggagtagccagatgtgaagtctgagcaggaggatatccttgatgagcaaggaaggttgctgttcactacagagctagctgcaagcattgtggtcatgagaaaaaaggagcagaaagaactatggaggactctgagagaattagaagaggggtttgcctctaacacctaaggatggatcctgtaactgagaagatttttttttctggatggggaaacgtccaaagaactcaatggttttggatgggaggtgccagcatatctgaactggtggtggaggttgagctagtgttgtgatagacaatctggattctgaacttgtagcttagcctgaccccacaacaccaacaatctagacaggaacacttaagagctgcactttttttccatgacataatttatgatgcttgactaaaagtaaatatactaggatgtgcaaataaagaaaaatagaggatactacagcgacataatttatgtaaaatccaaccttttctgaatgatataaaaatctggcttttattggtactcagaagttaccacctacaaatgggaatcctaagatgcccaaacatgatgttctcaaaatcgacctgacaactaaacaagagtacaccagaggcccctggaaaatggaaccacttagacctctcaatctgaattcagaagacaaacaaaagacaccatcaccacagttccttgatcatcttcagctcaactctgctcagtgctcactcactccagtacccgtcgtcttccttgtccttcttttcatcgtcctcctcgccttcctcctcgccgatttccatcactgcctccttgaaccgcttgacatcctccaacgccgccttccggaacatcccaatgtccactgcaccagacaccatgtggtaacccctcagcttgagctgctctgccgggtcgttcggcatggcgaatccgcctagatatgcgacattgccatctgaagctgtcacattcttcttcctggcatccaacaccttcttctcggcctccctcagcctggctcgcaccttcctgttccctgggtcccacaggtaccccatgctggctgacaagtcgagcggtcccatctggacgacgtcgacgccgtcgacggcggcaatggcgtcgacctccgcaatgccagcggcggtctcgacctggcagatgattagcgtctcgtcctcgcagcgggagaggtaggagtcgtcgaggccgtacgcggaggcgcggacgatggggtgggcggcgccgcgaacgcctcggggcgggtagcggcagtgcgacacggcggcggccgcggcggcgggggactcgacggcggggaccatgaggcccgcggggccgaggtcgagggccttcttggcccagatggggccggcctcggggaggcggatgacggctggggtacgggcggcgtcgagggcgcggaggcaggccagcgcctcgggaacgccgccggggccgtgctccatgtcgacgacgacgtagtcgtagccggcgagggcggcgagctcggcgagcgtgggggagaaggagaggaggaagagcccgtacagggtctccccggcggcgagccgggacttgagggagggtgcggcgtagaggaggtcggaggcggcggcggcggcggagatgggccgctgcccgcgccgccgcggcaaggggagcagggcgggggcgcggcgggaggggagaggcgcggggtctggcttgcgcgcgaggaggaggtgggagagggaggcggtggcggaggcggaggcggaggcggccatggcgcgcgaggcgagccggcgcggcggcggagaggtttggggatctgcggcgagtgagtcccagtcagtgtggggggacagcgtgaggcagtgacgtggcgttgctgcttcacgtgtcgctttgccacgggccttattgggcctcgcccactgacgttggtgggctctggcccgtctactttgtaaggcccaggaattgtatataacttaacttttaaattggaataagttcactttaaatcaccgccgagttcgattttcgttgttgtcctacaaccgtataataccagatataatgagattcaaagaagtatactgtatgtttttggctcacgtggcgagtgggttatgtttttggctgacgtggcgagtgggcctcacgtcaggcctatttattcttcctccaatctcctctctttttccatctcctattctccaaacctcctctctctcatccgttccacatcactgataggggagggcggatgtggccaacggcgggccgccatcgtcctagacaacactatatgcaccgcatcgccgtcattgtcgatgccctctgcatcgccaacctcctcttcactggacttgccctggatgctgccccaacaaccccgattgcacaaccactgggcggcatacgcctagctatagttgaggcaacattagctccatcaattatccccgcggcaaggctcctccggtgagaaggtgtccttctcatcatcgtaccccccaccatgtagaagtcttggtgcatgtcaaactcactaagcttgagcatgtgcttcatgccaaaactatttgctgacatgtcgaggctgttggatccatgctccaccatcgggaagaggttcagtcatcctaggatagggatgaccgctgacgagtgcatcgacgcaacgttccactcccagtggaggaagtcagtgctccgatacaccaaagcagagccagtggcaatgaccttgacatttgttcttcgatccaccccaacaaccccacatggcaccgcgcttggctgaccatcatggagacctcggatgtcattaggcctagggcagtgaccgcacactcaaggccacaaatggcatgggtgtaggtgacgatgaggtcagagaacatagcagtgaagcgcgcgtatgtgtagtcaaccgtcggtggcccaaccagagccatcttagatggtggttgtcaacgtagaagatgacggtggtgcgggtccaagagatgtgtaggagtgcgtggcgacgatggggtcgtcgaaggggaggaggtaccgaagtagtgttccttgcagctgcaagtgcggtgctgccgtcgcctccgtccctcccttagccgatgatgggaaatggaggagagagatgggaaatggggaatataggagatatagagggaggggaggttggaggaagaagacatatgcctgacatatggggcccactcgccgtgtgagccaaaaccggggaaccatactgcttgggaccttgggtacaccagttttgcacatgtcatatctggtattgctgttcaagaaaaaaaaatcgaacttggcgaaagacgagggaccttgaacttattcctttcaaatttcgttgtggatcagaaatttggtgggccttatccggattccagcccagcaaatgatgggccccgcagtggagagaccgtggcccaaacatcatcgcctctcgccgtcgtctcgtctcttcctctgcggctgaactagtcgccgatccagaggccgtcgtccactcgcggtcccaccggccaccgcctccgccgcctctcaccggcgccaccgctgctctgcctccaccgcgttcctcctctccacaagcctcggtcgcccagtacgcatcccatccgtcgccgtcgacctagctgcctggtggaggtggaggcgagggggattgactcggctccggcgctccgattgagcccgcagccgaccgatccggatacgatccgctccgctcctcgccggagcggaggctgtcgcgaacccaggtaacatcccgccctaacctcccacgccgcacgcacgcgaaggccgacggcggcagcgccatcccctgacggccgactgcgcagcggcgctccgccccgcgccccggcctgggcctgcccgccttcggccttccccgactcgcgccgctgctgcgccccgccgtgcagccgttgccttcgcccttcgcgtcggcgctgccgtgtcgtcgctccgtgcagcgccgtcgcgcgcggcgcgcccgctgcccggcatccggccctcccccaagccccagcccccttggactccggtgagcactgcctctcgccctctccggctctccctctacctcagtccctctcccccttctagtagaccacagtattatccccttcaataatcaatttctttgtatgattgtatctgtgattagccaattagggatatagtaatttgtatagattactacaaaattatgtgcaacaatgaacctcaaatgaaatttttgacttgtattgtaatatcctatttatctaagatgttatgttatgtttgaacaatttacattgtcctttaggtaagattcaaacttgtttgttattttctacttgtattgaaccatttagagttatataccgtatcacggtatcgtttataatttatcagatatcttatcgaatcataccgtattgcatttagatttttttttgctaggcctaccccgggttcaaatcctgggtccgccactgttagaacacacgcagagaactctggccacatcgaatcgatcgccgttcacgagatgtgctaattgattccatcggattttttatggaactgcagccaatttagactaggaagcatgaggaggcgaccgggaatcgcgggcttgcagaacgcagcggctactcgtgtatgtggacatcttgcttgaatagcttataatgttttttttttctttttctgtggattctgagatgagtgtgctcttggaaaatttaaggaccaattccggctggttggggaaaatgtggccaaggtcaggaccgatgtcatgaaggagcagcttgcgacgtttcggacacagctcgaagaatttgcacgcaagcataaggtgattcctactcctgtattctagttgagttttacagaaaatattaccgacgctattcgtatgtcacaaattgaattacacatagcatgctttcacaatcttcttaatcttggggatcaggatatatcagtcattcttgcagactgactgaattcttacattttttttcaactgcccagcgcaaatgaaatgaatgttctaacaaacatgaaaacagtgaagttactgctattcacttgattaaagttgtctatcgaactgggaaatagggaacctaagtagcatactagtccatggtcaagtgctcaacatatactaaaactgaggaacggtagttaaagatggaaaatgtaccaaagaaaaggtgttggagttaccaaggtgccaattgatcttgtttcttgtgatagatttcacttgtctcatggcatctagttccaactgggttgacatttgcaatgtaacactgatgttctaggtgatcacaatagagctcaaatggcacagcatattccaactcttaagtaactttgtgtacatggtgtgctagtgcagaatgatatccgtaaaaatccactatttagacaacagttccatgagatgtgtgcaaaagttggagtagacccgctggcttcgaataaaggagcttgggcagagcttctagggattggtgacttctactatgaattgggttggtatacttaatttaagctaccttgtatgttttgatcctggaattttctgttattattggaccatttacgttctgcttggcatctgtgtctattgcaccaggagttcagattgttgacatatgcatagcaaccagagcgaccaacggtggcttgattgacttgctagatctccgtaaactcctctgtcagaagaggaaagctgatcttggatcgttaacatcagatgattgtttgcgtgcgataagtaagctgaaggcaagtattttaaggaattctacagctacatttttttgggaatcctgtaattgcattcatgcaagttttacaagattgcattcgaatctatggccaataaaattttatttgatgtacttggacagatcgttaattcttctggtcctttgcctgtgaactctcaggtccttggtagtggttttgaagtaatttctgttgggaagaaaaagcttgtgcgttctgttcctacagaactgaataaagatcacaatgggatacttgagctagctcaggtttgtaatcagcttttaatagtgtataataccacagtacacttaacaagtatgtggatgctgtcataaccttatcatgcttacactgaacaagtatgtggatggtgtataacctttggttggaagtcataaagccccctatgttccacataaacgcttatttcagtcaacatagagacatagtacaaaactaagttaaaccgaagctttcaagttgctgccttgctcaatctgtcaccttgccacaatataaccgtacctgtccagttataacattatttcacatgcaggctgaaggttttgtcaccgtagagcaagtcgagagaaagttctcgtggtcaactggccgtgccattgacgtccttgaaactttgctcaaggtaaatcctgctcctgcatttccactctttaagcaacctttgtgcttcatttctgtgcccaaagaaaagaaaaccggcttcctttgatgcaagttatgtattggtgaatggtgattagatctctctgttgaatccacgcttaagccattgcaggattaccttctttttgagctatccataatccatatataaataaagtacttttcgtatgtgcatctgtattgacacttttatgaacgtcaaattttttggcatctatatccaactctggtctctattacataaacaggaagggcttgcgatgatcgacgatgggcacagggatggcaagcgcagatactggttcccgtgcgtcactctcagctctgactctactggtgcggatgccaagtcatgacctgtgccgtgcctgttccactccgttgttgtcacctgtatccttttccattggttcatttctgtaggcactgaagcacatatggcatgccatttaccagtacagctctggaagaatcatgagatagcaatacacttttcagggctgggctgccggcaaaatttttacattgtgattcgtgcatcaggattctggatgtatttgtactagtgatctatactatactagctcttctttcacgaaattactcgtaatcgtaaatgttcaatgctatttcctccgttttataatgtaagactttctagcatggcttatatttatgtagatataaatgaatatagacacatatatgtctagattcattaacatctatatgaattatctatattcatttatatctacatgaatataagcaatgctagaaagtcttacattatgaaacggagggagtaacttgctaatgtgagcaagagaaatgctcgcaataaatatgataaaaagagagagatgctaagtaacggtatcttattcggatgaaataataccttaaagatttcgtctctaatacctaatagcggctgataccctatttgaaatagggtatcacacgatacttatgacttatgatatattatttcatggaaaaagtacaccgaaggtcactcaacttgtcatcgggataaaaaacatcctcaaaccacaaaactagatatgtgaggtcccttaactatacaaaaccagtcacaataggtttcttagcggttttgatcctggttttgtcttacgtggctgctgagacagcgtgagccccatatgtcggcctctttctttcccttcttctctcccttcctcttctctctctcttctctggctctgggcaagccggcgccggggcgaggccgcgaggcgggggaggaggtccggcggggcgaggcgggagaggaggtccggcggccggcgacgtggcggcggcggcagcggagacgacgcgggatcaggggagcaaggcggcggcgacgacgacaacgcgggagcaggggagggcatcggcggcggcgagggtgaggagccgcctccgccaccatcagcgacctcaggacggcgctctgttcctccttcactctcgcgctggtttcccttgacttccacctcttcctcaagggcaccaagctcatggccgacgcccgaggtcggaaacctccccgtcggccccggcgagtccatctctttcatccctgtcaactccgctgcatcctcccgcttggaagccgacgtcgagctcgagcacgccgaatccatggagaaaacgcaagttttcttggcacgacggcggcggtgaagacgtccacgccaagaagccaacgagcccagcgctgccgccgccgctctcctgccatggatgtgtagttcggggatgtgaatgggaatggattggatcttgggattatggtgtccgccgctgttgccgatcttgatggcgccagggttgagctcaccagtgggaggatggtgaatgcctggatcgagtactcgcccaccttgtcgtcgccgtcgaagccatcgccacgtacgacggcgcctttgccgccgccggaagcgccagtttcatccgccgttccgcctcccgtgagttttaatccaatgcttccctcgcctccgcagctccccggcgtaaccacggcgccgtcgccgccggtgtccacggtttcgatgcctcccaccagctccgccttgctcccctcgccgccgccgacgcccctcacctgctcccgcgtcgtcttcgccgccgccaccgccgccacgtcgccggccgccggacctcctctcccgcctcgccccggtgccggcctgcccagagccagagaagagagagagagagaagaggaagggagagaagaggggaaagaaagaggaggctgacatgtggggcccacgtgggcccacgctgactcagcagccacgtaggacaaaatcaggatgaaaaccgccgagggatctactgtgactggttttgtatgtatagttaagggaactacgtggttttgcagttcgaggatgttttttattccgatgacaagttgagggacctttggtgtactttttccttatttcatccgaacggaatatcgtccttaagcattccaattcggcccacgggcctcaaggcttcaacccatgacaattgacaaccggacaggtgtgggcgttgactagtcttctttagttttccaccggacaggagtaattggcaagaagaaacaaaagggaaaaaaagtggcggaaaattcatttttgggaggggaaatggccaccgcagaggcgaagcgccggcgccaccactcaccgccggcctccatcgccgccggcggcgattcctccacccctacctcggcggcgcccgccgactcgtcgtccccgtcgctggatctcatccccgacatagcccgccgcctgacgtccctggaggatttcttctccctgcgcgcctcctgccgcgcctaccgcgcgctcctcccggcgtcgcgccgcctcctcgcctcgcagtccccgctcctcctcgtctccctctacccctccttcgccgaggcgctcttccacccgcgcctccgccgcctccaccgcttccgcctcccatgggggcaccacctgcccccctcgcgctacaccctcctctacgcccacggcttcctcgtcacctccaccaccgccgccaacaactacccgccaaggctcctcctcctccgcctcttcaccggcgagcagctccgcctccccagggtcttcgcgcccttctcccgcgtcatcctcaccgcggacctcctcgtcgtcatcttcttgcccggccgggccaccgtccagcactgccgccccggggacgcgctctggcgcgttgcctccgcccctgcaccccatgtgttcgacgatttgatctctgtcaatggcaccctctacgcgctggttggcctccgtcttgccacgctccagctgtcggagagttcgctggagctgtcatttctgggaggagagcatgatgacgcgaacaggccggagggggatcggttcatgctcggggagtgtggaggcgaggtgttgctcatcagcgtggagcatgaggagagggttgtgtaccgcgtgttccgttgggcatctgagaaaaggaagtgggagatgatcaccaacttgggcgggcggtcgctgtttcttggcttggatggattcgcagcttgcgttgatcaagatcatccaggggttcgaggggattgcttatatgcagctgggcgacgcttgggtgagtggcatgagtattccttggctgatggaacctgtgatgtctgcaatgctgactatccaggcgcgccacccctgaacaacagttcactgatcagaccatcagtttggatctttcccagcttgtgttgatgcaagcctgagtagggttcatcctagatcaatgttgaagccctattgctcagttgctcacatgagagaaaagaatggtaatgcttgatcactagcttgcttactaggtcatttatgtaaacaatatattcatacggcgatcagtacttgcatcttattcgaccagtcaattgttgttttggttgatatagtgaatacttttccttaggattttgaccacaggagcaaaataattttgttccctaaatgctgacagcattactttatgtgctatgcaacttgttgagatattatgaagcttcttttgcgtttattttcctctgatactgcagtaatagtgagtaaagcacataatacatcaaggaatatgctagtaccataatgttaattggttatatttgactatgtccctgaagttgcatggttgtaacttgtgtagggtaggcagtagcagaattcttaaccctgtttgctttgtgatttatacaatgctgcaaatcctgcggagttgtcacagttagtccagtgatagtgataaacaagaccaggaatgacacacatgtccaatggatgatatcataaattatagctgatcatgtttatgatttgtactcctaaaaatatgacatatgccaggtcttagaaccacttatttatatgattttccactcctataactgtaactttcattcctgaatcctgatagaacctgtggtgtatgacctccaaatggtctacccaatcagtagttggcagcaagcagatgtgaaggggttgggcatgctcttttctggtccatcagtttaggctttatatttaaagtgttcttcagttccgtgtttttggactacccttcagtttattcttttttcgggtctcctgtctctcccttccttgttcttgctgagtgctgacacgagacacaacttggttctcttgcggttgtccgttttgcttggtccgttgttgtttctctgtcttaatacaaagttaagccaggcttttgtgtgcttcctgtgtttcagaactcctcttattatctcaaaaaagaaaaactcttcttattgacttcagagggattggaacaatttcaagtttgaaagcatgattcgctgacatatggacctcaaacttatgtctgtgcaatgttacctggcatctcattttgttagcactcgtaaacatgaagtctggttacctgcaattctgaagaacactgtcttataacctctgacttgtgtgcaggttttcaagtttattttttgacctttggatggtatttgcaatgagattcagtcatatttccttatacatgtttccttattacttgaaagttgaaactaactttgagaatgttcaacccttcaaacacttgctctacctacttggtgtattgatatttgcatgtgttcccaagaatgttcaagtgctgcatcaatttgtgccaggatgccagcttagcgagtgcatatttgcgatctcaagtctgtcgatgacatacgcacattattcattttggatgcctactgaatttgttctgtaatcgcaaatactgtactcaatttcaggttgcatcactggctttcaggtgttctctttcttctgacatgttgctacttgcttgcaaatggatcgctgaataccaaccgtccattctggattctgccacttgcagttcttgctgatagccttgcagttctttctctgtgtagctcttttgttgatgtctgaattctgatgcttcaaaaattcagaaatgcagtaataaacagtagtagtagcactatttatttattgacacctggaagagaggtcctgtgcctctccagtcactgacatgtgggcccactttgcagtcattgaccaccctactgctacggaggtccacaggcggtctattgtggggtccacctgcagtgggtcaaacgggccttcgctaactcctcgccgtcctcttcccatccaaacctccgcagcagagctcgctgccgcggcgaacgcacacaatgcaacacctcgccctcctccgtccgctcatccatccctctccccttccggccgcgagtcccctcgctgcgcgatgccgcggcggccggggccgaggccgaggccgaggcgtccgctggagatgcgcgacggggggaggcgcgggcggcggcgaggttgaggagggggagggggaggggaagcgggaggcggcggcgtggctgagctcggcggtgggggagaaggtggacgagctgctgctgcgcgaggagaaccgcgcgctggtggaaggggtcgaggccgccgagcggcgggtggagcgggcgcgcgccgcgctcgccgacatcgagcgccaggaggccgccgcccgcctcgccagcgaggaggtccgccgcctcgagaggcgccgcgacgaggtatggtgactgctgcccgcgttcaacctgtttgatgctttgcctgctctgcattcgcctcaatcaacgagcagagtgcctgccctagcgagtagtgggtctctcatggcctcatggtggagagcgacgtggcctcacctagctatagtgctgtacagtgtacacacgcgcggtccaatccccaccccgacgcggtgatgcacgcatctggtggcaatagacgtagcatgaaccagcaatatggcaccaccagggtgttgcggtgcaatggcgtgctagtatggttgtggttgtactgtactactgtgtcggtgtggccctagatgttctgtgactgccgcctttgtgtttgagttaatgtggcaccgacgagcttgaggaatgctctttaattagccgaacagtagtacctcaccacgggtgcatgtgatttacgaaatgtaaatatgtaatgcacggaaacagaaaattgcgtattgaagactattgtcagagaatatgaaaaagctccagttattttctcctatctatatactgcctaacctattactccttgagcgttttctacaagcaggcaaaaaatgctatttctgaaagcaaaccctgatatgcattgcaccgccttacattgaaccgacttttccatgccatttcgctggattcgattctttgaaatgccttttggatagaagtgccaagcacaatatccctacagtcgataaattgtagtttatatattcttgctttgtcatggcttgttatgcatatccagttggagatgtactgtagaaatcagctcatttgatctatgctgaacagtttgttagatttagaaaactagatgaatttcccctacaaacgcttagctggatactgaaacaaatacgaaatatccttatgtttgaagctggtcgcgttaatatatcaatctagtacctgaggctgaaaataactgtatttgtacactaatgtagtctgtaaaggtgcaatatctgtccacagttttgctaattctatgccattataatctgaccttagcaaatcatctgtgtagtttccatcattttttctctaggatttttttattttacaaattaacaattgaatatcttgccttcttagcatatcagatgctttgaatccttccaactgtttatattctccatttctgtataggagatggttccatgtcttttgagaaaacataaagtactagtagcatgtgtcagattcatgtggtcccatgacgataaaggcagaatgattattagttgtgatatcaattgtatgacaattcatttctgtaatcatcaaattatctttccttcaatatacatgggaaggacatgaattatttgtagcttggtgtttcctatgtgctatttcctcttaataatgttgtttacaatgctgcattacataaacaagatcacagagtcccaacgtgaattgctacaagcaagagaaatgattgatgaagcacaacgttccttgtcttctagtcttgaggatcaaagctttggagatgtaccaagtggagatattgatgaagatagtgaaagactggaatctgtaaaagctgcagcagtttcctctgtagttggtgttctagctagtttacccatatctttttatgaagcccatgattttccacaattatttgttcagttgtcagttattttcataagttgtgctttgtttggagtaacattccggtatgccattaggagagatctggacaatgtccaactaaaaacaggggctgctgctgcatttgcttttgtaagaggtaaaactcgataatgctatttcataaaacttctcagcacatattcaagcacattgtcattttgtttatttgaactaaattatttgcaggccttgctatggtggaatctgggaggccctttgagctgagcactgatgccttaatatcacttgcccttgatggtgcagttagtgtggttgagaacattttgacatttctacctgctgcaattgcactggactattgttttaagatgagatttttgagtccatttcctacaagaaaacagtagttcctgcaaataatctgtaaggtccataatgccatttgttggtccaatgattgtagtaaatataccatactgcttatgtcttatattcatcatgccaaatactcgtggaatcaaaaaatcatgttgtttatcaaatagttgctttaatgtaacagctggatcttgtcctgtttctcagatattctgagatcgataactcatagctccactatgtgcttgaatagacatccttcttaagtgccctacactttgccaggactgaggcatatggacttatctgtttgtgtttctcctgtactattgatgttcactcccaggaattttttatttccacttgaatcaatgctttgggctatctgtttcatatcagcttttggtgaaatgctgcaatctgcgtaaactgatatgtgcttcatcagtccttgcccttatgcaaagagaattctttactctccatgaccatccattctttctacacaataatctatattctaatgtgcaagcacaagaaacatggtacatatctttcttcggtatgttgtatctgtcatctacattgatttatgcctgctgtaccttgcttgtctattagtgttcttccctttatttcagtattgctgtgaagcaactagctgctgaactgtgctataacctgatacagtattattctggtcattcataatgcgccaaaccggatggaactggatgacatatcattgcatcacaaatatgggtccgctggaaggtcggtactgttgagaggtggatgcagagcatgtatttctgttcttgtgagcctcagctgtcattcttcatccgtcaagccagatggaactggacacagcttgatctgttgaagctttcggtgtcatgaagaagatgaagtgcacaggtcttttttgcatactgaatgatggtggtgggggattgtgcagtgaaagagcttcatgaaccatcatctggacaaggttaccttctcaatagtctatttttattaggttattgagatgattacatgatcagcccagcattattttgctcatccccactggtttgttggtgttggctggtgctttagttctggcacaaacaactgcacgaggtctgtcatagcaacatctttggatacattgtatgtagggagctaatcaaggatgagagaactaatgaaaaccacttctatgtttgcatcctgttattatatctagaacatattttgttccaaagcagtccgctagaattttccaagctatttcagccagctgtctttactgatgtgttgaattgctcgtctggatttgcttgcttgagtaagaaagaatgtagttttgaacattttagttcctaaacaatattttgaacatattaggaatatgtgatgaaggtctagaaatcattaacaaattcttgtggttcattagtctaggacgtagggatggagtgtcaagcttgtgattctgactcagtatcatccagttggcctacaaaattgattcgaagtaatcaaatgagaaacttttatacaaataaaacaggattgaactaatggtctttggtgtagacaacatggtctaatgatataggcatctaaaagtttaaatattagtaagcagatacagggaaccttcaactgaacttttgctactacaggattaaattgcatgcctgtccctctgccagctaatagttactctgtacacctggagtcactacttgctgatggcattagataccataatacattgctgttaattgcaaacatgcaggctactgcctgttgccagctgctactggcctatgaaatcgcagcccactgtcagtgactagtctgctatggataatgtgcaagatcactagacaccaagagcaaataagcatgtgcaacttactgttgaatgataaacttggtgctacaggcctgcagtgctcaagaatctttagagcaagaacagattgagaattccatctctttggaaagctggaataatgaccatatttgcacagatgtcgagtatctcataaagtaatggctttcaatttaagcctgagtcttgatacttgcttaatctggaacaaatcttggcactcggtctaatcatgtctatatgggaatgcacatactcttccatgctatttgatataagtttgcccaatattacacaccaatttgacctgatccgttctgtcagtggggccccaacttgcacatgtaataggccacatttcggtggttggaatttttctgaatcattccctacctggtgtgattagtgactgatgtttgctgactttgaacagaatgtagcatatggctgtcgaaagtgtgcttatctaccttggtgaaagaatttacttcagtgagtcaggccaagccagttgcaaccaaaagtccattcttctgtctcctggaccattcaatcatgagactagtgtctttttataaaaccatgccatgcatttgaggatctgagctactgtctggctttctcttctggtttcatattggttctagagagatggctctaaaggtacacagttagttcatgctgatacaccatttgtccgtgtatagtgtatgctgtaaagtacaggtctttgcagtttctgtctctcttaaacaagtgcgttggattcaactcactgttcttatatctaatgagattactggtgatttatgtttttatggcactaccaggtgttcaattggctgaatcggaagaagcattctaatgtcgagtattgcaccatcaatgagaacaagggtaaggataccaggatatctctcttttatgtaccacatgttttgttgttctcatgttgtcaactcttgtttcttctcttctattttttttcctgatggagtagccatggaagagaaggaagactctctgcgtgcaagtgtgactgagcaagacactgaggccctgctgctccgtgatgtgcttattaatggtatacttgcaattggcacgctgggccacaatgtaaactcactctgtcctgagtcctgtattgaacaagatgagcccatcatcatgtgtgatgagaaagtggaacaagagaagtgcgaagaagaaaaggctgaggctaaacaggacacaccagttacagcaccaagtgaaccggcatctgctcttgagcctgccaagatgcactcatcatcgatgaaagaagacaacttcatgtgctttgtgaaggaggaaatcctaatgcatggcatggaagtggaagatgttcctaacatccaggaacgaccacttctgatgttagagaaggtggagaaagtgagaactacacttgccgatctatttgctgcagaagcattctcatcaagtgatgcagaggataagtgttacccgaaaatcgtcattgttgctggggcatccacttcaaagcctacgtcgtgcatggagaagatgcatcacaagaagccaacaaaaccaacgtcaaagccgctgaaggctacaagaaaattaagtcgagtatggttttcttcgtctctgctttatttgttaagccttgttacattatattttactagtctggaatttattacactttgttccatggtcagtgcgccacatcttacacatatgttttaccatatagctacaactggagtaagcattatgcatctagccagtctttagtggtaaatgatcactgacctggaatgcacctttttggtttttgtcatctgtaaaataagtaggtcatgaggaagatgttggggaagaagatccacccagagcagctcaatggacgtagcaatgcagagggccctgtcactgcataatgctaggtttgtggacaaaagtttcctttctctatctggcaatttattacctagagtttttttaaagctgtctgttgaactatacagggctcaaggcccttgtgttttgcatacgattttgtacctttccaaattttcttgatttttacttggattccattgtttgtaataaaattaggttaatatctgaggtagtatttgcatagaatggataccttctaccaaagttatatttgtttgtgggtcctagagctagcatgacccacgaatcacattcaagaatatagtaattcgtttaggctacatttcactaggaatagaacatatgaatattctcaggtttaataaggcagatgcaaaaaagaactgaatagcacaggaaagtaatttttccatttcaagcttctcacagtcaaaaacaagtaatggttcaaaaattgaatattctatcacctgttgcctccatttatgtggaactcacaagagggtctaagtgctgcttgacactctgacctgtatttaaataaaatgttatcacctattgcctctgcttattattgggatctcaaaacacaatctattactgtgtatgccttggcattttttaaaatctgagctgcccccttattcttcacattttctcagaaaaccatataaacttttagataaatgaagcttttattgatctcagacaattacatcaagttgatagaaccaaactaagaacacttctggcctctgataatggaactgctgtttgtttaagtagaaagaatggtgtgtgtattttaacggttggtgattgggaattgggatgcagtgaccatggagactgtgttcttcagaatatttttaagaaatagtgttttcggtggatcctatcatggaactgcctatggtggaaagagcaatacgagttgaaacatatagggattaggaagcatgggttcggactaaaatgcattcgttcctgccatgatgcaaagcttcattcgaagcaaaatgagcacatgccatggtacagtggcgtgcaacgagcactgcaattgcacacgacgtgcatgttctgaaaaaggccagtggacactagacatgcagctaatcctcttttgatgaattctatcatgaaaccaatggattcgttgaaaatctgaacaaattgatggatttggtcccagctgtagaaaggttggcaaactcttctcgctcctgtattattgtaggctggagctatgatggaccaaatcatcagaagcaaatttcaccatatataagcatctacttttatctttttctctattttaaaatgtgatcatagtgaagttatatacattctatctgcttaacgctccacattatccaaaaaaatgcatcacactccatattgggaacacgttggtggttctgaaccaaagtcgatctcttgatgccaattttttttttgagctggttgagtagtcgaactgggaacaattactgcttgaggctacaaaatttctggccgacaatacgtcttgatcaggaactgactaaagaaattccctttcaccttttgcgggatttgttggatccatcctcacgcttcggattccttgctcaagagaaacatccatgcatatcgtcgacagcgttcgttcagtcctcttccttttgttgttggtgctgttgttattattgttatagatgtgtttgcctattcgctcgccagtgatgaagaatagtcctgcctatatttgcctgtagtacattgtaaagctacagttgacgtgtcttgtaagacccttattattattgtccataccacgacgtctcatcatcgtgttcctgtcgagattaataaacctctatcctatccgttctgctacctctcctaccctttaactgtgtactcgtttactaatccactcaatccctgtctcgtccatggtccatggctggattggctgcagcagctgcaactgctgtgaataaataaataaactagacgagtggttgcagtggtgctctgcaccaaagcagttcagtgtttatacaacaaaacaaggcgaaactgccaaagcagcagcttagctagcggaatggcagctgatgattgtaagcgtaaaggtaagcatcggcgcgtgaagctcataccctcatgcttgcttgctgctgctgcacgttgctgttcccgtctcgccatcggttcgatctagacgggtcgacggcgagacgggaggcgatcgattatcgataccaccagcagcaatactggtgctctccatcggtgggcgccgtgtcggacttcggttggtcgccctcatcatgccggatctgaaacctgacgcccacgccttcttcttcctcgtctcctcttcttcttctagcggggccttcttatgtcggcctagtctgacagagatggagaatttcagttgagatgcgcttgatattacagtgataactgacaagagtatgtgatttcaaccttaagatcatgtttaattcttaagacgctcacagtttcttcttatttatttgacaactaagtttcacgcgaagtagtttaatttttgttgtctaacaaaggcggataatttcatataacacgttcttgtagtgatcaaaagttacctcctcttgaagctgcaaaggggtgcagccgatggcaatggaggctggtaaggagtgagaggcgcggctaacggcgggaggccggactgcacgatagacgtgtccggtggtggagaaggccgacgtggcgcgatgaggcgtagccagcggtaaaggtggcgaccacgatgtgaggaggagctgtcggtgagtgtggcgctgtcttcgacgcacgaaggctagccggcggggggcgttcccacatgtcggcagaggatgagtggtggtggagcatcggtgcgacagccgtggactcgcaggtgatgagcagcgggtgaaaacccagcccggccttggccggaccgacaacgatgattctttcccccctcctaagggcgttgtcgtgccgtctcgtccttcaagggtggttgctgggtaaaagcccagtcgtggctcctttaagttcctgacggacggcgcggcggttttccgtcgcttctatccttggagacgtcgtttaggcatccccttgctgaaaccactcgaacgattggtgcaagcacgctctagatagagttgggctttgtgttggttgtaagggcgttttttggcattctcggctgtgttcctttattggcctagcggcaattggtccgttgctagctttctcctggacctgtgtgttgacgttgtctgtgtatgtggtggtttatttttgtccttttttctggttacgaccttccaggattgtaatcttgtaatttttttcgctttatcaatagaactttgcaccgtctcgtgcaagtcgttaaaaaaaaagttacctcctcatatttcacgtgaaacaattcaattctcgtagcgatcgaaagttacttccgttgcaaacggagatttgtgagttgtatgttgagtgccgcactgatcgacagtcactgccactaaactgattgatgatggggtgtcttctcaaattctgggcgttgtgctcatagcctttgcgacgcactgatgatggattctgtttctatggtaacagaggggtgacgatgatgcagcactgctttgtgcgcttcccaaaagcaaagatacactctgtcacgaaacagattaaaatctcttcatgtgttatctctcttatgtgcgaaatctctccatgtttatctaatttatgtgccagtagtgcctgaacgttcatagttttcgagcaaacggttcagaacttcatatcgacttctcctaagaaattgttcaaaactgtactacgttcttcgcatacagtagagttgagctaagtgttagttgggctgcatataagcccaattacatcaaacaaattgctggctgggccaatcttaaattggagcagaagaacatgaacctaaggttgaatgcacggattatggggatttttcgtctctctctctcctcatttgtcttttgatttatcgactacagttaaatttaaattttaaaacttaattttagagctgattttgaggggttttttaaatatatttttcttgcctttggcttttagaccacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcgaagaagaagaaggaggtgctcatcttcgacgccgaggaggacctcgcggtgtccctggcgaagtacacggcggagctgtccgcgaagctcgccgccgagaggggcgccttcaccgtcgtgctctccggcggatccctcatcaagaacatcaggtgattttgattgcttggaccccagagatcgcgcgtttcttgggttgcttcctcttcctccgggtgttctcggatcgcgtaaggaatctctcgccgttttggttggtggtggcgcaggaagctcgcggagccaccgtacctggattcggtggattggagcaagtggcatgtgttctgggtggacgagagggtggtgcccaaggaccatgaggatagcaactacaagctcgccttggatgggtttctctccaaggtattccctcgcgagctctggatttcttctttccgaaactgcttgtcctagtcgtcgtttcggcctggatgcatgatctgctcggggcatgatcaggctatttagggatcataatatttttgtggtttagagtgatggaaattcattcaggaatagaattctggtaatgcttgggttaactgaagatgaaaacaaagaaccgtgatgaagaacagattcaggttttcagacttagagcatctccaatagcctctttattccactctccaagccaaatgttagcaactttggacaaaaaatacactccaacttagggcctgcttggcaacttcgaaaaattttgcaccggtaaagatattacacttgtatttttcggggtcccgaaaattcccttttggttacggaggaaaagtttttccaggcaaatgatgtttgggcaaagagcaatgggtatatcacaatatttccattactgcagcaataggtacccattctgaaacatctttttctataaactgaaatcaaatagaaaaccaactgattataaagaattttcattacaaatcaggaagaactgcaatcgatacttgcaatttataaaagaaataagaggcaacaaatttgaatgagaaaacaatgatcttgaggaatttcaatcttgcctgctaagatctgaaataacaaagaaactcaaaagctgacaaaccagaactcaatctttcatcttgtgaaaataacaccaagcttctccttccaatccctcggtgtggcaccgggcgtagcgctgtgaaacgagcttgaggctgaccttgcccatcaccggataggagagaagcagggggaactgttgcgccagcctccgaagagggctaggtgagggtgcagagtgctgctagagctagaggaaagcctgctggccactggtaagaagctgatcgagctagaggcggcggccatgggatagaggggagaggagcgcagcacgagcacaaggagaggcgaagcggcgagcctgacttctgtcattttatttgtgtggcctgaggaggtgttactgttcttccgggtgtaatgggcattttccggcggattttaatccgataacagcccatccaagcagtcctttccagcccgtccagtaaaaactcatggaccggtattttacaccggttttgaaccaaaaaccgggcttccaagcaggcccttgtgggaagcggttgattgatatgttttctgcagtgtactagatctgtaacaaaaacacttgtgcttctcatccagtttacagaacctctactgctctctgtgagttatcggcataagcattttgattgaccaatgatgaaacgctttattcgactgtgggcagtgggattttataatctgcttgcctgtatccatgctcaattgtttgaaattgtgccaaccatttgaaatataccgtgaaatgaactatagtggttttttgtggataatggataatgaatcattagtatccgcaactgtgaatatttaggaaataagttgttgaagtggtgatccgagatgcattcttgtgtctacttattgcattttcatcagttttctggtgtgcgtgtaaatttctttgctgtgtattcagaagtactccttaactaggttcttcctttcgaatttctaggtcccaattcctactggccaagtttatgctataaatgatgccttgtcagctgagggagcagcggatgactatgaaacttgcttgaagcaacttgtcaagaatggtgtgattgcaatgtcgcaatcgactgggtttcctaggtttgatgtcatgctcctgggaatgggccctgatggccatattgcatctcttttcccaggccaccctcttgttaatgaaaacaagaagtgggtcacctacatcaaggattctccaaagccaccacctgagagaattacgtttacatttcctgtgatcaactcatctgcgtatgtcgcaatggtggtcactggagctgggaaagctggtgcagtgcagaaagcactttcagataagcagacttcgtctgatttgctgcctgtagaaatggctgtacttcaagatggggaattcacttggttcactgacaagccagcagtgtcaatgttacagaacaaatgaggtccatgcctggatattgtttaagctttcatcttaaataaagatccaggggctaatcccagcctggatactgcttaagctttcaatccaaagctgggttgtaatgatcttctgtctaaaaaaggatccaggtgactgcatagttgcattcctcttttatgcatcacttgtaaggaaaacatgagcatgtatgttgtatgttgttcagagtgatgtatctgagacactcctggtttcgacttagtaaataacctttcctggcccttgctcaagtgtctatgtttgttaaatttgcgcggttaataaaccggcgatcaacttatctacatattttgcaaattcagatagagaactcattttgtgcatgttattcaaatggtttcaattcaagacacaattctttttgtttactgattgaagtgatgccaatgctgcttgacaaagtgaggtaaactgtgatacaagcttggagacctgcatgattctgcattattcactattaagaggagtcttattcagagtgtattgcgagtaccttcagtttccagtttagtaaatcacctcttttgggcgttgcattggaaatatttagatgttcagctgccacttgtcaatacctgtaattgttagtttattgtgtatactgttccatccacagacaatccatatctttttactgcatttgcacttcagaacggcaccaatttcgctcgctttcagctgcctgtacatcgcaaggggctagtgattattcaatttttagagccatgcataggtagtgtacaggttgatctgtaagatttatattttcaggcagtactgcacgaggatgaatttacttaggcagcagcctaaatggctgtacgttcaaggcagggaactcagaactgattagcaacatggcctttctacccaacataaatcgcgcattagttgtgctgtctgacactgacctcggtacatttctggcatctaaattttcatagacattcacattttgggcaataatagcatgttgacccgttgacaaattatttcacatatttaaccgtaaggaattttggaggaatttcataagaatcgaactactcgttaataatatttgacgttaggagtactagtactcttagcatattttgaagttgggagcactaattgtaatactggaagtagtgaattttatgaaaagttctataaattccatactcctatgttccaaagaagccttaatcatatgataattgaacttattcctaaggccgagtttagttccaaagtttttcttcaaactttcaatttttccatcacatcaaaactgtcctacacacacaaactttcaatttttgcgtgaactgaacacgccctaaaagaaattataaattccatccatttcaaagaagccttaattggataattgaacaccacgttttcgacatgatttggcaggccaaccgtggtggacacatccagagtgaatgcagggagacgagacgatggaccatggctgcattcccctcgtgctgccacgggctctcggccggccaagccaagccgccgcaccgcccatttcggccatttgcaccggcatttgcagccatggtcctccatccatctgcaacgcactccaaaaatcccaacaaacaagcagcagcaacacatgattccatgagctgctccagtgaaagcttctgctgccactcgatctccagtttgcagcaagatattactaatccagtacctaacctctcacccaggttcatgtgaggtgtgaccctatctcctctcaagactcacatgagctttggagcaaaagaacatggcctagaatctagggcactcttaaaaatctaacctattagtttcaaaagaaaaaaaaatctaaccttggccatgttagaggctcatcatggtgtggcatggaattctttttttgttcggataaataaaactgaaagattcagaagcctgatcttggggacacgttgctcgtcactacatgaggagagctccatcgttgctgctgttggtttccccacaaaactactccgcatgttcaactgtctcatgtaagatcatattaaaattcttggtgttgcaacttgcaaattgtgactttgtgactgaactcatctgtccaaattttgtgtgtgatcgaattaagaaggatactggatatatagagaattgttaattaacatgtggtagcagaatagatgataggatctttcattttttttgccgcagcaattgataaagagaagagaaaggtaaaggtgttcgtcaaaggtgcgaccagtgcagaaaaaaatttggggtggttatgattgccggacagacctgaccgatcgatttgcttttgtcttaaggttttgtgcttttttttgggcctgctttattctaaccatgcgtattgaattaaatcaaaatttagctggagtacgtaataacttgaatacgaaatacatacgaatttctgaagaaatttgcagccattacatgagaaaacacgcgcgttattgtcatgtatgattgcgtatggttgttaatttggcttggctgcatccacaaaagattttgatgactcgttcaatgagtcggtccacgcgaaatattctccaattttttcttcgttttttttcgagcatatttgatccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccggtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggagaggggacatgaaggcgctgcggcgatccagcacctcgtcctccccgtcgtcgtcgtcctcgtcgccgacggccgcgtcgtccccgccgtcctcgtcgtggatccacctccggtcgctgctcgtcgccgcggcgtcgtcgtcttcgtcggcgtcgtcgtcggcggcggcgggaagctccgtggccatggtgtccgcttcggcgcccgccgcgtcgtcgtcgccgtcgccgtcgccagcgcccgcccccgcgccgtcctcgccgcactcggatcggtgggttttctccctctccttcggattggtgaaaaggaggagtaaaaatgactccttttttagtcctttccttttgggggcgtcttgatctgcttcccgtggagtctagcctcacatgttctgatctaattggtggtctggaggctgcttaggtgctcatgttatggtttttttgtgcgcctcaatccaaccaagtctttggatttcagcttaagagtgcagtaaaacgttagagtgacagcctggcttaattgtgtgcctagcaattcctgcctcgtgcaggaaggttgcggggcctgcaatccaaactgaggacaccggatttttaagagcgaatcgattatgtgttcaatctgttgacatgatagtgggggagattcggtttgttgattcagagagatcatggattctgttgcagagtggtttgcttactctaaaggtgccttccgtctaagttctagtgtgataagattttgtcatagtttagtggcagcgttagtgctgaatgcagcttgcacaattgcctcaagatatgttgatgatgtgatgctgttggtggtttgaacaagggacagcttgctgctatcttgaattatgtgctttaggttgttggatggcatggtatttaagaccttggaggtgatcctgtcccctaaggtagcaaatttagtttctaagaataatagggggggtgcttgatgtttccttttggtttgggagtgaagctgtggcactgtaaatgctacctaaaagtttggatcttccatgagttgaacaattttgctgacctgaataggtatcaccgtaaatcacaagagtttttagatgatacacctccagttttcctgtgatctgctcttgttccgtagttatctcttgtcaagtttgctttcaacttatttgttcactgatctaggtattatattgaactgcatgttgactataacgattcctttttgtagcccaggtcctcagataactcataactatgaatcattgcctagaaaatcgttttatgtggtcatcttttcttaatccaattaccaagttcaataccatcaatttttttcactagcgtatggtgttagggaccctgtttcatccacagattccatagtattgtctgatttatgcctcttgatcgatgtatgtattattcagctatgtagttttgtttagataatggataaaattgtatggttagttcaaaatatggtagaccatactgcttgattaagaatcagttcatgctgcgcataacgaatgtatccttgacgctgcacaattatgttcttaacagcactttgaaacaataactaggaggaagtttttcagtatcacgtttgtttcgtaaactaattaataccttaatatctgtctattttatgaatttgttttatatccaaccttttcgtgtgcatacaaattatatgtgaagttggatttatgaggactcaaagcattccctcttcggatgctgtagcttagagagtgtgttaaagatggtactattagttagtctgtcagttggtatggcagtgttatcttttattgatccatatcttccttgttgctccactttctaaaactattctttaatcttctttcaggggtggaataaagtctccatggtctcgaaggaaaagaaaacgagtactttctcgtcaacaatgggaaggtctgttttctgctaatgggaaacttcgtgatcgaggaaagaagtttctgaagaaagttcgcagcggggtaagtttgattatctatttgtttagatgtcctgcatatgtttacaagaatacttgcctattgttttgtttgttcaaagatttagacatatatagtagtgatattgaaagcatgttctgcatcttactccgtacagtctaattaatatactggccttttttttctgttgtgtcagggcattgaaccaggaatcagggctgaagtttggcccttcctgctaggagtgtgagttttttaatctcttctatgcatctagtaattcataagctttcgtttctttgaccaagtttgaggtcgcaactacatacacgtagacttcctatagcacctaattggttatgtgaccacatggagtgtgcatgttttgtgtagctctacgggacggctccgattcatggactagggtccttccttactgtttcccataatgaaaaggtttaggattatcagttagagaagatagttcttcatggcaatataatacaccattcttagtatttgaatccaggataattaataccttcatactacctctgtcccaaaaagacttcatttctcagttcttgtccaggtgcatagccagaaatgaagtctttgtggggcagaggtagtaacatcttttccagtttggttttggttgatgtgataaattgtatggttgttgtcataaagtctgttcggattgttgtgttgtgtttaatgtattctgtcttcaaaccaagagagattgacgctgtcaattcttatgtgcagctatgatttaaatagcacagaagacgaaaggaataccatcaaaatcaagaaaaggtattatattcattgctctgaaaggctgttcaatttaagtaggattgaaacattttgctcaatgtgctgtgtttccatcaagctacactaaaagcccaaccactaatatgtaacatagcagaagatccccaagtagtttcagaacatcaatattgttattttgcaatggcctaaagaaaatgagactatgatattctaaatgcgaccaatataatttctaatctgataagaacttgttgattgatgtggcttttggttcaggaaagagtatgaaaagttgaggcgacagtgccagcaaattctgaattgttacaagggcaatgggctgaaagtaataaatgaaaataatgaggagtgttctggtatagagtttagtgctgaaggatcagaatcaccttgttttgaagatgtcaatattgcaagggcttctgtgtcacatgaggagctgaaacctgaatccgagcctgagcaaccagataactcaatgtgtgctgttacagaatgtatggaagaagacacgggtgaattaatttgtttagatccttgcatagcagagtcagaatcttctgattctgaatcatctgatgaagatgaccctggaaggatatcgatgtctggtgaggaaaattgtgatccagatcctaaatttaccaggactacttcattcaaggcagacttttttaagtctagcaagacttcagaggattttgccacgtggcaacgcattataaggttggatgctatccgagcaaacacagaatggattctgttctctcgcaaccaggccgaaatttctagagagagagctttgcagtgtgcagaatctgttgggttaagagattatgaccatttagatcccagtatgatttatcatgctgctcgattagtggggcttcttgaagcatatgcggtctatgatccagaaatcggttactgtcaaggtatgagtgatcttttatctccaataattgcagtgatggaggaggacgatgaagcattttggtgctttgtgggtttcatgaggaaagccaggcacaacttcaggcttgatgaggttggaataagaaggcagttgaagattgtctctcagattatcaagcgaaaagattcgcacctgtacaagcacctgcagaagctgcaagctgaggactgcttctttgtgtacagaatggtagtggttctcttcaggagggagctcacctttgagcagaccgtatgcctttgggaggttatgtgggctgatcaggcggcgattcgcgctggtattgggagatccacctgggcaaaaataaggttgcgtgctccaccaaccgacgacttgttgctttatgccattgcggcttgcgtcctccagaggaggaagctgataatcgagaagtatagtagcatggacgagatattgcgagaatgcaatagcatggctgggcaactggacgtctggaggctactcgacgacgcacacgacctggttgttaacttccacgacaaaatctgatctgagggatgcgtttctctttgttcttgcggtagaacaaatatagacctcgacattttttttttttgggggggggggggggggtttctttgctgcttgcagaaaagtgttatgttccctgtagctcgtaccggcatagaacattagaacccacttctaagtatagagattgttgtaacttaaaaagagtgaggactcgagtgttcctcacacacgaagatcagcaatactgcttgatgttactgaggctctgcagactactactattcattgtttaacctgttataggcacggacagatttttcattgaaaggtatatctgtgtatgcctgtatggtctgtcatattgttttctccaataatttgggcttcgtttgggatttgggagaagtttcttgttcatgtgggaatcaaattgtatcgtctgaaatcgatgcctctaaacatttggcttcaaaacgcacccttctgtttcttgtttgattgatacctgggacttgggagcagcatggcaagcgaattctagcctgacaatcgtaatcctttatgcaggaaaataaaggtaacaaaaccaagcaaatttgagttggccgatgacgtattttgctttgaatcctattattctggagtgctttcagcatgttcaattatatactctctctctctctgatttatattataaaatattttgatttttttctaagccaacttctttaattttaattaaatttgtagaaaaatgtagaactacttttagcactaaacagatagtctcataataccctgcaaaaaatatagtctcaaaatacatttaatattagatttagtgaaattaattttttgttatagattttggtatgattttttcaaaaatatggttaaagtcaagaaaaattgacatagaaatgaaacaggagagtacttttttgaaagcccaaaacatgcatacaaagttcttaaaacgaaacagaaagcaaaacatactggggaattggggataccggtttctatcacgaaaccaagctggggcagttcaattatatacttaaaaagacatttaccagttctccttttactgtgattaacagaacgattttcaatattactattagaccttgttcggtttagagggagttgaagatgattgaaggggattgagggggaataatttcacaccacaataggtgtgaaataaatcatctccaatccctccctcacagagattaaatgaacaaggccttagtgagtaaaactacaacgctatggagaagtactactccgtaaatcaaggatacaaattagtatatcatacatgggttagtgtcaaaatttggccaaggtatcatacaagttatttactccccccgtcttaatataagtgtaacctaggataaacgtgacatatcgtagtgctacgaatctagtatatgtttcatccaccataggttgcacttatattgagatggagaataaaatttagtaatacactacttcctctgtcccgtaaaggcgatcgttttatactcacaaaatatcctatatagattatcataccagttttgtcggatcatatagtacttgaattattcttgtccacttgtttgaattaaatgcatgtgcgtatttattgttatttctcaaccactcaaaccacctttgatgaaggaggataaattggaaatttacacatgagctaatttatcctataatccttagaacatcaatctttctgggacagggagagtaatagcttatcttacatttcttttctaagagtttgataaaacaaactagctactactgtagtaaccatctcaaaacaagcccacagcattctgctaacagtctatcagatatatatgggtatcccgtacacgtttcgattgtcttctttctgccgcatggtggattgccctgagtgacaagacaaggaacatatcaaatcgtagtatgatgaagctctccatgttggggtagccacaagttgtcgtagggcataactttgttgtcggattcatatttctaaacaactttccaatgtggcgtacaaaatttcatggcgtattttttttccaagttacatggaaatatgtaaaatatgcatgtacaattcattttattttctaaccttttaaatataattttaaaataaactcctcttaagcatatttataaatctgaaccatttgcctactgtaatgttgagatagaataatgttgttgcgtcacttaagagaccaatgatatggcaaatcattgttgtcattccatgccatgaacaatagttctataatattttttttcaattattgatactttttaaaacaagttatttaagagtttagtttttaaaatataaaggaaatactatctccatttttaaataacttgtagctgaactattcatgcttaaactttaatctctcatttttttcttaaaaaatacaaatatttaagaaaatactatattatcgaagtatatgtatattgcatatatcttaaacataggcataaaacttcttccatttattacagtaaaaataggaaatgaaaatgtgatagtcaacgctaacaattattcgaaaatggatcagcaagcaatacaattcattgcatcagggttcgaaattttgtttcaacatttcggcccccaggaacgaaactatagcatccgaaattctaatatatccgtgaatttagctaattttattcagattatgacatgtggatctaatggtaaatccttaattatcacttgtatggcaaatagttaaatatctcaaaattgaaattatatcagaccgaaatatacattccaaaatttctgaaatttcggatttatcgtgaaccctctgcaaatggcatacgtacgaaggacggagcgcacaccgtcgatagtgagacctctcgactgcccaccgctttgcaagtctcggcttcttcatcaaagctcaaacgaccaaagcgatcatatcgcgacacagtcgagtcaccctgcacctaagcctgcgcgctactgaagatctctcgatctcatctcatgcgtcaactgatcgagatctgcagctagctacagctatagctttagctatcggtcgccacctcgtacgtcgtctacctctagctacagctcccatggctgacatgcgagcacgacggcgacggcgagatcgacagccggcaagccaccgtgcgtccgggctccctgcaggtgaactgtatgacagggaagcctcatcgactctcccctcaaacactagatgccgttgctactgtgtagccctattaccctatatattcctgagcctagatatccattacaaattatgaggttgtacatatcgatattatttcaaatcataccatttttttaagttgttcaatatgtgcatctatttagtttcttttttatcaaactctgataaatatataagaagtcctgccaaaacctggcaatattgctaaattgtcaaaattttggtattgtcaaattttgataaagtttattttgagtacaatctgaacataccatatatttcaaaacctccaaatatagtatgagataaagataaaaatatgtaaattacactagttgaatcttaagttccgtttggtagaactccaattcctaaatttaactccaaaagttaggtatgtagtaaagttatagaacagtctaaacctagctccactactattttagatggaactgaaattgtttggttaggccccaacttcaagagagatgaagatgaagccagtactgcaccaacatgctcttaggcaagaaaattctggctatgccttcaaacatgttatagcaacaacatccagctgctgccatgcatgtctaagttagctacaccatacgtttcaaattatttatagttatcattttaatttatcctaaatcaaatatatttataaccattaatttttattcgtgtgattcaataacatgtgaattatacgcataaaagtatttctcatggtgaatttaaaaatataaatcttatggtgtaaaactatatgagtttacagaaaatattattcaaagagattaaaatgcttgaattgggataatcctaaagcgataagtaatttaaaatgtgggagtaattaactgtctagacagacacaagcatggtggagatgatgagtgattcgatcacttgcgcaatcggcaccagcaggtgggttggatcgatggttcgttcaacttcaaatcagaggttcggttcagaagatacggcagtatcacctatctgcttctctgataagtggattggcatgcatggtgagctaatgtctactaatactttaaatttgaaagattgggcttattcgtttcaaaggaattgcaaaggaaaagcataggaataggaatgggttttaaactaccattcgttttataggaatgcaccatagaaaaactataggaaagttttccattcctccatttataaaggaaaagcataggaaaaaataatccactccaacctaatgtttgcattcctttggttggattgctcaacaacataggaaaaattcctgtgtttctcaatccataggtttgcacatgtattcctatagtattcctacgtttttcctattcctacgttttgaaaatcctgtgaaccgaatgagccctgagtgaattgttgctgcggctgatctacttaattataaggacaaattgaatattttaacaaataaacttaataaataacttaaaataagtacatgatccaaacaatacgataaattttttttataaaaaaatatatcttttaaagcatgaaacaaatcattcgtttcatcaatctgataaacatttcgaaaagaaacattcatcttgctgaatgctgatgagctatatcattgcttcaactggcactacacagtggctacacacctacatacccactggcctggtcgatcaatctgcatttgcacgtgtggggattgaactgcatttgaggttgcaaacttgcaatgggggacagagagatcagaagtgtctcaccactggagtctcttctcgtgtgtgtgcgcttcaattctctgatcatttgagccagaaacctttttgtgcatcaccccctggtagtgatatgccagtgcacagctatatacagcactgcaaaagtgcagtaggaacaaagcttagctgaggctttagtagagtggagaaagtaatatttgcaggtggtgaccaagcattagcttgggtttcgattattctctgtctgtttccaccttgcatcgtgcggcagcaacatatgttccgagtggaaacactagtactcctggattgtaacgagatagggggctttgcccatgcgctgagctgacgagtcaccagaaaaatgtcttctcttgtttggattgcaacgcattttcccattttctataaaaaccagcaccgatatagacctcaatagccgcacgcgaaaaaaataccatggaaatctaatcgttatgaagatgagcactgctatggtgctctctacttgtagtattctactacaagtagaagcaatctgagccattaatttataagggcaaattagtattttactaatttatggttaagggtaatttttaacttttacttttttttcttaatagtaggatcagttcgtctgtgtcaccgcttctttcgttctcgcgtgcgcccgactccggcggcagtgcccactccggcatgtgcgagctcctccgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaagatggtaccgaagtatttaagttcagagtggtcatttgctcagttcaaagcgatgctcaaaacaccgtaatattgattggcttcgatggcgttgaaatcgttgaattgatctgacttcttgtcgtggttcagggcttcaggctcgctagttatatgtctccttctcgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaactgatatgcaaaattacgaattcaaccatcccgtccatattttttggacgattataccctctaacgtttctactaccgctatttaagataggagtataaatagatctgacccattagatataaaacgatcaacggtttagattaatttatactccgagtagaaagcaccggagtgggactctatgaagatactaacatataatatttgttactgaggttaacgtaaaattagtgttcgcctagaccatatagtttagacggtctagaccctaaatgttgggttaacttggaattagactgttcgactgtccagtcagtcaaaaccaattcgaacactatctagaccacataattagacaatatatagacaagtgtaaattgtaaacctgtcgttttagactatggcctaggcaatgggccaatgcattttttgtgtggcaggagttaaaacttcgagcccaatccaaagtgcatatggtttaaggttttgacctcattccaaacctttctcctctactctaagccagtcactgcaattaacttacgtcgtctcttctctgctattcgtcattgtggaccttgctgcatatttgtccggcccatggctttactcgagtggttgtacctatataaagctgctagttcttcaatatttatggaacatgttaagtgtataaaaaaaatgacgataatatagtgtacggcatatcgtctagactagctagactctataccatgggtcaccgtccgtctagcgtttagcgtctaggtgaatactgggtaaaacatacatccctgagacactaattgcaagcactctttcccaatctgacataattacagtgtatcaaggtatcaacaaatctcaatctgcttgaaccacttgccattgttcccttgcatatgttactgtccccatgcagttatattgtgtttgtatctctattaagggagagtttaggataagagtcagactatatttttttatcttgcatatgttataactctaaatcctacttcctttgtctcaaaatataagtatctagcttgtttttggagagattaaggattatggtgcaaggtaaaaatttattatattctaaggctaggtagttggtttgatatagattgctaggggtagggtgaaaaagtaagtgaaaaaaaaaatcaccttttacaattctaggtagctactccctccgctcctatttgatcttcatagaagtttttttcatcaaagatgaggatggcttaacttccatgcatttcatttaatatgagtatgttttcttgtgtttctatgttgtcctggatagctggtagccccagtgtggtcacgcccagaaattcccgaatagaattccaagcagaatgtgtattaaaatccccgtccaggaccggccggggtacacaaacgacaatgttgacattcagatccatatcttacaaacatcataaaagtcttacataaatacagtggaaaaacgaaagacaacaggagctaagccttgactagaactgcagcgggaacaccactccacaggcatcctcgatggcacggacgaagcctactcctcggagaaacctccatctgacacatactcgtactctggggttggggaaaatagagcaagactgagtactacccactgtactcagcaagtcataccggaataggggtatgatgtagggaattatcaaaagagagctaaagtggttcatttgcataaagcgagcatttataaacagaagttgaaagaattaaacagttgcaataattaattaatattgatcatcggctgtccaacgccatcccacgttgcaacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagatgccgtgacaggaccctttgcataaccccctctaaccaagcacaccacacctcaggtttcacccccactcctcgcaaggcagcgggcagtcccctctcgtacctaggtgaatccagaagcgacagaggccgtcgcagggcccgccccgctccatcacgcccacccttgcctggatgcgtcagctagaggaaagctacactacaagcccagccgttgcccacactggcttgtggtaagtacgataagttcttccagggcatcccgcgaaccggtccttaactgccatgggtgcgactagcaaaatcatgcacccacagcccaccgtgtgattcattttaattaaccaacaccaaagcggtggtactaaaccaacattatcatatgaacctacagtctaaacattaataggattttccccactgtgtactagttgaactaagcatggctaagcaactcctagtccaacgtctattcatgttataacccaagctaaaaaaggagcagggtaccaaaatagcatggctgtaacaataggtaaacatcccatagtgatattgcaaaacaaatgtagtatttgaaagaaaacattagaacatttgcaatatagtatcaacatgatcaagtgacaagcatgacttgccttgctctgctgctggagaaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataacaaaaagtccttaaatcatttattgcgcaataattcccagggctgacatcatcaagggggcggcgccgacgggtgggtcccactggtcagtggctcgggagagaggggaaggggcggcggcacgtgggccccactcggcagcggctcaagggggggcggtccaccgtggaccgggaccacagggtgatccaccgccggtccacgggaccgacggcccagatcggccccgagccgatcgggcggtggcgatagaggtggccgccgggctcggctcagcatcaaagccggccggccggccagggctagcggcgatgacacgcggccgacggcgacggcgaccggcggcacgggaggcggcggtggcggccgaaggcaacggcgcatgacttgaagcggcggcgcggcactaggagggagagggaggggagtaaaggggagaggacgcctcaccgagggtggccggcgcggaggaagatgacggcgaacggcgacggcaagccacgggaggacgacggcaaccggcggacgggcttcggggtgccctaaggaaggaggagagagagattagagagagggagatgaaccacggcggccggcatccatggccgaaggcggcggtagaggtagaacttaccggagcgcgaggggatgcgaattccggcgacgaatcccgacgaaggaagggcggacggggtggagttcgtccttgcgaacccaacggcgacgacggcgcggtgcggcggcgagcctagcggcggctagcggcggccggagcggcgggaaaggcggcagcgggtgggtgcacggcgcgggagcgatggggagcaagagggagttcgacgaaatggggaaaaagagagagggggcgacggcggagcttaaataggggaggggagtcccggacgtggccggtaggggcgagattccgccggccaacgtgggggagtgggagaggagagagagaggcgggattcgaaaatcgaatcccagccatctcgggcgcgggcgcgggcgggagagagaggggagtgggcgcgggaggtgcggcgcatgcgcgggcgtgaccgacgtggcccggaggaggcggaggcgtgggcgtggcgacggttgcgggcgcggcggcgcgggcgcgaggtaggagacgggcccgacaggtggggcccacctgtcggcgtcctgggtgggaggagggaggcggccggcctagctgggccttggccttcggctggcccagcggaggggagaggaggaaggggaatgggccggcggcccactcgaaaagaaaagggggaaaaagaaaaagaaaaaggaagaaaaggattttccctggaattaaaatattgcttgctcaattttaattagttaaaattatttctagggctctgaaaattccactaaaaatcttgttagcgtatttcgacatgtagaactcaagaaaaattccacatgccaattctgattattatttgcattaatttattaaggttttctcttgatttacacaagtatttttttgagaccatttataacttcaatttaggcttgggaaagaactttggggtgtgacatagccccagtgtagttgtttactatggttctgcccttttgggccttttttcacttttagtgcagcaaggttctcttgtctgcttttcatgtatgcacttatgttgtctcttgggcttggtttccaagctgggtaacgaaagacttacctgttgtacaaaaagtggtagagaataatcaagaaacatatagacttaaacttcctcatatgcacaaggaaagagtgcttaagggcaatcccaacctagaaatcatatagtgatttccatacttaccttatcatatagacactatatatagaaactatgtacccaataagtagtttcttcaaaatatatttgtcgacgggggatacccgcggatcgtatttggagggtattggggtacgttggtacgaggatctaaacgatacgacatcaagcatacaagaagaaaatgattatactagttcagacccctcgtaaggtaatagcgctaatccactttatataagattatggaagaaaccacagagagtacagaagagaacgactgaactctgagattactgacgagatccttgtcgagaggggttcaacgagatctatcggcgagtaggcttcaagtcctccggattgcgtctatggtggcaggtgtcttgcactaagatttgataccctgtatcccttagggggtttgtatttataccgtagatcaccttagtctccaagtagaagtcggagacaacggaccccgtacgaccaaactatatcctaatcctctccgagtaggactctgttactttccatttcacaaatactatttccttgatttatacagatccttttcgtgtacttatggatataccgtatccgtatgtctcatgaccctaaggatagagggtatgacttatccataaccctgacaatattcttgtccaatcacctttattctctctcctcatcctcctatccccttgttcttttttttatgtagaactagtttgttgcataaaaatggtttcttcatcttttttccctctctactcattaactcttttgccaccttatttttttcttatgtgacaatatatttaatgatgagtaaattgcacccatgatgcatcaacttagcaggtgggtgcaatttggtgcaagaacttgagaaatgagcgttctagtgcaacaacttggcagataagtacaatttagtataagaacttcataagtgatcgtataaatacaacaacttacaagatatgtatgattttgatacaataagttaagaagttattcaacaacttaattatttggagcacatttttacacatattagatttttaagtacttattttgataatatactagcgtgggtttgtatataagtatatttatatttttattctaataactaataactgaaagtcaattaaactggatgtagaaattattatatttcggttgagatttgggaaggtgaagaaaacaaaaattcttgaaggtaattggatgtgcagtataattcttaaagattaaatttaatattgtaagataatatctgtaggattgctatgtaacagcatattgacatcgtgaaaaaaaaactcacctagcatatgcttagctaagttgatgcaccaaaatactaaattgtcaagttcttttactagaacacacccacttgtcaagttgttgcactcgaatgtttaattcttaagttcttgtactatatcacagccacccgctaaattgttgtactatgggtgcaatttactctttaatgctatagaaattagctcatgtggagggttgggaccgttctaattaattacccccatttcatgcaaacttaatttgcatgtatagacaataatactgcacgtcaaatgaagatgtcagtgttatgtgacgatcagtttgaaatttctgaattttttttatgtgatgattaatatggcatggagggagtatactagggacatttaaacactaaagtagctatatttttggatggttgtgtactttgtaaccgcctttgtgtatatatttggcactaaattaaattagtttctgtcaaattcttatgggacctctcctgcgcttccgacagaatcttactgtgaaattaatttctacaaaaaagaaaaattgtttgctccaaacaaactcctcacagtgtagctgacctcactcgattacattgcactgtcagaaggttgcacttgtgacttgacagaatactagtgtccgagctccaaacaccaaacggataggcttgtcgacgatgctttccactgaaatgatcggaggattagatacatgatagaaaagaaaaagaaatgaaaccgataggaacgcccgtgtaaaacagaatattgaaaaacacaataattctatataaatatgtatttgaatggaacatatgaaaaattaagaattttagaggattttatgctgctaatgttgtgcgaacgttgtactaactttttcaataaaattaatggtcaaacattatgcgaaaagttaagggatgaaaagaaaatcaagagctctgagtgaattcttcttttcctctggaatagacagggaaggaaactttctttatgctttccttcgattttcctttgtgccattaattacgttgatccaaacgatgttacagtggttaaatacataggaaagcaaatccttggttttctttgcttttgctccaattcaaaattggcctaaatgtgagaacttctaccgctaatcttacaccatacaattcaaaatttatactttggataaattggaaaacttctgaaattttgaactcgataagtgaccaatttacgccagtgaaatttcagtttaaaaatacactgtaactgtttgtttttagtgctgcattttcagtggcaagtgtgtactgcatgcactgaacatagtacaggaaagcgtgtgtgtgtgacactcgatggctcgacatggacgtcgagacctaataacgatagcaacagcttcaagagttttcctagcttttctttactttcagagaaaagtgtgctgtctcgcgtttgctgtttctgagtgttgtgtttatatctgcccttttttagtgactattagaatatgattacacaacttgctttttatgcaggtcttttttttctcgtagttgatagtgttgagattatagacatataatgatttaatctattccataaataaatcatgacattacagatgaaaactagtatgaacgcatcattagatctacacatgtaaactacacagtataacatgaatagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattaccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgatttttttgtatgttgcgtgaagacggcaggtcggtttatatagagaagggtcgcttgatcagggcgcccgcacaatctctactgcgcgtaaccgaaccggataagtcgcgcgtaacttatccggactccacgccgtttgcacgcaccggatctttcggaacgtttccaaaacaaaaacgaatccgaatttgcaacgaaacaaaactgcaaaaggaggctgcatctgcgcaagggtgaggagccaatttttcggaccattcgacgcgtacgtcgtgcacgcgcgccgcctgccctgccctgccaggcgaggcgagcgagcgcgcgcgtgtgtttcccctcttctctccaccacacatgcttcaagcgactaggagggcatcctcccttttaaggaggtccccctctcctagaataagcaaggtagtactaaactccacatgcatgccatcccatgaggtgggcttttgtgattttccaaagaattaatcttcgagtgggctaaggcccattcattaattccaacaatcccccaccatatgtcaaaatcccactgagatttgccttttccaatgtattgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaattattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctctta

SEQ ID NO: 42968 - DNA, 2485 bp, Oryza sativa
tttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctcccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgattagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcaaccacagagtgaccctgatctgccatctcttaaaatgcacaccggtgaatttatccggtctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagattaaatatgcgcaacatattgaacacgtaccgaggtgacggaaagaccggctgcttggtcgaaacttttcgcaagtgtctacgaaggcacgaaacacgcgagcgaa

SEQ ID NO: 42969 - DNA, 23536 bp, Oryza sativa
  unsure (1)..(23536): unsure at all n locations
tggtactaaactccacatgcatgccatcccatgaggtgggcttttgtgattttccaaagaattaatcttcgagtgggctaaggcccattcattaattccaacagatagaccaaaccgtatgtttaacaaatggttctgttcataaagagagctgctagagcatgggatatcgtccgaacaggatactttatgaaggttgacgtagttccatgtatccgctcctactcgtagtctagcataatcctaccctcactccacgcactcacgccccgcaccttgagccaacagcggctacgttggcaattagggatgcaagtggggcgggcaagtgggttttttagcccgcttatcttacttttagttcattttttcttctaaattttgtaatatcgtgtgagaaataaactagcaagcgggtttttatgcgggtagcggaactacccacttgcatccctattggcaatgacgctcgtcacgacaacaataacagggagcaagggttgagccaaggggaagggagaagaggagaggaggtgctagtgacagtctgatagacttgataccccgtaggtatcagctgtgataccataggtaccagataaggataatgcaccgcaactgcacaaaataccggcaaggagcacgatgggctcaccaccatgttgttgtgaatcgaaactccaagtccaacaactttattggcctctcccttgcatcaccatcgacaatgcgctgattggcatctttctcgatgtcattccttcttcctggtcgccccctttcgccatggaagccagattagatggatgccgttatgcctcaaagtatgaactggaggaggccacgagaatgatgctggcaaccgcccttgttattgacgtgcactcggccggatccagtaggtgggaagggtctagcctataatctggcttcattggcctgctccaccatcgctaagcatttctacgaagtagttgtctacggctagaaggaggagcataggaggaggaggggaaaatacaggagggggcggaggaggatggagcgagggaagaggaaaggataagtatctcattaatttatcttgcacaaacaccgtcctgtagattttcttattcataaaaggtctaaagataataataaccctttggagatggtttatagtagtattagaattaatttcgacttcatctttcctaatccatatatcgtatttatttctatctgtactaccatctcaactacttataataaaatatatgtttctttactagtaataaaactcacaattgaatgattgagatcacttctgctggtgataatactgcagtgaaataatactccctctgtcccataatataagtgattttgagtttttgcttacaccgtttgaccacttattttattcaaaaaattttagaattattttttttgacttactttattatccaaagtactttaagcacaactttttattttttatatttgcataaattttttgaataagatgagtggtcaaacagtgcaagtaaaaattcaaaatccttatattatgggacggagggaggagtacagaccatcgtaaggtgctctatcctttgttgtgaagccatgttgttcctgcgtgatcatgatgcatcttttgggcaaaatcgaaacagctgcatactaatgatgatatatatgtaaattgtgtagcttagctgggggcctgcataaatcaatctgagtcgttctaagctacacaatcaatcagtccggctgcttaactgtctaatctgaccacaaacttggactgagatacagcaagtggacacagatcgtctgacaacagcaaaattgctgcactatgattgatttggtgagtttaatctctgttctaaaagcttgagcaatccctttccagaattaattatggatttatgggtctgtgactcagtcgatcagaacctctgcgtatacattatacacttgctgaaagcctaaaacccttctaatcagagttgttaaagaatcctgagcatgcactaggtgctctctcatcaataatatgctgtacttatcatgtgattttcctaccaattaatagtgcttcctgtcttggtgatgtagtagcatgcatgatgcatgagtgaaaagtaaactgacttgagtaattggttgcaacaattttaactactgctgcatagcaaaaactacatatcatatgcttgacatgatccttatctgttcctgtgtaacatttggccatttcaaccccacatttcagtgacaaataaacactgactgctatattaaggattatggatagactgcgattgcgcggcaattcgatcggctggattttatcatgaaagaaaccaaaaatgaagcaaagacagtgatacattctgccgatcgacttaaactgaacctcctactagaaaacatcatgcgtcggattcacagatcggtttctacccaagatgccagtttcagttttgtagcttagcgcctcaacttgtgcctcgagagaaaagcgacccgctagtgaacttggcaactttcggcagtgaaattgggagataagagaggcacgcgcttgggtaggaatggatgccaagttgttgtcctcagatttcatggcaggtagcgcggttacaagaagctatctgccaagagccccaaacggttgccatcttcagagaaagaagctgggaataattcagagttcagaccagttgtaataagtggctggttagctagtttacagtctgaactctgaaggaataaaatctagtgttcaggtcttcaggatatgcttggatctagtcatgcttcagattgtcggatgcttttgttaactcctgaattttatggttgagatgttttgtcagggattgttcttggtccttcctttgtgagccaaatcagttacagttcagcttagcattgcaaggaaatggagatttcgagtcttggcagtaaaatagatgtacaattccataccattgagactaatttacagagcaagccgagggtaatatttagcaagagaacagtacaaaacaaaaatatcacactcagtcacctcatttcgccagcatacacacccttgtggcctttgtgccggtgcaggctgaccaggcgtccaaaaagcatcagcacttcacatcctatatatgtagtggcaggagcatctaaagcatatgctacaactactccctccgtccaaaaaaaactcagcctagaagggaatatgacccctcctaacataacgaatctggactaagcgtcgttagtcagtccagattcgttgtcttagaaggggtcacatcccctcctatgttgagttttttttaggacggagggagtacaaggcaccatcaagtagtctttgtaaggagcatctctgatgacgtagcttggacacgtcatcacaccacacgccgaggccacgctgtcaccgccagcggggtggccatctcgcacgacagccttagcacctccgacaagtcgacgccgtgtgccgggtcgggcgaggggaggagggcgaactcgtgcaacagcgtggcaagccagaatgccaccgtggccatggcgaggctcttcccggggcagctccgccgacccgatccgaacggcgcgagcctgagatccgaacccattacactgaactccgccgccttcccgatgaaccgctcgggccgaaactccatcggctcggcccacacgtcggggtcgtgtgctatggcccacatgttcaccatcgcggtggtgccagcggggatcaggtacccgtccacgtgtacgtccgacgtggccaggcgggcccatgagaggagtgggcccggtgggtgcagcctcagcgtctccttgatgacggcgtggaggtagacgagtgaggccgtgtcggactcggtcacgtcccggtccagcccaaccacccggcccagctcgtcgtgcacccgagcctgcacgtcctgctgcagcacgagccgggctaagacccactcgatcagcacggccaccgtgtccgtcccgcgaaacaccatctcctgcacacgtatcagaaaaccgatgagaaaacatgcagaggtagtcgccggcgagaaaggttgggttcttcggtgacgtgacgcacccagagaacggcgaccatgtcggagtcggcgagcttgtcgctgccctgcagggagagcaagacgtcggtgaagtcgatggcggctgcgacgggagcagatgagcgatgctcgtcgatgatgcgggtgacgaagcggttgacgcgggggacgaggcgggagcagcgggcgcgggtgctctgcaggtcgaagcgggcgagccatgggaggtggtcggaccagttgagctggccgagcaggtcgtagccttcgtcgacgagggccctcagctcccggacctcgtcgctctccttgccggggtccagctgcagctcgtaccgccggccgaacaccgaccacatcacgttgtggagcgacgcgcggcgcaggacgcggcggacctcgacggcggcgccggcggcggaatcgccgctccggctccgctgctgcagcttgatggcgcggaccatctggcgcgcgatgaccgcgcgctggggcgcggacgccgcgacctgccacggggagaagaggtgcgtggacgccacccgccgcagcgcgcgccagtacgcgccgtggggcgcgaacccgatggcgcggtggaacagcagcccgtacgcggactccttcacggggcggtcggcgaacgccgcgccgtgcaggatctccctcgccacgtccgggtgcgccgccacgaccacccgcgtctccccgagcgacagcgccatcagccgccccgcccccgccgcctccgccgccgcggcgagcttccggtgcgccagcccggtcatgagccacatgctgccgatcaccggcagccccctcagcccaggaacagccgccacaccgcacggcgacccccgacgccgccgccgcgtccaccaccacctcccccacgccggccctccggggaaggaccagtgcagcagacatgtaaccagaccagcgacggcgcaaaccacgacgaacccaagaagccggtgaggctggccgtcgccatcgccggagcatttagccgccaaggagaggtagagcagccagctgccagtgtcctccggagtcgccatgactattgttgactcgactgtctagagacgtacgactctcgttcgttagctcaacgcttcggcttgacacaggcggaatgacggacgaggcgccggcttttataggcgcgggaaagtcgtcaacggcgcgcgacgcgagcgacggtatacagtttaacgcacttctacgagtagtagtactactagctgttttcatttcaacggcgattcggcagatgaaaagacgagatattttgggtggcgaactgggcataatagtagtactattataggcagtgacacgtaaagcagtagaagagtagaattcacgtagaggattctcaaccggacgaattggcgagatgcatggcacaagctggtgaaagttttgagggggtgaaacggcgcgcgcgagagtgggggggcacgcgtaaggacgggggagagagggaagcggcggtgacacgtacacgaacggtggtggtaggggtgcgggagaaggggcaggggggcgaggcggcgtggggtgcacgtgattaccatgcacggatgcgccggttggcagcgaggcgtgcgcgcccatgcaggtgcagaggctagcgtcgcgtcggcctgtgtaattgtctacgatcggaatactaggtaggcgcggagcatggtgctcgcgccgcggggcgcggctggtcggctcggcgcgcgctcgcccacagctagcccggccacgcgccgtcgctgcgtcgctcacgcggggctcgtgcgcgtgcgggcgtgggcgcgcgcatgatgctgctcaccaaccaatgcaacggcatcggcggatcgacctcttcctccgtatcccttgtttaatttgtcgctcgttcgatcgtgtgcttcatgaagtcctctggcaaatgccgcaacggcgctgtttgaagagttttgagatttttaaaagcagctagtagtagtatttggggtctgtttggcatagctctagctccagctccaccccttccggagctggagctcagctaaacagtttcagcttcaccaaaactaggagtggaattgggtggagctctcacaaaatatactggagttgtggagctgggtttatgcagctccataactccattccagactcaactcctggagttatatttagtagttggagctgtatcaaacatgcccttggtacagctccaactcctaaatttagctcagaaattggatttggagtggagttggagaacaccctaaacacaactccacatttctactttattttgtgagaacgcttcacccagcttcactcctattttaggtggagctagaactgtttggctgagctctaaaactcgagttggagccgtgccaaacataccctagggccttgtagagctccaacttctaaataactacaggagttgggtctcgagtgaagttgttgagctgtctaaacctagctccacctctctagttcattttgtgagagaactccacccagttccgctcccattttaggtggagctaaaactgtttgattgaactccagcttcaggagagatcactactagaaaaatcatttttttcaggcaaccaaaaatcattttcgcaggctcccgtcacccatatataaattttcgcaggtggcctagtcacccgcctgcgaaaatcctctggacaaacaatgccgccaccgccgccctcccctggccggatccgggaggggaggggagccgcgccgccgccgcccaacgtcgtggaggggagggggaaggggagggtgcgtgtaatgtcccgcctctcccaggctggggccgcttacatctggcagccttcataggtcatagactaccctcacaaaccaacacaagtcttttctgcgcactctcaggaagaatttcccgatcggtcacccatcctgaaattgctccaagccaaacacgcttaaccttagagttctttcgagatgggcttccgaaaaagaagttgcaacttgttgatatgagtattctattaatactatcaagccctagggcgggatgttacatcctcaccctcttaagacaccgacgtcctcgtcggtcaaccccaggctaggaacgtcccctcttgactacgtcagtgcatccagtgccagcgcatgtgccatactgtgtgaccactccgggtccacaccagccatgcgccctatgcctgcgcaactgcgacacacgcgcccgtgtaaccgcgagagtcggctctgataccacttgtaacgtacgtccgtgcatccagtgccagcgcatgtgccatgctgtgtgaccactctgagtccacaccagccatgcgccctatgcctgcgcaactgcgacacacgcgcccgtgtaaccatgagagtcggctctgataccacttgtaacgtacgtccgtgcatccagtgccagcgcatgtgccatgctgtatgaccactccgagtccacaccagccatgagccccatgcctgtgcaactgcgacacacgcgcctgtgtaaccgcgagagtcggctctgataccacttgtaacgtcccgcctcttccaggtcgggtccgcttacatctatcagctttcataggtcataaactaccctcacaaaccaacacaagttcaaagttctttcgagatcggcttccggaaaagaagttgtaacttgttgatatgaatattctattaattctattaagccctaggccgggatattacaacgcgggagaggaatgagggagaatgaggactttgaaaaaaaataggccctataggttggctctatttatattccaagtctattttcgcaggcggacaacgagcttcaccccggtttgtatttctgtaggcggctatttggctccgagggtcatgtccgcctgcgaaaataaatacctaacgtcggtaaaagtgttttttttctagtagaggatggaggtggagctggagctggaattgtgccaaacaggaattagaggattcattgttaagagatgagtagttagcgggtgagaagtttttccgtttctagtttttagttcaatttttaaatactatagctattgattttcgaaatccataggaaaatccaggttgtctgaggagctgaagattgtgaaagtctacgcaagttcttccgtgtgcatagctgcagctagacatcttcagataatgatcagatatacggatcaggttatcagggcaggggcagggagtcccagctgatgcaacataatgtcattctatatattagtaccgcgtcacgcatttagcgacaccattaaacaaactttgtgattactcctactaaataaatatcgaatggctagaaatgtcaccaactcaccatgccaaatatcactacagtgatgggagacatatatccattccatgaggatattcccttgttttgtacttatcactttaaaagtgataaaaattaaaatattaacaagatagacttcacaaatatgtaaatttaaatttaacttagacaattataaaaaaataataaatatcgttgcgaatggtacgcactgttcacattcaaatttattgtttttttatttctatttgtatatattgattttaaattggtacgtttgtgacatgaaatatcttatattaatatatcatgtcattttttttaaaaaaaattaataacaatttaggtgcatatagcgaagtgagtgtaactcaactgggtaggtttcttgttgtggaactagctcatctggtttaaattatagatttgacatggctgctcgcgttgatagctaattattctttccgtggtaggcaacgtacccatcgatagtgaggcgtccgtgtcgactttatcaatgaaggccctcataggttcatagggtgaatgtgcgcgcattgtaagtatttgtgtttatactatgtttctaaaaaatattaaatgcatgtaaaaataagaggatattgcattaaggtatgaaaaaagtttcctcaaataatgcaaggttgatgcataaaacaactcgatccaagtcaggtacttaagtgtgcacctatcatgcatgtccgtcccatggatacgaacatatgcaagttatttactccctccgtcccataatataaggtattttgcgtttctgtttgcactgtttgaccattcgtcttattcaaaaaatttaggaattattatttattttttttgatttactttattatctaaaatactttaagcataacttttcgttttttatatttgcacaaatttcttgaataagacgagtgatcaaacattgtaagaaaaatttaaaatctcttatattatgggatggagggagtagtaaatactaagattaacacacactagtagtccaattttaaatttgtttagattaccccctcgaggatatgattgcctaaatggatgaatttctgttcattaggatcagttccctacgaatatttatattattctacaaaatttgaactaaaaagaatactggggggtcagtatcgtcttgcctttgggatgaaaggcaaggttcgccgttgttccatccagaccatccgtacttcaatgaacggtagcatggtttagcacctcaaagatgattaacagctaattaattaatataatataataatttctatatattagtccaattaattaacaagatcggttctgtctattaattttcttatgataaaatactcttgtacaataaagacagattagttttttcaaaataaatgtttattttttgggaggattttagcattagaattgctagatgtttcatacggacgtggcataattattttactactgtataaataaaggatttttcttgtcctgagattgtttgcttcttgattttatcttattttttgagttggttccaaaaggcaaggcaggtattagttgtatttgatttaccgctggagatcatttccttgatttttttttaagagagaacaactctattagttaattagctgctaattagtcactaaaagggtgctaactgctaaactatggaaccgttgattgacgtatggatgtcctggatggaaccaacggcaaactttgcctttggtcccaaatgcagaggatacgaacccggggagggggaattgcagtcgcgtgttaattagattattgttgcatacatatatggttcaggaaaattatacgtcacattttgtactagtaccaaattaagaataatagtagagatcaacatgctttgtcgctggacttgttttaattagctcatgatttcgatcgtaagggtgacgagtttgtgaggcaagcactcagcactgtcataacattcttctgctgcttttgtgtgatatcttttcagttatggtgcagcatgaacagaacaggcaaagtgcccagcaaggtaattatcagatcgttatgtggtcagtggtattcgcagcttcattaattcttggaaagatagaactttcaagtacacatatagtatcacacaccaaacagctgggacaaatagggggttactcaggctgtagtcaggcattcatttctactccgtttttaccagttcttggcttcttgcaatcgatcgatcgacaatacatgcgagtatgtgacgcagtgacatgctctcagacaagagctgcttcaaccaatatagataatatctgatctgttgctagctagattctgttagtctcctgtggacgccaaaggcttgctttgttactatactaattagtatgtatagctgattagttaatttccctatgcacccctaattgtaccattatgtccatttcttaaaaacacatgaaaatgactcgtggcaagtcaactaggtgactcacttactcaataacataatgtgctcttgcctgactacatgtttaactgaaataattaagcaacgttcttcagttatatgtggtcaagagagggacatgcaaaatacagaacaggtttcgcgaaaaaaaaaatgcagaacgggtgaacaacacctccaaggcttgtggatatggatggaccaactctattttaatctgaagaggagtgactaaatcaagattcttccttagatatgctctttccgttcctgccatcttgttgtggcaatcttgcttgatcgacactgattgcttccattgcaggaaaacatccatgtttaccataaacaaatcaggtgttaagctataaactagaatcaattattgcatcgatgagctgtgagtggctaatcttgtatggtacagtaagtttgatctgaaaattctgcattctctgtctatgtcaagcacaagttagttttcatcattgtatattattctagctcgagggatgagagcatgattaaatatatctgaagttctgaatcctactagtgcatacgagggacgaaaagaacagtgcggttttttaagacgcttacaattagataagtgtttgagtccttatcgattcctattgttttttctttgcgttctactcacaacgcatcaatattttacgagcatatataatatagcgactgttttgttcatattagcaagaaacagcaaccaatattggatgacagcatgagtgatgccttcctcaaaagaaactaaaaggagcatgagtgatgatgatccatcagctgattaattccggggagtaagttaattaagttttttgatttggatcatcagctctctcttttcacatacctggcaaatcctgatgctaaccttgtattgtactccttccatccacaaataatataaccatttctaggttatctaccagaggttaagatctattacaagaaaagattttgtaactcctcattaaataacactacacataattttcataaatttcacatcatcatgaaactagtactactagacactactatttcaatgcaagcatcactattccatacttaaatttaatgctacttatctcacatgatgtcttggatgttgtgtagaaatcatgtctcatgcaagacatggtttatttctctttccttatttattcacttgccatatcatttttcattctaggtgacagtttatttaatgatatggacaccatcctagtcattggattgagaatggtaggtcattcccaacacatgacactagacatagtttccataaactccacatcatcaagaaactagtgctagacactactcttccaatgcaaacacaactattccatactttaatttaatgctacttattccacatgatgtcttagatgttgtgtagaaaccatgtctcatgcaagacatggtttccttctctttcctcatttattcacttgccatatcatttttcattttagatggcaacttatttaatactatagataccatcctagtcattgggttaggctcatcaactgtgcagtgggaccacccctactaatcaagctcgtactcgctccatccggacctccagcatttaaaatttacatatttgctacatatcattcgataaaaatttagaaataaaatcttatagattttggaccatccgatccgcactaaatttttgtggctaagctttttatcctccgactttagtgagctccccctctttccggccccgacgatatttcccaactctgacagaggagacatagattagggtttgggtttaagattaggttgggtaggagcgttgggagatggggaagaggaaggatttccttggggttcagagggatcgccatagacagcagaggacctatgatgggtggtggacacgggccaacgacgttggagccatgggggttggcagtgggcagtgggccggcgttgaagacgggggcaaacaacgagactgtagaggaggcaacgactggtgatgaaggatccggcggctagagacgggtaagaccttgggtgggggcaccatagctttgcgaaagagaaggggggaggccggccggagagagaggacttggtattgttaaccaattccgaccatccgatgagaccgggctgcagccggcgcaggaggagtgtgcatgcgcatgtgcaagcgggactgaggaagggaaggagaaagaaaaggttttggctatgttgcacaaatcttaaagtgatccaatagttcaaaatttacaacatttgagggggtttttcatgtcaaaagtcatataggcagttcctaaaatttataccaaaatataacttctctatctacttatgttcttaacaaatcataactttttcatttagttccacctaggaagtgatctaggattggtccatggtcagggctagcctataaaagagttaagggcatgtttggatcctaccctaacaatttattactagtgccaaaatctaggcaaattttagcactactaatatttcgttaaggtaaagttatatggttcttgtttcgattgggatcaatatgaagccaaattttggtatcgtagtgaaaaacttctataatttggccaaataaaacatgggcactaccaattggttgtgctcaatccaaacacatgtactatttaagttgccaaaaaattggtaaggcacattagcctatgcataatgattacatggtgaaaatatatccacataattaattagcctatgcataatgattacatggtgaaaatatatccatcataattaatgggcagtcttcgggccatggcccgagtgatctgaggtgtgagtctgcccctaattatacatattttaaaaatatctttgtacaatctaaaaacggatttgctatcctactgtcgacagttttcaccacagttttcaggggtgaaaactgtcaaattttaaaccgtccgatatgcttagctttgagctttgtgctgtggaggaaaaaatgaaaaaaaaaaccacacgctcacggcaagaattgaacccgagacctgcagcaaactttaaaccgtccgatatgctttgagctttgtgctgtggtggaaaaaatggaaaaaaaaaaccacacgctcactacaagaattgaacccgagacctacagactacatgctcattgaaataaccaatcgctccatcaaattcttccaagttacatttgagtcacagatagcttatattgtagttacatggtactcctacaactacattgtaattgtaattatatagtagttgcagttgaaagtttttcattcaaaaaactatcgaatattatataactacttccaaaaatctttatgttttaatatggaggtatagtaattataactaattcttttgagtggctttggtaattttggacgctggaattaatacgtggatatggtaattcttgatgccgatcactgtgatccgccgtccggcactggtggagaaatattttttactcccggtttagaaccctcggtttttcaaccgggactacgaatccaggtagtcccggttggagtaaagaggggtaatctttagtccctgaagaggggtagcggcaatcccttgaggtctttttttttcattgttgatttgctaatggctagagttaatccctatatttttcccaaatcgagtgggatgcatatcccaaatcaacatcctaaatattaagttactcatacacacagatcaaatacatcacaaatcctacacacatatcaaatacatcataaatcctaaaaaactacacataaattaaatacatcacagattatacatgtcagatccatgcgatgcaatgaatcacaaaatctaaaaaaatatacatatagtgaaacacaaattatatataaaaaaacaaacgagccggccaccgctcgcagcctgccgccatcctaccccgcgcggccgcgctgccaccgcccgccgccggccggctgatggaagagggagtagaggggaggaggaggaagggccggcttatgggagggaggagaggggaggaggagaagaggaaggggggaggaagaggggggaggggaggaggaaggggattggatcgagaagaggaagagatgggatgatccaatcttatctaaatatctgtctgggacttaaccgatcagatgtgggagagaaatatttactcccggttgataactccaaccggaactaaagatcaatctttagtcccggactaaagtggtaatctactaaagatcctcggcccctgacatacatctgacaggggatgaaccggactaaaaatcatctttagtcccggtttttaatggaaccagtattattgtggaatttggtctagcgaccaaagatggtttctccactagtgcggggctccgggtgcaagtaaagatcgaggtgattttgcattattattggcgcccggcggagcacgcgagtggccggtttgttccagatattgtgccgcagcgcaggccgcagccgcacgtgtagccacgagcgaatgcgatgcagaggccggcgagggtagctatagctggctgattcgccggctgtggcacggtggatcttatcagatccaaccccggggccccgccatgaacgccacacgggtcaagctacttgtgtctgacgagatgcctacctctacgcatatacccctgcctccgatccggcgatcgatcgatcaccagcacggtggccaagtggacgtacgaggcggacgccgccgacgacgacggcgatccactagcagcgcgcatatgcatgtaccgatcgccgggcccgtacgcggtacgaacttattccggttttttgtgtacgtactgatcgatgatgcaatgggcggcacgggtaagggtggtacaaagctagctagcaaccgtgagcggaggtgcacggcgaatatcgcagccgattgggcggcgggtcagtgcccggaacgctgggtgcgccggcgaggggagagagagatcgaagcatctctcatctcatcgcatcgcatcgaatcgcggtataaaggtggcgccgcgggtgggtgcgggtgacggccggtggtttggactgacggcgatctgcgctatagctagctatcgtctcgatcggccagccagctgattgccggacagatctcgatcgagaagcgaatatctttgcaaatttgttaccttgctgatgttcttttccttgctaaaatcgtcggaatataatcgtagttaatccaatgcgcgcaagcccctttcgctcgccggccggccactcggacaaagcggcgacagggagccggctggccggccttgtcgttcttgtgctcagctagctagctgtttaagggcttatttcgagagctcaagattctgaggagtaactggcggcgttgatagttagtttctaattttttttaaaaaaaaactaggttttccaattttttgtttagtagttagaagctcttaaataagtcctaagtgtaaatgcacaactagctcgccaacagctgagatatcgagctagtacctagttgcatgccctgatgcccatgccacggcgtaacgttaacgtacgtgtcgtcggtacatggtagttttcatgggatctttttgtacgtttttgctagctagttagctagctgcagggaccatgcacgtaagcaatcacacggcgatctctcgatcggtcgactgatcgatcgattagctagcttaataattagcttggacgatcggtttgcgagtcggcgtcctcaactttggccagctcttgctgatgacatgacctgtatggtacacgacgtacggcgtcgtcccaaaactcgcagcccaattgtttgattgttagcttataagccacaatcaaattagttttatgtgtgttctaaaacttaattgagctggttttttgaatttcttttcttaacgatggtttatttttcaccatccacttttaactcatcaagaacacaaataaagctttatttattctattgttttgtttattttcctatgagtcatcagctgttgaccaaacgatgagactgttgtcactgacgtggcagtggcacaacacgtataccggcaggggagggcagggtacgcaacgtacggtacgttgcaccggtcgcatgcaccatgcatgcacatcgatcgagtcagctgatcactcacactgcggactcaccctgcagctagcggccatgagatcagattggatggatatgatggagacgggcctccaaacaaagcaagttaagctatctagctagctagcgaccgagtgacgacgcttatctcgttatctcgtttgtttgtcatatgtaacacgtatgaataccgacgaggaagcgtatgtgcactgtacatggactggttatcaacctatgatttgatgatggtgggacacgcaccaaccaatcaatctccatttttacctttgcatggctaataatatttccaacttttgtatgtaatagggatacaagcgggacgggcaaataggtttttttagcccgcttcttctagtttatttttttcttctaaattttatactactatatgggaaatgaactagcaagcgggtttttatacggatagcgggactacccacttgcatccctaaattttagtacttttctcataatgtaagtttatatgaatatgtgcaatgctagaaagttcattatggaacggaggaagtagcatatagcaagaaaagaaaaagaaaaagaaaaagaaaaacttccgatgcttctcggcctaggacagcacggcccagttaaactgggcccgaattagggagttgcggcccatgcgcttcgggaagagcccgtgatggtgttacgtccacgtcagcccagcaataggccgctgatatattgggccgacacgtcaagtctcggtctctcttctctctctctctctctctctctctctcgtcttctccgatcgcggcggaatggacggcggcgcggccacgaacgcatctggagtcgccgcggcggcagcggcggcggggaacggcgtgcaggcggggggcgggggcgagagggcggaggacgcgtcgaagcagaacctggcgctgatgatggcctcgatccagaggacgctggggctcctccaccagctcaacctcaacgtctcctccttcagctccgcctcccagctacccctcctccagcgcctgtgagattctcccagcaaatccccctctcccccttcctgtgcgggtgtgagtgggtggagaaatcttagggtttggttggtgattgtctcgtttgccgcaggaactcgctggtggcggagctcgacacgatgcagaagcacgccgagggatgcaacatccaggtccccatggaggtcgtcaagtgagttggttcgatttccatctcagtacccctttcgccccctggttctgggtgtatgacttggattggattggattggattggtgcctgttttgctagtttgatcgatgacgggaagaatcctgacgagttcacccgagacgtgctcaacagctgcatcgcaaagaaccaggtcactaagggcaagaccgatgctttcaaggtatgttacaattggttaatgctgacatagcatgtgctattttgattctaggtgctaagtagagatttaggtattccctggcagttgctaagtagagatttagatctgttcaaagggaaactcttgatccaaactgcaattgccgctccccccgccctaaggggtgttattgttcgtgttattagtcttatgttgatttttagataagaaggtttaaatgtagtttcaagggaatcaatgacacttgaatgaaaagaatcagcaagagccttgcttatctcatttcaaacattctcatccaaaccgtatccaggagcatatactaatcccttttaacccagtgaaattggttatggtctagtatcttctgtctagctagtcagttattaagtacacattttgcttattgtattgctctcattgacttccaacaatatgctctaattaattttaggcgaattgtggggacaaagtttgttgtactagctagacagattcctatcactggtacatctagctgtataagttgatggtcctcattgaaacaaatagatggaaattctcatccaatacttctatagcatttattgatagatgtataactgttaggcccagattttttttagccttttgatattttttttatgaggtgcatatagttgtgatctgcattagtctgtgtcatggatacgttttataaactacctccattgatttttatatgctgtattttaatttgaagaagtcttcaacattaacttcgtctattgatttcttataaattatactcataatagtaataaatccaatagtatgtgagatcactttaaagtacaaagctattgatatactttttatacactaactaaatggttcctttaatttgtctaatcattgatcaaaatctacaaagtttggcctttttgaaattaaaatatgccatataagaatcaatgtagtagggagtatcaacattgttagtttgtattttaaactataatttgatccatgattgatttctccaagttaaacatctgctattttcttatatggtgtttggttacaggcattcatcttttacaaccttttacattactatttaattatttcctgtattcagatgaaaaattgacatcgtctttcatttgaacttacttagtaatacaaattgaattattttccttgcaacttgtttgtttcagagcctgcggaagcatcttcttgaggagctggagcaagcttttcctgaggatgtagaagcatacagggagatacgcgctactgctgctgctgtaagttctggaatgtagtttctgtttcaggatttgcatatgaatgcccatagctggtccaatgggccagcaatgttgtggtgatcatcttttggtattatatcaagcttcattattcaattatcagaatgcatatttagttcttctgggtgtactaattctttcgtttttatatccaactgatttctaaatattttgtttttatccaggaatcaaaacagctggctcagtcccaaagcgccttgcctaatggtgatgttaaagtgaaaccggagcattgagaggacccaactgcaaaggtaaggatttttatttatgctttgctttaggtatgatttgtgaattaacaactcaaatttccttgtatcaactgtttcttaccaatagatctgtatgtattctcgtattgtgtgccacatcatttgttcagcttacctaatgattgaagtaataaccctgtaatctatcatcctacatgagcataaattatctgcagctcagctagctcaagggaaaaatggttgcttattaggtgctgcatgctgagtagttgtgtttaccttattttggtttatccaaagagtagcaccatctggactaggaatgccatgcctcatctatcagtcaatagactattatgcaactgacaattaatagtaaatctgtaagcttatatcttatcattcgtctgatctgataaccatttcctcattctggtcctactggatactgctgtgtactccattcatttgctaatccagttggcagttgcccctagattctttctgcaatgtagtctatggtcctatatagtacataggatagattgccttctggtttgttaaacagagaaacggttgtcttatgctgtgttggctggtcgatttccctttcgaagtcagctagttgaaattaggaaattcatctgtatacttggggcgcttcaatgtctaatctttcctatttatgattttgactattatcaccagtttatcacatgaatgcaattaattcaggtacttaaatcgtttggtgatttctcctaaagtgacgtggatactatgatggtgagctactgagctaccatggaatttgctatggtctaatggaacttaaggggacggaagatatattatgaatacaagactgcattaaattagaagtaaaccttgatcttgacatcagcctggaatattatgtatataagcatatatgagatgcagagtatctttaggacgtaacagtgacttgtagcgagcgatcgtatgatgtagtccatatgtttattttgaaagatatgtgagaataatttgagatcattttctcatatttcttctttgatggctgtactaccctcagtctttggattgttccaagcatgggagctttttaaattaacgagtcacgcctgcccagataagtcccaaaagctatgtatccaaatcatttagtccaaatcatttagtcgttgtgcatcagtaatcaagtcaaagatgctattggtttcaaactcccagtacaacacgtccatggatgaagatgagagtgcaagaccctgtttgttccactgagtttcatctctaggaattccatacaaatctttgttttaattattactagtattacgtaaatcatgtgttccagatatgtagtaaattgatgtactaccatgcgtggtgctcatcttttgaatgatctgcaacttatctggagttgacacctaatcgcatctaaagttgaatatccaaattgaaactgcgtgcttggagtctttcagtctcttattggagtgtatcaagcatccactgagaaaagcctctgtatattctaactcatccaaggtaatgtcacacgagtaagtgataagcaatccacgtggacaacggcttgatgacagaacccttgcattcacatcacagggtgtacaagtggctacaattctgtgactaggtgaagagttttttttatatattgctagtccattatatttgctttgctttgccctttgccttcactgatggggtctttgttcttgacaggattgcaatttgcttataatatgttgggctcatgagttgtcacatttgagtggaacccatatcggttagatggaagcaatgctaaccaccctcaagataacacgacaagcgcctgtgatattctggagctagcaagctcaactcaatattttttcctctccatttttctttttcagagtttcatactcttggctgcttggctagtgcccatcgaacatagaatttgtgttcaacgattctgatcgtcactgtgtctgaacagtgacatgtaattatgccatggagcccacacaacagttgaagacgaaagaaagagacctgatcgttcgccagagaaagcaacctaattcgtccggggttacgtacgtgcccaagaaacagtgggtgataccatcgccattaattactgtaagtaaataagttgcttaattgataagtgaaattttggttttggatcaccattttagtttgtggccttgtgggtgagctagcatgtactggattgttgacacgttggagctggtcgctgtcaggatggaaaagaagtatgccgggtaaattattactatcacttctacctaggataaacgaaggattaacatggtggctgtcattgtcctgggtgggtcttgtctttgactaaaactgctactgcttgtatccggattgattactcagccttgcactcttcagccttctcacaaaattctagctttagtcataaaaaatggccttctgatcttgcagaaaaatgcgactactcatcagtcgtttatcctgtaagcgcagcaagctgaagggctcgtttggaacaggaggattttgaaagattttcgtaggaatcaaactactatatatgaaaactctgtagaaatcttaattaggttccaaaggtgccatgagttcgggttaatttgtcccaactctgcaaaggtttgtgtctaaatggggtgtgctaaactgatcaggactacactacactacaaaatcaatctccgatcaaatggtatgatatatatatatttgggctgactaatcccacgcgcctcttacatttgcttgaaattaacaatggcggctcgcatgttctgtgatctgtgccactctgtattgtcccgtactgtagcgtagtacgtgtgagtgagcgaatgtgtgttgttcgattctcatcccctcacctgctcgggaatcttgatctacatggatgcacacatccttttcctctcttcactttctttctttcttgaacctatctagtttttttttttgtagcattcatcgatccaccattggaagaaagcataaagattcattgatccatccattggaagaaatcataaaggcgaaaactgaagcggccattggatccatcaaatgaacgaactctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42970 - DNA, 4112 bp, Oryza sativa
  unsure (1)..(4112): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattttgataaggtataagctatagtgcaatcagcacaatgtcaacacaaacatgagcttagacttatttagggtgtatggctcttgcatacttgccaaataaattaacaaatatctccctagatatatcgccgtcttttgttgtttgctttattttaccaaatattttcatagtgttggcacgggcatatatttttaaaagtaaaagtagtctcacatctgtgtgaaacattatcaatgagattgagtgaaagttattcaagctacattatttcatttactccttcctacaatcaacatgaatacagattcatgtgtgtgagaccagctgccagatggtgtcaaccgtcaagagatcatatatatgttccatgacttccatgaaatcaatggtgaaaacaacatgatcttttgataatcgtcaatgagtcatgcgtctgatattgtgtgaaggttgtccttatcaaggtagtaagagctgttagcattatttcatcttctatgcaactctgctaaagcagtaaaaatatttttcttcaatgtaagcccacgactatggtggctcaaatttggtatatgaggataaacatgttattaaatgaaaccctttttacttccaaaagatttgattgcgggaacggatccatattatgggaaaaactaaggacatatttgtttttctccaaaatcaactcgtgattgaaattatgctggtattgatcgtattgttgttttcatgtcgttggttggcaaattcgcagaaaaattatctgcttttcttaattgatcatggctgcttcaaataaaattatgtcggctcatgtattttttttacatgaggtccaagtaaataatcctaaatataagccgatgctacaagtcaactaaaaagaatttgatgtgtaatattgtctgttgaatttgtgtttatacaataatttcttaaatatatcgggtattattaggatttagatgatttctaaatatacaaaagttggaatgttattttacacacatggctatgcaattattagttaagataactctatgtgttctttccatgtgaatcttaatataacattatatacttcattgtcaaaatataactaaatattaccgtagtgttagcgcgggcaaattaatagtaccctatactaatccaccaactgcgtcttacatcttattcctcattgattggttaggatcggatccaacgactcaggttgcttccaccttctccccctaatccatgatctctctccctaatctttcccctaacggcaccccgccgcattgcctgcctccgtcctctccgcatgtccctaaccctaatcgtcgcccaccgccgctgctcattctcgtccgctctgtcgcccgtgccgatctcgcccacccacatcgccagcgacgtctgcctcgccggtctcagcgcctccgccggaacacccatgctcgcgctgcgccaccaccgatcgaatccccgccgccaccgatctcgctcgttcccgttttccaattctccaggtctgttggtctctctcaaaaaatttccatggatacttttggaaaattgaatggagggttgccaaaaaaaaaatgaattgagtggtatctgtgttactactatctttcatctggattatttttacatggcattgtgcatataaaatacaaattgtttcttcaatgaggcactttcatgtcagcaaatttctaatggagatttctgtgatctgtaataatggtcgtcatctgaataaaattcatgtcgttcttttttttttttgacgcaacatgtcgttctttactaatttgcagtttatattcttggttatataagcagttacattgtgaatttttgtttgtgtagacctgggcatatttggcttactttcagcaacagaaatagagcagatcaatgatggaattgcattctactgctgtcccaaaaggtttttgatcaacatcttccagttcgatcagatactggcttttgttatgcctaaggggctataccatgcatggtgtcatcattatcatattttccaagttcttgacaaaaattgagcaaaatgagatgtgacaacgagaagacagaaagtgccattgcataccaggtgctcaagaaatatgatgatgcctcacaacaagatgatctttgaggcatgagaggtacaattttctaccttattttttctgcactaaaatgaatgttctgcttaatattgtcttctttgtttggtaacggaggtggcttatagctatgttagttttatgcatgttttggaatagttcacgatagcatttctgttagtaagatattctttgcataatattgatgcaaagtgagcactgcagtctgcaattcaacaaatgaatgattttgtaccttcatttgcatcggaacgaggttaaaagaacgaagtttgcctcattgtcaaattctccggaaataaagttcaggataaaaaactgaaatagaaggacatttgcctaattttcgcggatttaggtgcttaaaatattttactgtgtaatgtctgaaatttctattgatgaccagctgagctccattagatgtttcacatgggcatttatgttgaaattgctgttaagttcacctataaaccgtttagctaagtgcgatggtggcttacactgtattttccggttagaaattatagaggacagaaaaggcagttatgtttattatgcacctgtattttactaaaagttttgcagtctcaactgattgggacacttggagctactttagctgtttagcagtgttttaatttgggtacaagattacagattctaactggtcacgtgctcaattttctgttattaatgaactgcggttgacaatgagtgatagtctttcttagttttcatatctgaaattaaaatgagaaaacactgtacactccacatagttttttctgttgaaaaaagtcaattgtataatggtaagcatttaaaataacttgatactggtatattagcgaagtgtattaatttgtgttgctgccaattttaatacaattctcctttgcacacagtttaaatcatgttaagaatctgcagccagatgcttatggaactttttttaatgcagggtatttttggaactaaacattcccagtaatgcttttttttctctttcaagctttgatgcgataaaagatctccataaatatgctaagctaagtatgttttccttacgaaattgcatatcgttgcttctttaatctttactatgcccttaattcagatagcccttaattctttaatatgcccaaaattccttacagatagtgtattttgctctatactcttttgccttttcaatgattaaaaggtttatttttcacactctttcaaattcagaaattgctgggtgatcttgagggtacgtatatcttcctataagtggaagcctgaaattgggtgggcttataataactagaggtaatttctactctgatcttgaaatggactgcaagaacaaaacatgagcacctgctatggttggaggaaggacactgtatatatcagattgcttcataacatcacaagaagaaaatgtccatgtttaattttgagtaaatttcacaaaactacaggtattttgcacaatttatcacaaaactacagatttaagagcttatttcacaaaactacagatttagtgtcttcatttatcacaaaactacagttacattgttcaatctatcacaaaactacagatttaagaactgtttcacaaaaatataaatttagtgtattcgtttatcacagtgctacacatttagtgtcttcatttatcacaaaactacagatttagtgtctccattctca

SEQ ID NO: 42971 - DNA, 23234 bp, Oryza sativa
actaaatctgtagttttgtgataaatgaagatattaaacatgtagttttgtgaaaaatgaagatattaaacctgtagttctgtgaaacaagttattaaatttgtagttttgtaatatagtgttcaaaatacctgtagttttgtgataaatgaagacattaaatctgtagttttgtgaaactagttctaaaatctgtagttttgtgatagatcatgtaaagtatctgtagttttataaaatttactctttaatttttgaaccatatatacttatttcttggtgcatggaggaccaaaccacctcatagtagaaagaggctgacctatttattgagttgtatattcaacaaaaagaataaagttcgatgaaaatcagcattaccttggtttttatattgtgatgcttagctaaagtttggtataagtactcctgttttcagcgattcattttatttgtaaatggactccgagttttttatgtacaacattttgtattaggcgaacaatgaaaagcattttttcaatgacgtggatgtacaacatttgtattaccaaatgccaccgtagcattagcacgggtatactactagatagattagtttagttttaggttcagagaatagagaggtggaaacaccccatcaaagtttgacccgaaatattggttcaggccaccttgtacatatactacgcaataaggttgtcatttgttatgtgtaagtactacaaattcaagcttgtatattgttgtaggctgggatagacaaagggaacctctctcgtgcaagtttactgactttgtatttgttagccatcttggccttgttttgtacatgttgagaagattgagaaaattctgaattgacgtttcaagaaactgctggttcaagaattgttctcagtgaagatacattgttcattgttgcatgcatgtataacttcacattttggcattttctgttgaaacttaattagtacacactcctatgttgtttatgagacctctgattcactaaatgaggtgcatttctgcaataatattagtgttgatgcggtggactgatgaaagcgaaattattccttacaaagaacagcaaaattacgtctgattttgcatgtttcatcttggtcaattagcttcagcagtgaatcatcatctctttagtttataatggccattttcttaaaacaattgttcccaactcttactactattctgcttatatataattgttgatggtttttaattaattttatcaaataatatgaatttttttattttgctttccatatactccctccgttttatgttataagacattttgagtttggttaaagtcaaactgctttaactttaaccaagtttgtagagaaaaataataacatttttaacccaagataaatttattgtgaaaataaagctcaattggacatagagagtactccatcctgccatcaccgcttacccctgtgctcaattagaagtgttttctcctcgcatcgctcggcggaagatcgctaaacctactattctttgcgcaaatagatgggccccctaggaatgggggcccctcggggctggctctggttattgatcaccaaaaacaagcgcatatgatgacacatgaacacacgatatttgttaacgaaattcaaccgaagcctacatctccagggttgtgataatgggtgctcctccccaaccaatatagcaccaagtctctacgagtacatggccttaattatcactgctacattgtaatcgccatggttatatttgtggtatccttttctatgtttaagagagagcctccattggtgtagaagccgggttttataaatttccattatctaaaaaaatatttaagagagagcctatgacagagtgaaactctaactctatcctacacatattccaacttcaagttaactcctaatagaattagtatattcgacacctattctaacaaaagttcttggtgtctaagtcaaaactaatgattttttcaaaaaaaaaactcaaaatctggaaaaacaaatttttatggttggttgtggaattcgtatgtataaaccatcgatttctacatcaataagggattcaaagtggactttttccttgggttgacgctgcatcgaggccatgcatgggccaagcccagagagcagcggttccgcttcgcgtgcgcctaaaataaaaaggaaggggaggcgtctctcccagtttgtgaggaccgatcaagcgatcaaaccctagccgccgccgcctcctcctccttctcctcctcctccagatcggcaatcggcatggcgcttcgtgctctcgcctccaagctgaggatcccggcggccgctccccgctggactcctccgccgtctcgccccgtctccaccgctcctaaggtccaattcaactctttcccctaatatcgagctgtttgacatctacaatccttgcaacgttttactaactattcttctatttcctcatatatgcaactgcagcgtaagctctctgccacctccaaaacctgttgaaaaaagttctctcgattttcaggaaatgtacgatgcagatgcttatgcttagttaatttcctttgtttttcctttgtttgttgactcatgtcttttcctttattttttttctcttttcaaggctactcttggaacggattcgtgcacatcaagacaggtttgcgcggaacatgatgatttctcaagcaattggtaatttagttgggtatggcatcttttggtatcttgtcaacgatgtttccaagaacttggcaaattgatcgggttcaacaatgaacctgttatgtatggcttgatgaagcacctgttatgtatcttctaaaggtcctgaagatgaacctgttatgtatggcctagtatgtgctgatgaacatgtctaattattttgtatggatgatgaacctgttcaaatcttactatgttctgatcaacatgttgaatttgtctttactttggccacgatgaacctgttgtggcttgtttgtgtactttttggccatgatgaacctgctatggcttgcttgtgtttttttaatcaagtatgaagctgcaaatagcattgcctatctgggccagggcacgcttgtcattccacatcccaccatgatggcaagctgatatgtctcaccacagtagtgaaattggcaaattgttaacagaaattctctccaatggcaaatctgtaagaaatatattaagagtggcatttggtctcgcctccaagctggacgaagtcaggggagctaacaactatcgatgtagcatctacgtatctggctccttttatgttatgtgatagcgtgacagcactctgattatattgtggcagctcttgtggaataagaactttctagcatctatgcgatatatatgccttgtaatagcaccttattgtggcaaatttgagctttagcaaggcacttggggcgaggaactttgaattgagaaggtaacaaattactagacgatggtttcgaactagtggcctttgttgtaatgaatggcttgatgatgcacttgttatgtatggcctaaaggtcctgaagattacgatgaacctgtttaaatcatacgatattctgatcaacatgttgaattgtttggccatgaacatactgtcctttttggccatgatgaacctgctgtatggcttgcttgcatccttttcatccatggcgagaccgtatgcgctgctggagtgctggtctccgtcaccgaaactgctgatagtgccgagaaggtctagatcgccctcgagagctgacctacgtctttgactcgccgttaacccccagccatggccacctaggtactttatgtttttattaagattgactggatcagattcaagcagcgagacagtggtgagcgatttaattcccttgaatcttctgaagatcttaaagagtggtacatatagattgtttgctgaaattaatttgctcatgctaaaggaattggaaaccatgtgctttctggatctatttacgtacagatggtgaacactttatgagcaataaactttttgattgtccaccaccagcgttatactactagctcatttcaaattttgatatgtatgggagtcatgttcttctacaggatttcatttcttttgcattgttagactccatatcagatttctcgcagattttgttacttttgtactgtttgactcgatatcagatctctcgcagactgtaatcaggtagtatttgatagaatgtacacaattttggaacgtagatttgttgggtcacctttggctagagttgtttcacttcctatttcctttaaagagctttcatttgcagatcttttttcatgtaagatcccatcagtcaatgtaagatagtttagacaaattttcagatcagtagtcaggacatggcattgttgaaatggcagcagtcaatgtaagagggtttagataaatgttcagaatcaggagccaggacatagcatcgttgaacagggtaccactatgaaatttaaaaaatgtggtcgatatgacgatgtgccattatgaagccttgcactgtgaccgtttggtaggttgatagaaaagcaaaatgattggattgggggtgaaatggatctggatgattgaataaagtgcttcactgttctgccaattgtcaaattcacttatattttccagtgcaaaatttagattttcaaaccatttgtccttttcttttcatgctatatctaagaaagcatatgaatgtgtattcactactacatccacaccattattctggtgactttattttggatgtaatatattttgctgtccaggggaaaggtgatctcttcttttggcacttatcttcgttcacaaatcacatatattaaagtttctggtcttggtgctatcacaaattaacaaaatgatatcagtgatcgcctccatccaaattgatgtttgctttggataaagatgcatgaattcctgttttgctcgattggtttgatgtgttgttgaggatgaaatggaaatattgtggtctactgttccgtttggatgaaaatatggtggtatactttcactacgtcagatcaaggctttagtaacacagctatgtgctactacaacctcaaaaacctgttgtggttctcggtaacacaaattttaagtgatcttatagcccatgttacttatgtacactacagtagcacaaaactagtgttccgacatacaagaaatatgtgttacaatcatgtcacatacctagtgttaccagatacactagtaacacctttttgagcatagctcgtgcagcttcccatgagtcctgtaagacctatcttagaggcagcaacacatatataggcagcagtaacacacaatcgcttagagccggtaacacatacaaatattttttttttttagagaagggtatttttttacccggcctctacatccaaccggatatatacggccattgaaataaggaactcaggaccttggggtactactcaggtcactataaccactaggctacatgccctttcatcggtaacacatacaaatatagacacgagtaacacaaaatcaacgaatctacctccagcagtaacacgtttataattttcagaaatgtacaaacatacttttatagtctttgataagcatcacatgtccacaataaggaaaaagtacgaatcccccccaactatcgcggtcgaccgaattatccccctaaactcaagtatcagacattttacaccctaaactatatataccggactaacgactcccccccctgaacactgttctgagcggttttgacttgagctagcacacgtggcgccaacgtggctgactagtcagcaaaaaaaaaatccctggcccacctgtcatccctctctttaacccaacctctcccagcccccttgctgtctctctcgtgcgcgtactcggacgaccagcggcggagctcgctcgcgcagctgggggcggaggtggaggcggagaagagccggttcccccaaatccagccgctgccgccctcttctcccctttggccgcccgcggaggaggcagccggagctcgtggtggactgtggtgcggggaaaggaggatggcgacggcgcgggggcgggcggtgtgcggggtcggcgacggcaagcttcttcgtggcttcgtggttgcggagcaggaggaggagaaccccgtcgcggcaggaggagctcccactaggtggaggcccagccgccgccggggaggaacgaggccggaggcagatgtggaggcggcggcttgcggcccgggacgacgaagaggaagccgaggaggcgcggaagcgacgtgtggtggcgagcgtggcacgcaccagcgcggcgggggaagaggcggacgaggtcgtcgcggagcgcctcgatgccgcacgtcaccgaccctcgcgcgccgaccgcccgtgcagctcgacctgtgcccgtgcggccgccacctcgacgccgcccatcgccggccctcgcgcgccgctcgatctgcgtccacgcgcgccgacccctgcgccgttcgagctgagaccgtgcggccgccaactcgacaccgcccgtcgccagccctcgcgcgccgaccgtccgcgcggccgcgcctaaggagtgtcgacgccagagagagagagaggggaagaggggaagaggaaaaggatgacatgatagagtatgaaaggtgggacccaccatgttttaaaaaaagggaaaatgctgattgggttgccacgtgtacgccacataggacaaaaccgctctgaattgggtcgaggggggtaattcgtccggtattaagttcggggtaagtgatgtctggtttttaggttcaggggggaaattcggtcgaccgtgatagttcagggattcgtacctttcccccaaaataacatagaatcaacatgacaagttgtattacataggaaaccagtaaataatatttttacatcaatctataacaagaaatctatagcaagattctataagaaatacaatgtctatatgactctgggacgatcaatatttgtcacttgatccattcatgagatgaacactgaacaatatttttcccaagttaaactaatcatatacttgcatgtacatttggcctggttacttcttacaaaaccttgatgaatgtgtaatggtacctgcacctcaccaagatgaagatattagaccatagaaattgacaaaaaaaagtacatatatacaggacatcaaataaaggagttcactgtagatttagttaaatccaaaataaaagtatctaagatataaatagtatggtcttcattcttttgtttcttttccctagccaggacaaatagtatatggtctagaagaaaaacagcatgggtaaacaaagggggaaaaagaagaaaaactaactattcgagaaataaggcaagcttttttctaggaataaaaagcaacaatgacttcacacagttgagaaataatataaaaggtgttgttttgaaacataatatattttagccatgacaagctactaagctagtcggatgctagatgaactgttgaataaaatattttcatgattaatgttggatgaaacacttcagctttaacatatatttcctatacatagatcagatctgcatttgcattaattattcttttacctgaacccctgaaagagttctgaagaaagcatttttaaatcagaaacatagaacattcatgttgaacagtgtagggagagagaaatacagcgaatattagaccacgttatattgagcctcaggggccggtattgttgacgcgaaaaatacacactggcccgggagatctgcttagatcaagtgcaggtccaaaggttgatgagatgcgggcgtgctagtcagtttgaccctgcaactgataagatatacaaatagcagatcaatgagccgatcggctgacaagccgatagattaattacagccgatgccgataccagccgatagcgatagggttttgagctatcggctataattctgatgtagattctgacgcttgatgtaaataacaatatgaagacaatcgcctggtgataatgcaagaaagcaacaagataatccaatagaaaccaatcggctaacaatgacatgctcgagtaagcactgatccgaaggttaaagcatacatcggctggaggtccgatgtcacaaaatccacacgattagataaacagtaaaatctttgttgcgatcggctaaatccaatatgtatgcaatccttgtaagccgatgcaacgtccagataacttatcggctaacaccccgataaaacattagcatgaacctatcggcttaacaagatttatattatcaacaacaatctagtaggtcgaacctaaccgatagagcacgagaatgcatatgataatctaatactcgatgagccgatagatctgtctaatgtgatggatataacaaatctatctagaacagcattgtgattgtagagatatttcggttaagacagaagatcagacctaaccgagacagttccaactaaactgatacgtctctaaacacaatgcaattagagataggactaagatatcatgtaggcaaatatatcgaccaaaccagagcaatccaagagatcgaagcgatgcatccttgaacaacaccaacggcgctgagagtagtattgatcgagagatattttacaatgacccagggtgtacatatttatacccatggggagatactagtccttgtaggacaagaaagaaactttcctaaagataaaaaggaaaacataaagtctttataggacactaaacacaatttcctaaagataaaaggaaactaacaaactactcctaattaatagataaactgccatgccgcatccttcttgaactcggtcacttctggataagctttctttaatagattaatttccttaaccgaatatagcaggaatcggactattggcgatgtgataattctcttaggggcttaccaaatttcactgttaacaggtatatataggttacatggattggatcttaagtatactgaaagagatagatatggaaactaatcctatccaaccataacaaaccggatacgatacaatcctatccatatactctaacatccccccgcagtccaagagtgagcagcgcgggcacttggactgaagaagaaaccagcaagaatgctcaatacggatgatagccctttgtgccatagtcgatgtagccgaaacgaagggtgtgagagacccgtggtcgatgaagccgtgcgtagagtagctgtcatcgatgtagccgaagtcagggagccgatgatgtcgaggtagcccagctgcaaggtgcgcatgggacaccgtagagtgaggtgcacgaggacatgctaaagacgatgacagtgatgcaatcgcgacagtcattgaggaagatgacgccaatgaatagtatagtatagggagagaggaatactgcgaatattaggccacgctgtattgagcctcagagggccgatgcatataggttacatggattggattttaactaaactcaaaaagatagatatggaaactaatcctatcctaccataacaaaccagatacaatatgatcctatccatatactcaatgccacgtttgttagacttccagtttcatgttatcacagtattattgaaccttatgtgcataagcacttaacaccaggacaattggaaaactaatcgtaaactgttcagcattgccaattctagcgctatcagcctattaatcactataagcttgtaaaaattgcttcactccctcacataaaaaatattatacatttgagcatattcaaatttagccctaaacattaacaaagcatagtggccaaattcagaaatgaattttaatatgcctatgtgccagtttgtagtgttacagcgtaaattttgggttgaatgaacaatatgtgctctgattgctctaaggaaataaattatccagaacagttaaagataaatctttgaagcgtgaaaacgattgctcaagctctgcaaacattcaattcttaaacaactgcacctcatggggatagataggaacttgtgtagttctgtgttccctgcttcccctctgctcgcaacctataggccaaatctcatcacaatcaaaacataatagttcagattagtaatacagagaaagagtctgcacattagagaaaggcgaggaggagttaaggatttagtaggcggccggggggggggggggggggctgtttgtcagtgttttctccaatggatcattacgtaaatcaaatttgggcccaaactcttccaatcgtgctgcatcaagacatcaagtgtgttcgagctaaatttttctgcatcaatctgtgagatttcaatggtagcagttgtgtgcacctaagtgttatttttaagaacggcatgtttctagaattttccaccttttgattccctatcaatattcatgcaattcagtactgatttttcttagtgcaatttaccaaatttttatatgagatgtgctcttttccatggaatagttacagtaagtatatttgtagcttttcagttcagttcacaatgtcataatagttcagttttccaatcaggtattaatgagtcctggatgtatcaatcatttgtgatttataccatgttaattaatttgtttcatgattggaaatttaatctttgaaattcaaatgagcatgttcttggtagcacattatgcttgagtatattcatcctgattggcttctaggtgcatgtccgttaataagctgtaagtatgtttttggtctgcagggccatggagaacaagcacaatttggttgcagagccaacatgacttgtccctctcactagtcactagtcaccacctagctgaatggtcagtaaacatctattggcttttgtttgcaatattgtaccggatcatactggatcttgcggttgaggttatcgactgatataatagtttaatttagcttatattgctaatgtcgtcatgccattcttaattactattgatttatgctttccattcatacatatcttgagagaaaattattgaaatccatgttcatgccacttgtttattggaaggcttgaatgaatgagtgaaactctatgtggggagtagcagcaggttcatttggattaaatcatcaagggataatgtttacatcttaaaatgaatgatactctctccgttgttacaagacattttaactttggtcaaagtcaaactaatctaagtttgactaattttataaaaaaaaagtactccctctatccacaaaagttgcacctattactttgtcatcaagatcaaggaaaaattaaattatcttggatgttacaaaatcaaggagtgaatgtaagcatgcaatcaatgagtatttagattactccttagattctaatcaaacatttaatttatctcttcatttaactcttgaatgcataaatactacaaatatgaacaacttatttggaaaagctcaaatgtgaaatatgtgtaacttttgtggatggagggagtaatatttttaacccaaaacaaaaatattatgaacatttatttaattatagatttagtgaagctatatttgtgttgtaaatattactatttttttctacaaaattagtcaaatttaaagtggtttgactttgaccaaaattaaaatgtcttatatatatcctgaaacggagagagtagtgaataagaaaatggtgatcttgacagtgatttgaggaagagcactacaagatgaatacttatttgcttctatattatagcaacccaattctaattaaaacttctattttcatttttcaggttccaagttgtacgcaccttaaaacttctcggctagtttttttagaaaagcgggttgttatccatggataagtatgagccgggcgcgcgcgctctgacaagacccgacgatcgagctgtgctagccgaagtagtactagtttcagacccacgcaatcgtcatacaagctagctaggccgcctgcatcgcaacatgctctgatccaaattagttttattaaattaataattaaatatatttttataataaatttattattactatttttctataaacttggtcaaacttaaagtgaccaaagtcaagacatctaacctgaaacagagatagggagagagtatttgctttgctatctacgagatcttaggctgtgtttagatccaggggtgtaaagttttggcgtgccacatcagatatacggacacatatttgaagtattaaatgtagtctaataataaacaaattacagaatccgcctctaaaccgcgagacaaatttattaagactaactaatcaatatggtttcaccgcagccgttatcaccgccaagtcgccaacagcttcctcaccgttgtgatgcgcctgagtatctcctccctctgctgcaccagatcatcttgcgtttgattttacaatgtaatcatgaaactgatactggatttacagtatgtttttagcccaaattcatggaaaggtagctaggaaggagtcttatgagcaccttatctgatctttgtgtcattagaggaattaactgacattcatttattgttatggctaatcagaattatttgatctgggattgctgcattcattgtaacgagctgctgaaaggcttttttttttcatatttgaaagaagaggcaacctactgggcatgatgccgccctggaccatgtacaggtttggacgatgacttgtagtggaatgagcactaatgtttttcttcatggtatttattaggttattccgaatcagaatatttagcatattgccaaaaaaaatgttggtgtttaccttctgctagcactctgaaaagcatattaactttttgctcactgacatgtggttcctaggtttgataaattttcccatgtgtgctgtcattgcaggacgccaggatccagttaggccttaattcttctattttatgacgaatactcatatttgatatttggtatgtatacctgtggtcctgtgcagatacttgccttgatgttccaataaatgtaacaaaaacttcagataaatgagcaatcatatgtttggagtttagaaataataactgaagagaaacataaccaaggcataaagcaaggtagattgctactaacactagactgaaactgaaggaatcacctattgcaatagctttatccaagcactcataggtacaacggacaagctgcttggaagcttcatcaacatttccaacaaaatatgtctcgttcaaatcacctgcagtttagttatatactgtgtcaaaaaaaccaacaactttcagcagcgaaatacaataccaggctgcagagaacttaccatgaactcctttgtaatatacagttacgtcgacatttacaatgtcaccatcttcaagtttcctattagagaaagatcagataaaaaccaaaatcaatttacctgtttgttttttctgaaaatagcagaaaacgttatcacaatactgatataatagaattgttacatttctatagcatttaattcattctttagaagttcaagaaatggacctttatgtggaatctggtattctgccttttctgttcattttaattatagagaaaaatattgattgttaatgtgcgcagttgttgaattggttgtcatgcattgtgtattatttttgctgtgtttattaatcatagaaaatggaaattttctatgtttaaggtgtgccatagcacttctgtcactgtactaaaaatggcaaattttatgttttcacaaattagtgatatttttacaaattttgcagtgtaaaggtgtgaaaattgagcttccttgaatgtcttttttttttacagcttttactaagtgggcatgtgttcgggaggattataatagtttagcctaattacattatgatttgataatatggtgctacagtaaatatttgctaataaaaatcaattaggcttaataaatttatctctaatttatttttattattaaactatgtttaataatagtgtgtcgtatatttgatgtgacaccagaacttttgtctgaacagccgcatgcatagcgagacagtccacactccagagtctcgactgcctccagaccggcgaggccagggtgagttgttggtggccacacccacacgtacagtacacacagagcaggagcaggagggcgacttcctccattggttctgcacagaaatggtggagtgtaacagtagtacgtacccggtccgtccattgcatgcagactgtatgtactcggatatgtacggtttatctatagcagtagatatgctcacttcacgcacgccaagaaccatactccgttcaatgtacaccgtgtttagttccaaaaatttacttcaaacttttaacatttttatcacatcaaaacttttcaacacatataaactttcaacttttccatcatatcgtttcattttcaatcaaaatataattttgactcgcaatcgctccctgcatataccaggtgcatttaatttgatcaatcccatcggcaagcagcgcaattaatgtttgctactgtaaatactcgcatcggagtagctggatggaatgtccacgaatacaattcagctatgacttactccctctgtctcagcgattttaagttttcgctcgtatcgtttgatcactcgtcttatttaatttttttttacaaatataaaaaacaaaaagttgtgtttaaagtactgtggataataaagtaagttacaaataaaataaataataatctcaaaattttttaaataagacgagtggtcaaacgttgcatgtaaaaacttaaaatcccttatattatgggacagaggaagtatataatattgctccgttcccactccgtatacatattttaaaattcaacttttaaaatatttggttagtaaatattttattataaattagattttatttaatgaaaacaatatcattggattattatttaaatttacttttatatgattatgattttgttgctataaatattgtagtatataagaaatctgaagttaaatattagttttaaagacttagttatgtttgatcacgtcttagtgagtaggacggagagagtatatgtttcttagggagtgggccagccataaatttttttaaaaaatatatttttttagtttgttgactagattgccatgtgaccaaattgtcatcgtgcaggtggcagctaggaccaatactactttgaatgttaggtaattcgtctagtatgaagagttctgttggtagaatgtcgggtttaagaatttaggggataactcatacattttgagaatagttctagagttcctgatgagatactaaaacatcgtaccatttctattgtaaaaaatatcctaataagttgcctatctaattacataatggcagtaccaggatttatgaaaaaaaaatcggttgctttagggtgtgtttagtttacgtcaaaattaaaagtttggttaaaattgaaacgatgtaattgaaaaattgaaaatttatgtgtgtgtaggaaagttttaatgtgatgaaaaaattaaaagtttgaagaaaaaatctgtaactaaactcagccttaatctgaaaaaacattcaaattcgatgaagaaaacatgccaggtcgggcccatcatatatatcccgacgtagtggccgatgaggaggatgagggagaacaaattaccgaaagaggaaagagcggaaagctgcaggccgaaaaacaacaatacgtgcagggtgtgcaggtgtgagagacatactgtatttctgaagctgaagcagctgcaggctgcagcctggccacgcccagagccacagctagagctagctataggcgtgtttgtactgtttgcactgcacccctatgccacatgggtgtgttcctggttccgggaatttccttccgaatcgaggaacggggactacctggaacttctgtctcgaaaatagatgggtcgttattatgctacagaacttagaaataggattgctgctaattgtataatttgaataggagtgctagaactagggagcaaggaggagaaaggttagggcaaataagctcatgattatgggtgtgtttagttctttgggtgtaaagtttttgaagtatacggacgcacatttaaagtattaaatatagactaataacaaaacaaattacatattctgcctgtaaactgcgagacgaatttattaagcttaattaatccgtcattatcaaatatttactgtagcttcgcaatgtcaaatcatggcgtaattaggctcaaaacattcgtctcgcaatttacatgcaaactgtgcgattgttttttttcccacatttaatgccccatgcatgtgtccaaacatttgatgtgacgtttttggtaaaaaaaaattaggatctaaaccaggcctatttatagtactgttgtttagttttggtggcatatttaaaatttgagtttcaaactgtcatgtttgtaagtggcgtcaataatgcggatacggtagaatatatgcttttgtaaactcattaatgttaacttggtcagatgttttaagttcattcccaacctaccaaaagcaacagtatattctccaaataagtacattaattagttcattgaatgtgccaatgtgtacttccagatgtctatagatgcacttttttctcttccttaatgagtgctaaattagaaataatcccctatatggatagggagagtaagaatctccatgctcggatgctcttatccctgtaaaatcaaagatgtttttgattatttttctgtgatgaacaattggcattgaagattatcggttttattatttggaatttatttatgaagtggttttggagatgattggatttacagatgaattgcaggtgttgttattttatgtggaccggtcagaccgggcagtggttgccggtcagaccggcgtgtattgcgcggtctgaccggacgacactatgtcggtttcggtttcggattgtttgtttggatatccgtgattatttcatgattatgtcttctagatggatactatgcgtatgtaatactgttgtttgctaatattgagtcaagttggagatagcttggtctcggaatatggtttctttgtttgttccatgtgtaggtaactcgatgtctcgagagagtatttgcggtgatggaccgggagtcggcttggggataagacgacgtccgtggtggtcagatatcatgcgggatacttaggctagagttgatgcacgtggttggtgaagattccatatggcatacgatggaggtgttgtgtgcgtataggatgcggagtcgaatttggaaggagtccaaatttggtatgagtggttatgtaaagtttgtttcttgcatgagaaggtttcctatggggatttggacttctagtatgagtttggttcgtggctttaggctgcctaccttatgtataaatagagagggagcgtgaggcttcccggtatcgcttttgagagcaattgagttgatagtttagttagggtttcgagttttctcgagatttttgtaaagagtgttgttgatgtactttgtaaacacagagataatcaataaagtcgtcatccactttaagagttcttcgatttgtgtttcaccgggtttctgtggtctaaccggcatctcaccggcagtcagaccggcgacaagcggcggtcagaccggtggcttaagggcggtcagaccggcagcgactccaggcgcgacaggcatcttcaggcggtcggaccgatcgatctacaccggtcagaccgacgacatcagggcggtcagaccggtggatcatcttcggttagaccgatctagtcgaatttgagggtaacttttatttccgctaaaagtttaggtttttgggtgttccaaccattcaccccccctctggttggcttagttcttactgttcgatcctacaatccccactataggagtagtttcttttgagccgcttactaattttaaaatgtattttttgatttttttcaattaaagcttctttttataatattggttattaaattgctaagatacatactcctatataatttttttaccaataaacctttttctaagttgttaagccattgctttatcagctaaagtttcgtttttttcctgttagcatacactatcatagaacatgctagcttgtgaaatttcgagtaactactgtacgttaaaaatttaaaagactatcgtttgtttggagctaacatgaacttagaaatagggtctgtttggcaggccgactgcgatggctgcggctgcgacggcagctacgcacagtgagtgcggtagcctgggcagccgaacaggaccatagaccggccacggccaattttaaaatttactacaatttaatcagctgtaggagtagtctgtatttatctggccatatttgctttaaaatcactaatatcaatgtatattattgtctatattagctgaatatttatggtcgtagagtaataagattttaaaccaataaattagtatccatgtaatactgtagcttaaattgtctgtcccatgcatggttggtatggtataggagtagtagttcatcaggggttcttctgaatgaagcgtagcaattccacatgctagtactacgcggataaaaatgaaaataggctattctatggttgcactttatggacggatggacaagctagggggccaggctcatgttgatgaattaaaatactatcaagggtgtgtttagtttcacgttaaaattagaagtttaattgaaattagaacgatgtgactgaaaaattggaagtttgtgtgtgtagaaaagttcgatgtgacgtttttagttcaaagtttaaatctaaacagagcccaaattataaacttctctcaaacagttacagtacattattatatactactggagttctgttaacacgtttcctgattaagatgattatcttattcaatttccatcagcacgttttacaaactattttaaaaaataatttatgtatagaagttgtcttaaaatattaaatacatctgtttttaaatttataataattaaaacttaattaatcatgtatacgcgctgagttgatatttatcttaatctctcttaaatactccctccgtcccataatataagggattttgagtttttgtttgtattatttgaccactcgtcttatttaaaaaatttgtacaaatataaaaaacgaaaagttgtgcttaaaatactttggataataaagtaagtcaaaaaaaataaataataattttaaatttttttgaataagacgagtggtcaaacagtgtaagcaaaaacttaaaatcccttattatattatttgacgatgggagtaccatactactctacgtgatcatgatactattgttgaaaaattagtactcctactcctatatcgcacgtcttgctagtgagtgacatgtgatgtactaggtgtacagtactctacaaaattgacaggagacctacaaaattgacaggagactgttctagctcgcagtctcgcaccgtgcgacacccccgacgaagcaatggtgcagtgagatacatactcctatataaaaatgtttaccaataaacctttttcgaagttgtttagcttctaactttttttcaaacttctaactttttcatcacatcaaaattttactactcacaccaacttttaacttttttcttcaaacttccaatttcagtcaaatttctaattttgatgtggaactaaacacaaccatgttgttttaccagctaaagtttcgttttttttattcacacactgacatggaacatgctagcttgtgaaacttctagtaactgctgtacattttaaatttaaaagacgatcgtttgtttggagataacatgaactaattatatatatagaccacggcaaattttaaaatttactacaatttaatcagctgcaggagtagtctgtatttatctggccatattttctttagaatcaataatatcaatgtatattattgtctatattagctgaatatataagtacatcctttaatttctttcaaggctgggttaattctattgtgttctggtattcagcttaaccactttgctagtgaatgtgttctccggaccgctaaatggtgaatattaaaaaagtatagaaaagtttattttagaaaaaaatcaagtaataaatctatttttaagtttacaaagttaaattcaattaatcatgtcatattgactcgcatgctacttttaaatattataattttatttgaagtagaagtctaatgaaggcggatgcggcacggctaccgtggcgggcacgagttggagtggagcagctcgtagagcataccggtgcttcttggtggtcaacgatgacgtgaaagtcgaaaaagccatagatgttgataaggctcgggcgcagagagaggagaggatgtgaatctaacggtgatgatagaaaatatgattgtgatggtattgtttttagggtgtgtttagttcacgctaaaattaaaagtttggttgaaattggaacgatgtgactgaaaagttggaagtttgtgtgtaggagagttttgatgtgatggaaaagttagaagtttgaagaaaaagtttggaactaaactcggtcttaattttacaaaaaattcagtaacatgtaggagtagcaaatattacggatagtaatagtatttttataatataacgattatgcaatggtatattggcatgtatcggattaatcctaggacaaatatccgtagccagtcggtctatcagtctgtagctggtctggttaacaagtgttgtgtctgcgttgtttttctgcaccctctcgagtccaatcgcttatactgtatccttgcatcaagtgttgacaagtttatctactaccactatagtacagtactttctccgttacatacagaaccaatctaatacttgatgttgatatacttcatccgtattttaatgtatgacgccgttaaatttttaaccaacgtttgaccattcgttttatttaaaacttttgtataaatataaaaatatttatgtcatgcataaagaatatttgatgataaatcaagtcacaataaaataaatgatgattacataaatttttttataagacgaaaggtcaaacgtttattaaaaagttaatggcgtcgtacattaaaatacggagggagggagggagtatcatattatcatgctttgctgtaactgtaattgtcaatccaaaatacggaatactatggctgtcttgggtgctgagcgaggcactatgaggtcccattgtttcgtttattcatgaaataaactaaacaacatatttacaaatgaaaagtaaatttatggctaaacttttatatatgtgttcttagcgatctaaaagcaaagactgaaaaataaacttgaataaaaaaaactccaaaatcagcatcaaatttaatgttgaaaaatcaaattttagctgataagtataaccatgagcgaaaatatgagatcctgtgattgacgccggttgtccaaattacggttggtcgtgggcctctagctaaacctcaaatatttaaactccttttctagaaaagaacatatatatatatatatatatatatatatatatatatatatatatatatatatagtatatatattgttttgcgaaattggtaagacgtttctctattttctctagcaccttcactgctactgtaaaaaaaaaccgctaatagccaggtaacccctgaggcctaacctctaacctctatggtttttaatagaatcgtttaggattatttaatctctcagtgctaaaaaaaaactcatttaagaactagcacaactacgtacataaactatttctgtagacggacaaaaccagttttcttatgcggttggcatcccgcatgcaaaaaaaatatctatgaaatacatttttctgcatgcggctagcataatcgtatgggtagatcaatctttgcatgcgagcaaatctacgtaccgctcgaatgggaagagcccattaaccgttactagtatagactaatatctaacggtcctgaataatcaatagtttttaattaagaacccttagatcgagtctaaatatttgtctgctctgatttggtggaaatgcgtaatatataaaccttagagaaataaacaaaacaacctttctattttaaatctaaaaaatatacttcgacaaaaaaatcactctaaaatttaagtttcaaaatttacatgtggctcatgagcttaattacaagtagataaggagagcctagttgcgtagtattcattctgtctcgctgaataaaacgtattgaatttttgtgtaacagtacttctattgtagatactagctacactgtctactacagatgacatgactatcatttttcgtagcatgaaaaatcaacatagttcgtaatgctttttggctagagctagctggccacttttatggagaatgcactggtttatcctctgggacaagcccgtaaggaatattgagtcgaacggtcgaatcggcgttgtgtgagagccatctgtaataaacgcattagttactccattcattctaagctaaaataaacaatttgatacgatatatatgatacatcttagtacaacaaattagttattaagataatatatttagattcgttacagaatgtgtcccattaagtttgtttattttgaaaacgaaggaagtgcttaagggaggagtactgtgtttacagctgatgtgatagtgtgtgatgttttgattggataaaacgactgtgtcaccctcccacatactactaaattattacgtggcactctaataaattgatgaacctatttattttttttaaaataaaggccccatatacctcacctctctatcctctttacccaaatacctaattgtagttttatattgtgtacgtgggtacgtgcctcctccctcccctcctacttggtctcccctcttccttttttttaagaaaattaaaagtaataaattccataattttcgaaaagagtagtgacatgggacatggacatgtactgtagcactatctagtggaccacccccccccccccgcgttgccccc

SEQ ID NO: 42972 - DNA, 35440 bp, Oryza sativa
atcccagcgaggagacggcggatccggcgccaccttcgtcggatctggccatctcctggccggatccggccggagggtgtgtggttggtggcggacaaggccgtggcgcggcggcgcgtgaagggcggcagcaccggcgcgacaaggcggcggcaacggcgcggcgttggcagcggaggcggcggtgacgacgcttgcacggctgctggcggcagctgccgcggcgaggacatgtgcgcgggagacggagctcgcgccgccgggccgggcggcagcggggcgagcgacaacggcaacatggcggcgacggcggcgcgaggctcgacggcggcggtgccggtggctgccgcggttgtggtttgaggcagccgcggcaacacacgtggtggcggcggctgtggctgacggtgcggaggctgaggcctcggagctcggcgcagcggtggtgtcagcggctgaccggtgactgctgtggcacggtgggaggaggcacggtggtgtgttcggcagcagcggctgcggtggcggtgactgcggtcaccggaggcatggcggcctcggacggctagctgagggtgtggcagacggttgcatctggtcagtgcggtatcgtttggaggaggggtcggagaccggcttggcgcagagtggcgcagccgatggtagcggaggccggctcggcgcgagaggcgcgggcggcggagatggaggccggcttggcgtgagaggcgcggctgatggagggaggctagatcggcgcaagaggcgcgtccggtgaaggaggccggcttagcgcgagaggcgcggccggtggtggaggaggtgacctcggtgtgaggaggagttgccagtgggtgtgcgtggtcttcggcgctcgaaggctgaccagcggaagacatcggtgtaggggtcccacatgtcagtagagcttgagtggtgatggagcatcggtgcgtcagccgtggattcgcaggtggtgagcggcgggtgaaaatcctgagggcgttgtcgtgctgtctcaccccctaagggtggttgccgggcgaaagcctagtctttggcttctttgagccccgacggacggcggcggtggtttttccgtcgcttctctttttgaagacgtcgttttagcatcccctagggggcgatctcgtctgtgtacctttgttggtctagcggcggtcggtcacgcttagcggcggccggtccggtgctagtcttctcccgggttatgtgttggcgttgtcggtgtgtgggtggtggtatattttttcttttttcctggttacgaccctccagggttgtaatcttgtatttttagctttgtacttgatccacactagttgctctctattaatacggtgtactagaaatacaaatgaactttattcactaacatatctagaatttttatataggttatctaacttgtatatatatttttaaaataccctaaaaataacaagttaaaagcatacattgatcaaatgtgcatcacaacatactatcaagagagttgtttttttgtctttttccaaaagtttctttttgctatgtatatatccaggggcggattcactgttgggcttgttggagcgcaagccctagctccagcttctagccccaagtgttctcccaataagttcaaagctagtagaagacactgggacagttagagtatacatgttggggcctgcagcgactagagaggaagaaaacttgcctatagctctgcggtttgattagtgctcaatctgttatccagtgtttattaattgctaaatgctataccaagcccaattcaattaccaaaccggtgaggacaattaccaattcaattaccaaactggcgaggacaagacaacacagatattaccatctacaaggagctcttggtttgtatctgattagggcacattaattggagggtttaattcaactgagcatacatgtttttccaaaatgaaacatggatatttttaagttcatatttttcaggaaatatgatttctagtactgagttatatttttagctctatgcattagcaccatctctattttcatcttagattcgccattgtatatatccattacatattggccatgttttgaaatatctcatagtactcctcattcctctcgaatatgagggcatgttcatagtagtaccttcaaatagctacaagctgaaaaaaaaatcagataatccggctgcgttcggcaacaactgatcgagaaaaaaactaaacgttttgtgttttaccaatattttctgtaggaaagttattttaaaatttcaaactaatatattttgaatttgaaataattgatactctattaattatacgctaatagttcacctatcctctcaatgttctaattaatcctatgctgtataccgcacagagcaggagttttgctcagaatcagaaatggtggagtgtaacagtagtacgtacccggtccgtccatcgcatgcagaccgtatgtgctcggaaatgtacgtacggtgtatatatagcactagatatgctcactccacgcacgccaagaaccatacaagtcagtcactaccagtaaactccgttccatgcagtgcaccaccgtcatattatccccatgtgcttccatggccgtgcacgagcctcgccgctgttgcccccaactgcggccatgagcaaccacgtctccacgagcgccataaccgtgagccatggtttgcaagttgtggcttaacccaggaagaagcagccagcgcgtgggctagctagcttctggcgatgcactccatcagtcgcgatgcatgcccaggtgacggggatcgaggagagggaaagcaagcacacactactgggaagagtgatctttgctaggttggttgttttccacattaactaaatattatttttagtctcgattcatcccctatcagaggcttgtcaggaggtcgaggatctttagtggagtaaagatcaccactttagtcccggttggttagatctttaatcccggttgataataccaaccgggattaaaaatctatctttagtcccggttggagggagtaaatatttctctcccatctctgatcggttaagtcccagacgagactttactcctcaccgagatatttagataagatcaaatcatcccctcacctcctacccctcggatctcctcccctttctcctcccctcccctcccttctcctcctcccttcctcctctcctcccctttcctcccatccggcggccggcggcggcgggcaagcggcctgcggggtagcgcgcagcggcagctggcggggccgcgcccggcggcgactggcggggcagcgcgtggcggcgccggcggggccgcaggtggcaggcgctggccgtggcgagcagcatccatggcgggcgacagcgcgctagttctcctctgtcgttttttttctttcttttttttgataatttgtgatttatagatgtataattgatctgtgatgtatttgatttgtgtgtaaattttttaagatttgtgatgtatttgatttgtgtgtataagtaacttaggatttatgatgtgaatgatttgggatgttacattgatttggggatttggggtttgattaaccctagcaagtagcaaagaaacaatgaaaaaagaaaagaaaaggggaccaaccgggacggcgctaccctctctttagtcaactttactcccggttatttcacccgggactaaagatgtgcatctttagtcccggttagaaaaccaggactacagggggttcccaaccggcactacaaatggtttctccaatagtgacaggattctgtttgacggaggagggggggggggagcagcaatctccacatcgatgtgaatatgtgatgcccggtatcatgtggatgtgtacagaaatccttggacgcgagctccactgggagaaaaaaaaaggatgttcaaaatatgtgctcagccaagaagatcgacaagtttataaatagatgagggatacatttatacgtataggtaatgtatcccagttttaataaactaggaatgtagcccacgcatttgcgcgggcatgtattgtagaatgtgttgcttagataaaattttaatctgtttgttagctttttcggtataatatttaatcattctttaagcaattatatgtaatcttcttcatcacttaaaatataacagacttagtttgttcagaaaacatatctaacaaattaaatgtaaattaaaaagtaggtgtttttttttaaaaaaaatgaatgtttaggagctatgttttctctatcaaatcttaaaagactattattgctaacaaatgtgttttatttataccatttagctagccctccttttatttggtttatattgatgcactttaattactacttatatatgaataagacagaggatatatacatacatcctaggtctcgattccctatgatatgtgtgatccattgtacttttaaaaagaaaaatctaatcagcttgacccttaaaaattaaatttaatagttatgaatataacttctaaatcaactatatactgtaaccttaatatttttgcttatacttgcaataatatgtggagaaaatcataataccatggtgtaggatagagaaaaaatattaatatctaagcacttaattaaaaaaaatgatgcaatggttatggcaatggttgtttcaatttaagtgcaagtatgaatcaaaagaaataataagattttctccaattagttcaattaatgcagttcatattggcccttttttttctattttctgttttgttttatacaattcttattttaagtttaaactttgtgatatgttaaatagtgacggtgcgttacacattttatgtcatttttttgaaaaataaatgggctaccttttgtataagcatgtaagaccgatataggttctcactattaattgaatgtaacctatctgaatgcatgagtttgttgagtgattgcatagtgtgggaaataacctatatgtggacgttttatgtagagtgtgcgaggctctctatagcctagcgtgaatacaatcggagggctaaatataattgtgcacacatttttttaatgtgatttattatgaatacatgcttgaatatctacggatataccaaagtgcattaaacaccatctaaaatcaattagatggtaccttaaaaaatctattagatgatttagagcgcttaggctactcgaattatttgaccacattaattttaaaaaacataaagtaattcgatttgttttctataactaaagccactggattttttatgaagtgatttggactatttatatttgagttaaagtttcatttcttaatttaattcatgtttgcaaaacaacgtatggtggctcaacttgtattattgaattattttataattcttttatggcaattcggatgacatgtaaaaggccaatggtatatgtcccaccgatttttttatttgatatatttttcttaggcattgtatatttaatttagtttttatgtttacagaataatatatgatggtgcatcctatgttgctgaattatttcatagttattttatctttggatgacatgtaaaaagggcagggatgttgtccgtcaaaaaaaaaatactgttttatactttgatgtataaagacgtaatttgtgttgataattattgatagtgcacgggtcattgttcccaaatttcatatttcttatataacaaaatataggcatatgcttgcatttttttttcattataatacaataaaagttagatcagacatcgcacatgtatcttataactattgactatttcactttgatagcttatgattaatgaagagcgtagagttcgggccaaaagagagaggggtgggtagtgttgtgggcatatgagcgagggaggtgaaggtgactttctatttctattttcgtgaatgatttaagtgaaatccaataatcaggtgtcctttttctcagatttctcattttccccctatttttcaagacatgatatgtttatagtgcttgaaaataataggctatcgatttaagtagaaactaatgatgctcgaatttctaagaattttttctagttttaaaatgtgacacatggtgacttaatagaacgttagatgaatctgtattgcgtagaatgatttaagatgacactaaaatattaatgtttcgtggttgtttggttgttgctggtacgttcaaatgatgtattttaacttttatatagaaaaatagtaatatagatgttgatttacttaattaattactccctcctccgttccaaaatataagcagttttagcatagtgacaagtcaaatatttttaactttaatcattaatgacaaaaaaataaaaaagattaatcatgtaaaattgatgttattagatttatcattaaacaaactatcataatatacatatctttttatttaaaacattttattattgtagatatttttggtcaaaaataatatctcaaaaaccgtgttagagtttaaaaatacttatattttagaacggagagagtacatcccatccaaacacccatcagtccatccactgtctcccacctgtccatcccactgtctcccacctcccacgccaaaacacttccctcctctcccacgccggcaggctacgctacacgccaaactatctacttagggttttcccaatcctccgccgccgccgccgccgccgccgacgacgacgacgaagaatgatccgcgtgttggccaaggccagcaacacggcggcagtgccgtcgtttgcgcgcaccatcgcaacggccggggcagcgtccgcccgttccgccgccgccgaccaccccggcgccggcggcctcgtcgccgaccgctggaccctgccgaccgctccctccgccggcggcagcagtggagcggctgcggtcggggtcgtcctgttctgggccatgcctggcaaggggaaggatgtcgtcgtcgtcgagcaccacggcggcaggaggaccgcttcggaggcagctggcggcggcgcgctgttccaggcgacggcggtgaacggcgtgccgttccgcggcaaggtcggcgtcctcggcgagccgattcccgtccaagtcaagataaagagctctcttttcaccgccaccaccgaccaccccggcgccggcggcctcgtcgccgaccgctggaccctgccgtccgctctctccgccggcggcagcaggggagcggctgcggtctgggtcgtccccttccgggccatgcctggcagcctcggcggcaggagcaggtggaccgcttcggaggtgcccggcggtctgctccaggcggcgaccttcgtcgtgtacagagccaagtccacgtcggcggtcgccggcgtgaaggacgcggccaagactcgatttctggatcgcgccggcgccgcgcttgccggcgagcggcttgtgcggctgctgctggggccgacgacatccccggagaggatggctgtcgttgctgccctgaaaagggtgcacaagctcttgtttggcgatggttctgtgcggctgatgcctcctcagcgtcccctcccgtcctccgccaccaaccgatttgccgaggagctgcgcgccgcgggagtgatggatgtcaatggcaaagtcaatcaaggtgaagctctgggagcagcagtgggtaagattgtggaggccttggaacaacacaggtgattctattactgatgcaaatcatttgctttagctgcttgcctactaacactgagacaaagttataacacgttttctgaattgtgcttacagtgcttatatgatgaagtaccaccagagagcaggcgccaaggacatggtgctccatacacttttcttcgtagcacagatcctgttgatgacttactccagcttatcagagttgcttgaagacgttacagggcacaagacatgggagagtttgtccatccaggttcagcagaagctccattgggtaaaggatcgcacactactagtaaaagcattatcgcaagcggccgaaaagggtcttcgcaggtggggcggccgtccacctgtaagccaacgactgtgaagatcgccgatcttcgcaggcggggcggccatccgcctgcgaagataattttcgcaggcggacgttggctagtctgatccgcctgcgaaaataggaatcggccgcttgcaaaaaaaaaaaacttcagcatgcgaagataggtagaaaatattgaaatttaataataatttgcccgtaaattacttttaaattatttaatagaaattcttgcaggtagattattatgtacatatattggaagattatcaagcatttggcactgataaatgtacatatattacattacttaaaagtgttgccaaaatatatatattacaatatttttttacattgtcacttcaaatacgccatccagttaatacattatggcatagcactgttccactcccgaagatccttgaattcgtcacttgtggctagggcaccctctgggtcgaagaaatctcctttcacatggcagcactcatggtggatgaagtgccacagatcacgctggacatttttgatgcctgtatcgtcaaagcttgttcgacgttctaatcttggcaactgcatgcattgaagataaacaatatattagtatcataaatatgtgaagctgtctagcatatagtatagagacttacatcctccgcattagtcttgtacctcccgttaactctaaggaattcgcaagcgtaatacccgcaaaggaccgttcctcacggttgcttgtgacacttcaggacatatcataaaaaaatagttaaaatttgcaattagtgaaataattggtatacattaagtgagtggagtattaccggccaataggtacgtactagcagcttctccctagttcgggtctgttctccatccttgaacttgtaatactggtacgcactgtatggatgtcgtaccgtttcacattaaggaggatatttatttataatacattcatataaaaatgcaagagtcataatcacttactactgtaagattgctagaaattctttgtatgactggtgtctgtaatcgagagggtccaagactaccacggttccgtctttagggtggatgagtaaacagatataatgatcgctacatattaacaacagcatagttagttagtaccagctaaaataagacatatgtgtagaagataaatgtaccggacttacttaaaattataagcggccatgacgactctcttattttgaaagtgcaagaaggcttgtccaatgtactgtgcgacagtaatcaatttctccttgtgcaagcctttcttgtattcagctatctcttttggattcatgcccttcagctggtcagactctggtgctagcctcacggtatgttgtgtttggcagatccgagttggatccaagaagccgataggttcttttttcttcttagcatccatgtattgcatcctacagaagaagtttgttagtaacaatcacatggatttgtattgtacatatttttcatataattaattaaaactcatactcacatgcaccaaacaccgacatagttgacgtccatcttatcccgacgacatatggcgtggagatctgagaaatctagccatacataaccttcttcgccgaaacaatctgccggtaatcgagctgttatattgcccaagcctttcttgctggcctccatgtagaaggtatgtaaccttttcatctctcatggtccttcattcagtgcccattcaggcaagagtgctttcccatgttggtacttttccgggcaatcatcggttgtgaagtatgttggcccggctagttcagcggtcttctaggggtcatcatctctgagcttggcacgttccttaccccctctgaagacggttaccatgaacttctccttgttctcatctttggacttggagtcgtggctcctaagcactctaggcacctcagaactggtagtggccttcttagggacagtggtctcttgcacctcggggtctttcgcaggagaagggtcttcaaatatttctggctctgtaccgtcccattccaatcctggtacttcttctatttctgacccgactgatgccacaaattgcacctctggttctgccactgtaatctccatgggcatttccggcactggaatctccatggctgcctctggcactacaatctccggtggcacttccggcactagattatccttttgcatctcgggttcctccgccttatcagtcaccttcctcttaggaggtctcagaggttttcccaaccccggttttggcaccaaaggtttttccgtggcatcggtgcccaatccaaaggatatgtcattattgtgccagagaattacaagatcgaccgcatccccaagtacggatacaccatctgcagtcaggaagtcaatgtcgtaggactcaaacccttcgtggaccacttgcggctgcaccttggcatacgcattgggtatgaactcttcgttgtatgttctcccagggatagcaatggttgtagcggcctcaagagttttcccggagcgtccaatgggaacgtgcaatctgcagggcgtattctccttgaggtcatcgaaggggtaatctggttcaggttctttggtttcgaggcgaggcaaaatcatgtgcttgacgcagaaatccatcatttgcctttcaaactccgcagccccttcgtctctaagtttatcattgtacgcttcacgcttcttgtgggggtcatgtttgaacccttccttccaactcatttttctcgacacacctcgaacccttcccccatgctcaggagtacccagcgccgtacttagcacatctttctccctcttaggcttgaaaaatcctttcttctgtgaactagataaattctctattttatcagcaacgctctacagctccggatcttcaaacaatacttttccttcattcgtgatcttaggagttctagctcttacccagttccttgatctctgtgtccattcctccattggtaccggttgccccttcttcctcattttctcctcctcttttgtccattgctccacctttggtgcgtatcccgcggagcctaagcgatgaggaaatttgttcttcttggccaactctgcatactttggctcctttgaatttctttcggggagttcttcaacatcagaaagtcatcccactgattcggggttatgttgtcatacgtcgaaaatggtgtgcgtcccgtcttgacaaattttgtgttcaaggtggttttccaaccacgccaagacttggccattgtttgcagtgcacaattcctcactgctgcctctgatccatccgggaactggaagattttcttcaactctttccataggacttccttatccccattcgatacatgatcccagtccttcaccgtgatggggatcttttcccttactattatgccacactgtgaactgaatttcgcacgtgccgtcttagaggcgagcggctctccttttggcgaaacatgggtaacaacatggaacccttcatcctttctattcacgcttctctcgcccttccttttcttcgccttagctgaccgttcgcttttctttgagccggttgtgttagctggtacctcgtcaatttgcgacggaactgccgttttgatcgccgtggcgccgtttcctacgagaaggtatacatgacagtttcaaattagctcgggctaatagttatcacggtgaacagtttacatattatgtttacttaccccttctttagggggaatgtagtctttgtcgccttcttcaccgtcgccctttttccttctcttcgggcttgggcttggacaaggatcgcttggtgatgagtactcatcgtcttcgtgagctacgtcgctgccggaactatcttctggtgggaccgttggttccggagcaaccacaatagtaagggactgctcttgctccactaaacctttctcttcagtccctttagtactatcggccatagtttcaaacctctaacataaaagaaaaacaggctgacggggtccctgtatgaggatacagagtagtacgtattttcgcttttgacagagccaggtaggaagattatacatggtgagaagcactggccaagtactatatgagctgctcatgtctccaaaaggattaactccatcagtactcagggcaaatctaatgttccgtgggtctttagcaaactctctgtactgagcatcaaagtttatccactgacgagcatctgtcgggtgttgaatcatcccatcctttttgcgcccttcttcatgccagcgtattagttccgcatctcgcagatttgagtatatccgtttaatgcggtctttgacaagaaggtaccacatcacaagctgcgggatttttctctgtcgtccctcagttgtgtcagacggttctaggccagtattgctattcaatttgtaccggctagcaccgcttattggacattcatctaaagaagcgtattctttcttgtatagtatgcagtgatttacgcacgcatgaatcttttccacaccaagtgaaagggggcatatgagtttctttgcttgatatgtgctggatggtagtgagttaggcctcaggagcattttctgcagaagttctaacaaactgtcgaaattggtatcagaccatccatgtctcgcctttaacctcataagttcaagaactgaccggagtgttgtgaactcactgtcacagcccttcgactcatcatacaaaacttcctttgctgccttctgtaaagcttcaaagttatttaaccctctagccgaccccatcagcacctcgggttctgcatgacgtaacatttcctctaggtcgattttgtccacaatagaaccatcgtcatgcaccatgtcttcaacttgtgtcggaactacattttcaggcccgtccacttgttcttcgccatgacatgtccatatttcgtacttgtccataaatccacgagttactaagtactccttcacgttaaaagcattgtcaaagttccaggctatttcattcttactgtcagcgcatggacaaattatcttcctcatattgttcttctcagcgtgtgtcttggcaataccaataaatttagacactttgtttctatatggagacaaaaaccttggccaatgatacatccattcccgactttccatatctctaaaaaaatacacgtaaaatatttgcacaattaataccaaatttgtagggtttattgaaaaaacttatcgctattcaaaactaattaactaaaggttaagtgtaaagtaataaaaaaatcaaagtttatttcaattttttttacacagacatgccaaattagtacattaggaaaatctaacaaaatcatatcatcggcatattacaaaatactataactattttttgattgcaccgaataaatagacattaaaaattttattctctccctatatatgacaagatctagatctagatctagaactaagaggtggatgtgatagcaaaaataaaaaaaattgagaatttatgttaccacattaaaccactacaacaagaggcatcaagtattacacatacatctaacatcaacatatcaaaagaaataaaattaaaaaacatggagctcttccttcacaattttgcatgcataaatccatcacaaattaaggtctaaaagcttaaaaaattgcatacctagtgtggaaatgagtagatctaagtaccgtagaaaaatcccccgaagatttgaagttcaaaacatcccccatatatttaagtcactttaggagagagaaacttcggggagaatgaacagggctcggggaggaagaagactatatagaggcatctttttaagccggccatataagcggcgcctgcaaagataaatcttcgcaggcggaccgccccctccaccccgggtactttttttgccggcggggttttggctccgaattacttgtccgcctgtgaaaatcgatcccctatgacatcgaaaatgaattttctagtagtggcactggggaagccacagtggatcagatgcgagaaaacccattcctatattgcttcttcttactagatgatccttttgcttagcttagttgacgttgagctgattcacaagagttattattctactgcatgtttgtgttgttctacaggacttgctatgctttttagtattcaataatctcaaatcgtggcttcagtagtagtagtagcgtgtttttttttttttgtcaatgaagcacggagactgggactagatcactagaatgaactgtatgtaaatcgttgccatgcaacgtcacaaaccgtatgttgagttaagctatgaatttgacgttggtatggtgttgatattcacctgtctcattttaagaattatttgagggatgcaatggatcatttcatttgcatcccctccgtgtgatggggcttgagcatttgcttagagggtgtgtatgatattctgatttgtcatgtggctttgttgattgtacgagcatctcattgcattactgatagtagtagtagtatctaatttgtggctgcatcaatgtgcagtggtagtaacaagatgtgaggtttggttgtattttattggagaagtgccctgtgctgtgttgggctagctttgtttggatgataaagacagactagtaactggaattcaaatgagtgactgctctgttgcctttttagtactcagtatatgaagttatattgcgtagcgtggatgtgaatatgtatgtgtgatgaggaggatatatatatatatactccctccgtttctaaatatttgacgccgttgacttttttaaatatatttgactgttcatcttattcaacaaaaaattgaagtaattattaattcttttcctatcatttgattcattgttaaatatacttaaatgtatacatatagttttacacatttcacaagagtttttgaataagacgatccgtcaaacatgtgctaaaaagtcaacggtgtcaaatatttagaaacggagggagtatatgtgaatgtgatgacaagtaaagcgagacaaatactagtgtacaccaccactaaaactaggccattctctctttgccatgacctcctggaggatgatcttggtgtgggcggcgctcgaagctgttcaagaggcgggtggcgctggtcgtcggcggcggcggagatgagcttgtcgatcgacgtcgaagtacgttgttgcccagcaggtagaacgccgtgctccgaagcctgtacctgtacgcgtgcgccgggtagctcggcccgatgtcggctacctatgtagatgccgttcctcatgaacgtccggctccccgtctcgcataatggtaatttacctgtctctttttaaaaattacttcctccatttctaaatatttaacaccattgactttttagcacatgtttgatcgtttatctttttcaaaaacttttgcgaaatatgtaaaactatatgtatacatataagtatatttaacaataaataaatgataggaaaataataattacttcaattttttttaataagacgaacggttgaacatattttcaaaagtcaatggcgtcaaatatttagaaacggatggggtatttggttttgtgttgctgtaattatcctctctttttttgctttcttttgtcaaataagtacgtgtgccacacgataggaggatcaaaagcaaaagcaagggttaagttcttgagttgcatgctatcattggaattaatttattgcaaatatatagttaatctctaacatgcatgtaccttttccgtcagatgaagattttaaacttttagtgtcattaagggcataaaaaaaactccggttcattgttgcttggagcagccttattttccgggaatcttctcatttttacatgtaatttaaatagctgttttttttaaaaaaaaggtataattgatcaatacgaaatatgtcagtttcacagaaaaatcaaattcaacatagacaagtaaaaaaaaatgatagatttgactgtgtactattcacaataaaatttgttgtttttgtttctatttatttaggttgaatttgtattttgtatgtctatggaatgacatatttcacattgatctatgatatcaatttttttttaattttttggacgacatgaaatacaagggtaggggataaaaatccacttccttatcattgtgttatgccaaaccgatcgacggtgaatatgctgatcgatcgagagttccttctctgcggtggtatccaccaagacggtgttgtatactcctatgcacgcgcgtgcaaagagaacagcaaaacatcgatcatcgatcgtggtgtggctggcggaagcagcaccctcatgacgatgagccacaacgcttgcacgatgccttgagcacgaggtcgataggcggcagcaccgatgtcgttctccctcatgttgttttgcaagcccgtgccgtacgtgccatacggtttggttcgtttacatttaggtttgtttgattggttggaaattgagagaaggaatggaagtttaagagaactagtaattaatcgtgcatatgcaacgcacttaaaaaatcaatataaattaaaccagacaagttgcttgtggctctaatataaattaaacttgacaaacagcgagggaaaatatttttattattttaagaaccattaggctgagttgttttgttcactttctcaaactcacatcctttttttcacgagcgcgcttttcaaactattaaacggtacggtacgttgtttgcaaaacttttctataagaaacttgcttttaaaaaattatattaatctgttttttatatacaaataactaatatctaattaattatgtgccaatgagttgatccgttttacatgcgcggagtattagttctcaacccaggagccgaacacagccttaatgatggtagtaaagggattacctaaagctacagaataattttgaaaattgaattttatgtagtttgcatatatagtacattattgttgtgtagtacaattagtttttataagtagattttgtaagtaaaatagttccaaataaatcaaatttaaattctttgatttattatgggacacaaattttgttcatattagtacaattctgatctacatcaaatgctcgatatttttgtttgagactacaactgaatacacatgcactgctacatccttcgattagggaacacacgcagtagagattacctgacaatttccagtacaaaaggacttcgctggtcagaagctgattgaaagaagaagaaacataacacagtaaaattaaattggagtacaattgtgtattatgttttctgaattatgttcttgatgtggatacccaatctagaatctactctctactagaaaaaacatttttgccaacgttgagtattttttttttgcaggcgggtatgatcatcggagcgaaatagccgcctaaaaaaatgtaaaccgggttgaaactggttgtctgcctgcgaaaattagtgtggaatataaatagactcgacacatgaggggatttttttttctaagttctcagttctctcctcctctccggctctccctcacctctcctcttcctcaactctctctccctcaactccctcagcgaccggcggcggggggaaccgtcgacgatgaggcgaggcacgcggtcggcacggctcccctcccctccctcccaaatctggccgaaggggggaggcaaggtggcggcggcggcggttcccctccctccggatccggccgaagggaggccgggggagggcggtggtggcggcagcggttcccctccctccagatccgcccggagggatgccggggcagggcggtggtggcggcagcgcccctgcagatccccacttcccctcacctcctggcggcggcagcgccccccaaccctaaccctagatcggccggaggtgggtaggggcgcgggtgggggtggccgcgatttttttttttatagagatgattttcactggcgggtgactgggccgcttgcgaaaatcgatgattttcgcatgcgattgcttctagacggactactctcccgccgggaaaaatagtttttggctgcctgaaaataccatttttgtagtagtgactccctccgtttcaagtcaaagtcaaactattataagtttgactaactctgtagaaaaaaatagtaatatttacaacatcaacatagtttcattaaatttataattgaataaattttcataatatatttatcttgggttaagaatattactacttttctcttaaaaaaaattagtcaaacttagataattaagtttgactttaaccaaagtcaaaagattttgaccaaagtcaaaacattttataagatgaacggagggagtaccatggaagcacacggagaagcggacaattgtgccggctcacgtctgcacggagcccagcagtatgggcttgtctacaaatgttggcttatatggggatttgctatacaacaccctgctgaaaaattttgttttatcagctgaattcctggccatcagattgttccaagatttgtgcaaacgttaccgggcaaacagctagttttgggtgtgcacctgttttattccggatccgaatgggaacccaacgcgttcccctcgccagtctcttcgcctcctcacgtgagtcgccgccatcgccgtcgctctccccgccggcggatcctcctggctggagggaggaagatgcgccagggtgagcatgcgagtcgccgccgtacatcctcttcgtctccccctttctgtctcaccacctcgccctctccctctcctcctccctcccctttccctcttcctcccagctctgtcatcggctccccgccggcggatccggtcggccggaggggaggaagatgcgcagaggtgaggatgcaagtggccgctgtgcgtcctcttcccctccccctctttgtctcgccaccccgccctctccctttctcttcctgtccctccccactgtccccgtcctccccgccaacggatctggccatctaaagttaagattatgttctattttcactgaattttagttcattgatgtaggatggaaatgagcaacgttttttttttgttataaattgtgcgaagacatagaattgttagaaacagttttgtgttttctcagagaaatattcctttttgaagcaaacaaattaatgtttgtgaacttaagggataaattttgcactctgtatgtagtttgtctaatttatctgcagtagaattttggttaatttaccttgtcagggcaccatataagctactaaacagtaaactggttagcaataaagataacatagttttgttaggaatgttagaaattagcatgcatcacattagaatttgaagtgaagagtaggtacttagttttgttagaaatatatttgtaagttttgttctcaatgatgagtacttagtttctttagtttaattttcagctagcaggtattttggtttgtttaattttctataagcagctcataatctctaaaggagatttcctgacttctagcagtaggttgttctgtcatctactagccatacttattcctagttttgtcatttttgtgagcactgtgaatgtgggctatttgttataagttttgttataacagttcacttcctagttttgtcattttttgtcatttttgtgagcactgtgaatgtgggctatttgttataagttttgttataacagttcactaattatttccaattccaattaaagtggggatcaggagtttgtgtagttttgtcttctttttttttgtcaatttttaatttgctatatattaatcaagctgatggtagattagattttgctacatatcaaaagtcttgctaaatttttggttttgtaatttttgtcagcaattacaattttaagtgaagagtatttaattttgtatttgtttttgtctaatttttataattttgctagtagcagtacagctcaactagtaactagatactttgtagacgtaactaggtattccttcatggtattcttgaagaagaggtatacataaaacaaccacttaggtatgaagataaggtccatccttgactatgtgtgtaagtttgataaagctctctatggtttaaaacagacacctagagcatggtatgctaagttaagtcagaagcttcaacaccttggattccaaggatccaaggcagatacttctctattcttttataataaagggggtctgataatttttgtgcttgtttatgttgatgacataattgttgctagctcgagacaagatgcggttccagctctgctgaaggacctataaaaggatttagccttgaaggatctaggtgacttacactactttcttggcatagagatgaacaaggcatctagtggcattgttctaacccaggaaaaatatgttactgatctactaagacgagttggtatgactgattgtaaacctgttagtacacctttgtcaactagtgagaaactcactttgcatgaaggagatttattaggtcccaatgatgcatctaattacataagtgtagtaggagcactccagtacttaagtctgactagaccagacatttcctttccagtaaataaggtatgtcagtttctatatgctcctactacagttcattgggctgctgtgaagagaatattaaggtatttaaaacagtgtactaaacttggtttaaagattagtaagtcaaagtctatgcttgttagtggatattcagatgcagactaggtaggaaatatagatgatagaagatctacaggaggttttgcagtatttctaggggataatttggtttcctggaatgcaaagaaacaagctactatgtcaaggtctagtactaaatcagaatacaaggccttggctaatgctacagcagaaatcatatggatacaaactctgttagaggaactcagtgtgccaagtcctccaatggctcgactgtggtatgataatcttggtgctaaatatttatcatctaaccctgtcttccatgctagaactaagcacattgaggttgactatcattttgtacgtgaaagagtgcaacgaaaattacttgaagtggagtttgctcctacaggtgatcaagtggctgatggatttacaaaggcgttatcggtaagacaacttgaaaattttaagtacaatctcgatctaggtaggttgtgattgagggggagtattagatataatcatgtgtaagcataacaacctggccgtatcgatcttatcttagctgatagataatgattgtaatcaggattagttagagatactgattagccaaggtcgttatgatcctgtaaagccatgttgccggctattggcaaccatgtaaatatacgcgggcgcaccaagatcggtgacgacaccgcttcctgcacctctgtttcctttcattgtcatgggctatgacggtatgtgtccgggcgagacatggctgaggaaaagaaaatcaatctttttttggggggaagagaattcattaatcagaataggaaattatacattcgtcatgaatcaaccgcgagacacaagtcgcgtctcatggccgagccagaagcccgatcattcaccttttatccctaagttggctaacaaaaaaatcaatctaaccttgtctgtctcatcagctttatatacggctagagctagcacaatatactcaaaccctaacaacttcaaactgacttaaccctaaaccaattgagtttctccctaagcatttggtggagccgatcctggaacggagttgtactgcctgtttgctgcctcctaaattatatctaggcatttggtggatgagtcgatgatggcgatcataaagcttcttgtaacgctgcatggagaacacctgcattgggttgtgacaagcggcatactttctccatcccattatataaaagattttgaatggatggaacacttactagcactataaatctgagacactaactagtactaccaaggttgtgcttagttcacgtcaaaattagaagtttgattaaaattggaacgatgtgatggaaaagttagaagtttttatgtgtaggaaaattttgatgttctaaaaagttgaaaggttgaagaaaaaatttggaactaaacccagcccaaaactaaacattcggaaatactttgacaaaagtgaagtgctaattgatcacgggtcggcaagctagactccagacggaaacgcaaagaagccaggccacaccgtaggtactactatagatcaaaagtcgatccatacttacgagttactacgatacaatcgtacagtacgacagaagatcgatactactcgtacaaagtaataccacagagatcgatgcacaattcactgctcgtctgcaaagttgaaacttctgcgtgcctactctacactagtacctctagtgtaggggtgaaaacggtacgaaaacggacggaaatcatctttatcgttttcgtttcatatttttttcggaatcgaaatcggaatcgaaaaccccggatacgaaaacggaatcgaatattatcgaaaccgaaaacggagcgaaaacgaaccggcgtgaatacggtaacggaaatttgaataaaaaaacccctctaactgataaacccaattctcaagtcttaacggtcaacaattcatcataaaacacaatcatataagtccaattgttaggtatcaacagtacatcacaaaacacaatctataaaacaaattagtaatgctgttgataaatcccaatattcttatgtaattttagatttgtataacaaatattttaaaaaaataatagccaaacaccatggtattaactattcagtgctaaaaaaagaattcaggttattttgtgatttctggaaattcctagaaagaattctggaaattccgagaaaatttctggaaagtttccgacgggttccgagttccgacggaaactgcccttatcatttccgattccgtttccgagaaaatatttccaaatccgtttccgtttccaaaaaattccgactgacagattccgtttccgaaaataggtcactctagtgtatgtgacctgtgagtgtgaccgtgtggtgtggccataaatacctcacctgctggtctactccattatccatgtttttttttctgatatgccacttcaatcacgatcatttgcatatctttagggtgtatttagttcgcgaaaagaaaatttttggatcatatcagacgtatgaccggatgtcgaaaggggttttcggacacaaatgaaaaaactaattttataactcacatggaaaccgcgagacgaatttattaagtataattaatctgtcattagcacatgtggattactgtagcacttatggctaatcatggactaattaggttcaaaagatttgtctcttgatttctatgcaaactgtacaattagtttttttatctatatttaatactccatacatgtgttcaaagagtcgatgtgatgtttttgggtaaaattttttggaactaaacaaggccttaattactacccacaatggatcaatctggtactagctcaagattttgccgcctacgcctactaattactcgaaaataaggatttctatgtagtagtagcaaatactaggatttctatatcaaaatatttatttttagtcacttcagttgtcaatttttaaattttggatcgtttacattttatttcgaaacatctgattagctttgaaatcattaaagtgatgatatcatatgaatcagtctaggaatactataaaattttagtctaaatacttagggcaaccacaatctaccaaaaagttagtcttaagcattaagtgttgtaactttagccattgtggaagcacaccttaagcttcatacaaccaaaaagaaccttaggcccaaggttcatccgaaagaaatataaaattatttttttcattgtccacggactatttctctagcttgctgccttgcatggggtggttaggaagtgatctttttttcctttggtggaactcaacgggacccatcttatgttcttccaaaaacttaaccattgtagatattatcataaatattgctccgagctgtaacgggttccatccttattgtcataataaccataagcattgccttacccttatatttttcatggagaaaatgagtacacgatttcatgttggttaaattatactgccgctatcgattctatctctcatgaactcgggtcataaaaaaatggttggatatattcttttatgctcaatccatacttatgctcaatccatactaatgatctatccctattgatatgggttgtgctactcatctctaattacatatgtggacctgttgcaatatatgggccattacaaattcgtcgtcttggagaaatgacgttactgtttgttaaatcgactcagtgccattggtataccataaaattcgaaacgtgccattatgtggcctaagcctatgaggcgtcctaaaggagtttgtttataccatattttttcggggactcctacgcgtcgggcacccgatggagggggggggggaatcgggcgcgccacgtatacatgcaaaaccacttgaaactattttttctcttaaattatttatccaaatcatgattcgattacaccattaaattcattgcaattaaatctttaaaacaagaccacacatggatatattccgacgaaatttttttagcttattattgaattatttttaaatgttgcacaatgttccaccaagtatatcggaattgtttcactgagtagatagaaaatatttcaatcatttaaattgggtgttgtttcatcttgtatgaaaacaatgtttcagcaaatagcgaatgaatgtttcagttcactgtaagtacactaggtaaaatatttttggtgaaaaaaaatgaaacgagttcccttaatagagggtttccaaaatatgtgggtgatttgttacaaaagaatgtttcagttcactgcaacattagatgtatacatagtgaaacattatgagtacactaggtgaaacattttttatggaacaaaaaataaaacgaattctcttaatagagggtttccaaatgggtgatttgttgcaaaagaatgtttctgttcactgcaatattagatctatacatagtgaaacaatgtgtgtacattaagtgaaacattcttggtggaaaaaaaataaaacaaattcccttaataaagggtttccaaaatatgtgggtgatttgttgcaatggagtatatggtgaagatacgtggtggggccaggaggagacacgtgcgcgttaggggagagcgcacgatcctgctgcccccgagctggtcgaccgattggaaggaattctgtaatttttcacagggatcaaaatataatgcacctagccatttttcttccgtagtcgttatcttcttctaacacttggaaacatggccaccagtgaaaaaacagcttggttggtgtggctagcgatgaaattaagcactactgtagccgttgtatccggtggccccatcacgtacttaccacggtgttgggccgggagggagcaggcgtcagatctgactgttttttttaaaactcataaatttatttaaatagtgaggattacagacagagcttaaaggaaatgatatccccaaaacatcgccataaaagataagacaaagaacaacaccatccattcagaaggtaaagctagctgaactaagaaaaacatcctccaagataatccaaacagcagtaaagaacgcgatcgacaggggactgcggcaatgccgcgacgaccacgtccacgagcctctactgaagacgcgcacaccgcttgatagaccggtgaccccttcggctgcctccacggaaacggcgctattcgaggtttgttgttgagtcatgaatttttcttaagcttcaccggactcaacaaaatattgtctaggagttctccatcgaatctgaggagcatagactacaatcctatcgacaagagccgactagacggtttatactcaacccgaatggagtcctcaacctgaatactactgcaaggagatttgaagaaagtctccatactccaacttgccttgaacatgcaagaattaggataacggcgactgaacccctgtcttgtaacgatttggcggaggtacgcaacaccggagattgaagggataatgttgccgtagagagcttcaataagcaaccaacaagcttgccaccaagagcttcagcagaagcatgtggagattcaaccaactaacaagctggagcagctcattcagcccaccaacgagcaggagcagcagcagcagctcttgcagccaacaccatccgtccttgtcagagagcctgagacggccggcccagaaacaccacatccacctccatcgctctggccaagcaatgaaccgaggccagctgcaccagatccaccaccgcaagcccttgtcgccatggaaaggacgccaaacgccccagatccgtccatcttcagcgacgcagccgggattgcgtcggacaccgcgcagacccttgatgtggagagcaagccagctgcggtccagattaaaagcgacactgggacagccacggccacaaacaccaccgccaccatcgtcttctccgatcgccatgaagcaacaccggcgaaactccaaaagggacaaacccgagctacaggaagacctgactacggaagaactccgacctaacctactctatactagtacgggaaggtggcctgacccctcctccggccctcgccggcgacgaaccaccggaatcggggggaaaaggggtcggggagggggattttactgtagaagcctgttctctcacaagctctcgagagacttctcaccaggtagcgtcagatctgactgagattgcggttgagctcttcactccattgttggctttggtcgggaaaggatgtttcatctcgcgttgggagcaaattaacgacgggtgcccggaccgatggatgacgaagatggtcatcatactacggcctacgggtactcgagaaggttgacgatggtggcccagatccaactgttacgactttatgatcagccttgtcgagctcccaagccgccggtttagttcccaactttttcttcaaacttttaacttttctatcacatcgaaatttttctacgcacataaattttcaacttttccatcacatcgttccaatttcaatcaaactttcaattttgatgtgaactaaacacaccctttgtcgagctcctgagccgctagtggcctcatccagctagcacattgcaccttgaccttgttgagctcccgaccaacatccttgagctgccaccaacctcgatcgtagagctccatcactgcacacctaccacgtcgaagcaccctaggctgtgttggggaggaggggttctccctgacatgcaaaacaaagctcgtattattgcatgattaattaagtattaactattttttaaaaaaaatggattaatatgtttttttaaaaaaactttcatatagaatttttttttataaatcacatcgtttagtagtttgaaaagtgtgcgcggaaaacaagagatgtgggttgggaaaatggggggaagaacacagtcgaagccaccgtcggcctcgtcgtggtatagaggtctttaaatacaggacaacatgacaaccgaaccttactctattacataatacatggtttcggctcacctcctatatttctagtcgaatatggaggtcacgtggttatccggtatccatattatccacattagcctccgaaaccttcgaagtcgagttacagtcttctctatggttcatgaccgatactgagtgcttcaatcttctttgcgaaggcctcccgagtgtttacttattaagtccttatcttgatatcttgcaaagagactgtggagggctcgtcaaataaattaaaaaaataggtgcatcgaattgatagataaacaggtacatcgaataggtgtacctgataactgtagcaaactatgtgcttagttgggaaacaactaagcacatagtaagaaccataattttaaccaaccaagtgactcaatattagtttatagcatatgcggtgttaatctctgagtaatataccgactcataaaatatgatgcacgtagctctgggcaaatcgtggcttaagaatataacgcgagctttagggcaaccacgtcttaaaaatataatgcgcgtagctcaaagctaactgcgactttataaaaaagaatcacatagcgctaggcggccaaccgtgtatagaatgcgtgtagcactaagccaattcgcgtatttaaaaatcagatgagctatgttaattaccccttccttgtcacatgagcacagtacacatgcattggatgaccatggtccatcagggtagccatgaaggaccacttgggcttcggcagcgacatcgatcccgtaggggcgtcgcgagctccggccggcaacctcgccgatgatgttgtgtgcatgcagtcgccgttctgcctcgccgccaacgatcctgcgtttgctactccgtctggtttgcatgcatgggcgctagctagggccggccgccgacttacaccgcgggagaccatgcatgccgctgtggctgcgtacgttgcgccggccgggcaaaagcgcgcggcgagcctgatcgatcatggccgtgagcctgatcgacggtttttcctgacgggtccacgtcacaattaacatttcttgacgccagttgcaattttctacctgataggaaaattgaatttctcgtggtccttttttctatcggcgatttctgacggttcacctacaggaatacattttctaacggtaaaaccaatttttctgatggtttcgctcctacagggttggtcgtgaatctgctggtagtgaccggctgtcgtgcgcggcgtacggcgtggcgggaacacgtccgtacgtcgtagcttgctgatggttaggatggccgacgggaccaccatgccaaggtgcttcttcccgtacgccagagaggaggtgtggccgcgttgtgcgtgtacgtgaggtggtggatcgggagggggtttcggagaagaaaactccgacctccccaaggccttgaagttgggcgcatgcattttgtacagatcgatcagtgttatttgtacagatcacgtttctttatgtcacagaaatagtcgttatttttttataacgaaagttaacaagatatattaatgcacgatatatcatctttaaatatgcagtgttaaattcgatcttaacaagttatagaaaaaaaaagtaaattaaactttaataaggtcaactaatgaataaaatactgcacatttttgtttgcaagttgcaaccagctccttttaatatcgcgttggatatatcatatactagtacatcactgtaacagatgtgcgtttcacgagggatgtaggagtagttctcggttgatatgattacttcaggtaccaaaaaacaaaaaatctgaatcatagttaatctaaccaagacttgatgaaataatggaatccacagatagtggccatatctggattattgacgactgtaattgctctggaacctttttgtgctgcatcaaacaaacaattaatgcaccatgatattcttctctaacatcattgttcaaaaaaaaagagaaaaaaatctactctaacatgatcatttacgcaattgaagaacagtacggcattttttacttcaaccttgtatggtttcagtaattcagttcatgcctgtctctgagagcacattcccaataatacaacaacaacgcctttcgaagaagagctccttttttttttcccacaagaactgcagaatctgcatgccattcagaatttccaatggggatcgatcaggttaatctgcacaccctctgcctggccatgcgcgcggtcgccacgccgacgctctgcacgcggcgtgcgtagcgtccgagatggcgtccgtttgccccgcgcgctgcggctggcaaaagcggcgagactgagcatggccgtgaaccggctgtcgtgcggcgtggcgagaacgttctcgtcgtagctcgcggacgggatcagatcagatcaccatgcatgcatgcctgtgggtgttcctgcgcgtgcgaccgccggagagcggccaaagcagcggaccgccaggattgggcggcggcgctccggcgagtcgacgaacaatgaaccggagttacgttgacgtggcaagggggttcggagaagaagactccgaccccttgggatcggagtatacggaccacttcaccagcacactgacactgcacacatgcattggatgatggcgcccggaacttggtcggaagtcggtgcgtgcggtgaccggtgaggtgagcaagctaagggaggccatggcgaggtaaccggcactgtcaatggggttcggagtttgaaacaccgaaacggactcgcggacgccacagtctacggcctccaccggggattcagtcctcagtcgtcatcggccggcgccggcgccggcgaggcgaccacgggaaggcagtgaggccgacgatgtcgacctcgaactgttcttgttcagggacttggccgtgtccatgacgcgcgcgtcggcgtgctcgccggcacggctgcgttgttcacctgcggcggcgagatcagcggatgcgtgcgccgggcgggcgcgagccagacagagatcatggccgcgaacccggcggctgtcgtcgtgcgcgtatcaccatgcgtccatgccagaggggaagggtcggagaagaaaactctgatcgacctccctaaggccttgaacttgggcttgatctcgcccagtcgcgcgcgcacggcccacgaaggcccatttgtacggatcaatcaaagttttatttttttttcttcttcaaagaaaaggaagaaagtatcaattcgaacttgtcaaaattcaatcatctttggaatctccaaaaatgtcaacagaaatgtaacctaataattccaattgtaagcattcttctctgctcaaactttgtcattagtactggctcaaaccacacgagggtcagggttcaatctttcatttttgggatttgtatcggagggtgccgatatactgaaatttagaataaaatttgattaaatttgaataaaatattatcaaattcataaaaaaaattgaaaatttcatacaaactagaattttgaacccgtacctgagtatatccgccctttcccctccacacagtgcccaggaatccggttttgaaaatttttagctatagttcgtttattttctatttccaccaccccttaagatcaacttagacacccgcatcagcttaaatttggtccaaagtagagtaaagcaagcatgtgatacatctctccatttcgcactaacttcgcccctacctccatgtacatggatgctcatggcagcatgagatgctaacacttggtggcggttggtcgtgctagttctgcttccttctcccggcatccgcagctacaactggatcagataacatcatataacaatcacggcgtcatgtctggatctaacgctacttcaactttgctgctcaaggtgttaggaatggatgagatttgctccggtccaacgaaaagtatctcgagttactggtacctcacggtaccaaatcatttccaattgttagatctaacaatacacattatgtctaactagatttaatgatcagaaataatttggtaccgtgaggtaccgatacctcgagatattttttttattggatcggagtaaatgagaacagagggagtactccactcgttaagatttattttccataacgcagggattaataaggacagtggttaggagtaaaagataagctacccacagtgccactagtaatgcaccgacctacgtttaatttcatattaacgtactacgtgtttctttctcttcgatacaaagttgagttacgcttatgcatgcattgcacacgaatacttagtacacgaataggctcgatcaggaatgtaaaatactaaaatctgcacaaaatttactttattgtttaattactgtcccggcaatgttagacaaaaacaaaactcagtagttactctttttttaataaaagggagcttggtgcaaggagtgctagatcgatcaggctacagggagagaatcaaataatgtaggtaaaatgatcaggttaggtacgtttatttgtggtataatattattgggagtaaaaacataacaacttgttaggtaaactgatattttcatacctactacacaatagtcagttcatataaattgaactatatcaaaaaaaaaaaagcaccattcatcctttaccacgaaaatatgtaacattaactgcatatatcaatatactgtttacagacaactcgctggctctgttagagataagatccccagacaactcgctatgatcagaattgacacctgaaatttctcgaccaggaaaatagttaagcagggcaggaaaccccaggattatccatcaaccaaccaactaggtgcttgcttcagattttcatcagtacatcatctctaatcatccaggtaaaagacaagatcttgtcacgtgatcatggccccatgacacagtattatcatagctactatccaactgacaattgactaacaaatcatagtcactcactgtctgctactgaaagccttcctgtatttaaagccatggatatctgatgatgaactgcataagagatcatttgcattaatttcagagatagagtgagtgatcagttgagtgttgttgcataaacatggctgcctctgtcatggcttctctggctctgaaaccatctgcatctccattactagaacgttcgaagcttcgagggaaagggacaatggcaaggccatctttgatcatagtggccaagaaagcaaagaagattcagacatcccagccctatggtcagtacatgctgtaaaattcagagttaatatattagcaactggcttaaacatgaaatggaaaatgggtttctcagtttcatgggtaccaatgagtgtctcctggttatcttattttttacatgcaaaggtgataaatggtagtgaatagaactgtgattgttaccattcatttttctctaaattagtttaccttctcacaaagttatggtatgccaccatctagggcctgctggaggagtggtgttcaaggaaggtgttgatgcatctggaagggtagccaaggtcagtataaggctataagctcagacaagcatatatatcagacaaaatggttatttttcaccattaaatttttcaaatttaatcagggaaagggtctttaccagttttccaacaagtatggagcaaatgttgatgggtacaggtaaatgttaccgatccaatgaagaacaatatatttgagatccatgcacaaataataatatatagtaactcataaaaatattagtttcaaagtaaaaatgggataaagcatgtgaatgaataaaaggagaaatttacagatctagatgagggagatgaaaagagaaacacctatttattatctgtaaaaacagtgaaatccatagcttatccatgacattttgttgcttctaccgtgttacagcccaatatataccccagaagaatggtcttcaactggtgatgtctatgttggaggtaagcaaaaaaaaggactcgagaaacaagaattttaacactgcgcactgcttatttaaatttctcatgagatgtttattgttctcacaaattttgtacttacaaaatttcttgattttcccaggaaaggcaggtttacttctctgggcaatcactcttgctggaattctagttggcggcgctattcttgtctacaacactagtgcactggcttagctaagtgcagcagaccaagctgtgcctgcttccatgtatataatcttcactaggaatgtaaccagttatgtacctggactggacttgactgccagcggtggtaatgaataaggccgagtaatgttaattctaagttatgcaacgatgttttagtgagcaacatagtgttcttgggctctagggacaaataattttgagttcaacagagttggcacctgttggatcataagagttaaatcagttgaacagcttattctgaaaaattggaaaataaagttttggtagcgtaccgatccccatggagtgcaagtaaatcttcatcatcgaaatatccccaaggattacatgtcattctccagtattacaataatagtaataataaattaggtgctataaaacatactctgcatcagtgaaagtacaaaaccacaaaagcatattaacaatgtcttagtaaaatattttctgatttaacaacacctaataagataaatgttctttcagataataagaatgatatccagcatatccacaaaaaggatggctatcaccttcaaaaaaaaaaaggatggctatccaggatgcatgccttaagaatctaaatttccatcataatagaagagggtttgcaccataaaacttattaccctcttaaataagattatctatgtgagaatcagattactttacaatgattaagactttatccctatatgcaaaaatctcacagaaattaatatatgttctttcagacagaaatgaaaatgatcttcagaacttaaagaacggtgttgataggcgggaagcatttgactcgctttgtttcatagtatgttggcttatctatgtgagaattgaagagtgttcgatcagtaatcatgcttgtcgacacagctctttggaggggtcaaggaggagctcatgatctggaaggaagcaggcctgtttccttttcaggatgagtagcttgtaattgtggggtttcctgtgcttcttccgttttcgacagcatcctgtcgatgtacagttgccaacatgtacagttcctgtttctttttgtcccaaaacttaatacaattggttggcctcttcttcggccaacccggctaaaataatcttcagaacttaactcagtgaaactgacacacaaagaacgaaagaaatttcccaataaggggaacagatatgaatgcacttggtgaaattgactcacgaagaacaaaacgaaatttctcaatcagtggaacaagtaagaaaattctcaggattatccactcagcgctagacgtttccttcgaattctatcatcttcagttggtcatgtgaaggacaacgactgatcacaaagtagtggtccatgagcctagtatgccacatagcagctgacact

SEQ ID NO: 42973 - DNA, 89513 bp, Oryza sativa
actcaaaatccttggcctaatcttaattttggcataattttgcttttcttttttcacatagtgccctaatctattgtggagctatgatcgacgtcgatatgaacggtagacaacatcgtagtcgcgccgaccctcgagggaaagaacaccggcgagttgccaagcatcacacagcgaagatggttcctcgtaggtgtccggtaatacgatacgagggcaccacaacggcgaatgcgtatgtttcgacggggtacggagaagaaatctccgaacccctaagatgcgcctgggccatgaaccaattgggccgtttagtcgaaactggaccaatcaccggcccaccctagttgttcctctccataaaccagaagttgccgccgcccgccgccgacggcgatcgacgcgacacacgggtggagaggaatatacgagtacggtggcggccggcggcttcaggagttgttgatggaaaatgggagtattattttcgagagtataagtctgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcggtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctggccgccttgtcgagcacgatgaacgtcgtgttcacgttgttggtggccgccggggcgaggtctttgagcttcaccgtgctgccgctgctgatgccactgacaccgggcgcgtcgggctgcagtcaatccattctaattgttagtcaaagttacactgtaaaacatcaagaattggccgcttgcacagtcgatatctatatcggtagagtgatgtgttgttgctgaagcttgtgtaggcgtacgccgaagcagcagatcattggctctactgagcattccatcgaacatcttgaggtcgtcccaagatcgacacaacttctcaacgcctcgacacaacaacaacaacaaaatcaaatcccacatgtgaggtacttgggaggaaactgcggggttacccctttgtgtgccatgggtgatgctcggtagccgggagagcgccgccgaagtgatgtactccgcccggcggcggcgccgcacctaactgcacacacccacacctctccctcttcctgtacgcgttgttgccaacggcttgtttgatgggccggttgacgggcccccggccccgctccaccgacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggccgagggtggtgagctggaggaacaggttctacgtggcggtcaactgggccaccacgctcgtgtgcggcagggacaacatcaggatcggctgattgatgatggtttttggtcgggatttggctggacgtgtgttcagttctctgaataatccacacattctggaagagagggattggaagattctctctcttactacttgtttttctgaactaaatttcatctatgtaagtgatgatttattaatggattaattagatctatatcattaaaattttattggttttgaaatatactgttactttttgcgtatttcaaacgatgccactgctatttgtttgtaatttcattggtgctactaagatacgtattttgtatgtattggacgaaaataccatcatctccttctctctttcccgttgcttctttacatggacatggtcatacgagaagtaggtgtcaaagtacaggcccatctttttctcccccaattcgtaacttcaattttacgatgatgaacagataagagattatctctgcgggctcatcaatcaattcatgtcgggtgaggcgatctctacggctcccgttattacatgcgtgtcccctagcagcggtgcgggcagacacgcgcccgtgcgcccgttattacactaaaaactactatgtaaggttgtactctatgagtagtaggtaatggagaaaattatcttaaactagactacggacaccatggggatacttttctgatgattatctgactgacatgtaaataacatttcttcaatgatgaaaacaattttccatactggttattcattccacgcttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtttgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcaaggttttatgagctaatcacaccttaatcgacattgagcaattgtacaacggtgccacaaaaaaattcagtgacagaagaaccaaaccttaggttggttggtcagtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctcccttgcgtcggcgcggccgtgcggcggcggcggcggcgccctggccgccttgtcgagcacgatgaacgtcgtgttcacgttgttggtggccgccggggcgaggtctttgagcttcaccgtgctgccgctgttgatgccactgacaacaggcacgtcgggctgcaatcaatcggttctggtcgttagtcaccgtagaataagcgcatcatggagtggccgcgtgcaatgctaaaacctatattggtagagtggtggaattcgtgtgtttggtgttcgtggtgaagcttgtgttggcgcataggacgaagcagcggcatgttgagtcttctgggcattctatcgaacaccttgaggtcgtcccaatactgacacaacttctcaattaatttttagatacatggaaacagtaggcttacccctttatgcgccatgggtgacgcgattcgtcgaccagcaacggcgacgacgcagacctcccaagtcccgaacccctacgaagagagaccaccaggcgttggattgaaccgtcgaagaagacgagaagatctgcaggattggggagaagctaactagctaagccagtgggcttgcctgggccgtgggtcaatggaattgatgggagcaggtcggtgtctactcgtgccatgcgcgcgcagatcccttgatcggctttcctagcctgataagcatgggctagcccattgcagctaaagcccaataaacattttagctaaaatgaggtaatcttgcccacggtagcaacattttagctgcagtgccaaacagctcaccttactaagcgaggctagtatgtttattgccgaggatccaaacgcagcctagtgtgtaatctcaacttctacgaggtgaagtgcccatgatcacgaattcatgactcgagaattgtacacacctcttactcaaaatccttggcctaatcttaattttggcataattttgcttttcttttttcacatagtgccctaatctattgtggagctatgatcgacgtcgatatgaacggtagacaacatcgtagtcgcgccgaccctcgagggaaagaacaccggcgagttgccaagcatcacacagcgaagatgattcctcgtaggtgtccggtaatacgatacgagggcaccacaacggcgaatgcgtatgtttcgacggggtacggagaagaaatctccgaacccctaagatgcgcctgggccatgaaccaattgggccgtttagtcgaaactggaccaatcaccggcccaccctagttgttcctctccataaaccagaagttgccgccgcccgccgccgacggcgatcgacgcgacacacgggtggagaggaatatacgagtacggtggcggccggcggcttcaggaatcgaccggtcgccggcgttgggggatcagcgccgtgattccttgccgtcgctgctgccgcttaaactgctttattctcagaaatgttttaaatgtactctgatctgctctgttgatggtataaatttgaacttttaaacctcgatgtcatggaacttacttttcctgtagtattcgagactttgtacaatgccccgatcgatggcaggattggcaacttgtcgttgtcagcaaatactacatgggccaaaaaacttaatgtacccgtgtttacgtgtcagaccgacccatcttctactaattccctgtagtcgaaggaaggaaaggatatgaggatgagtaggcagagcaggtacaatagtaggctataagtcagctgtaaatatattttaagaagataaataagagagcagtgggctacagatttatacctagctgtagcacggactccaagacacagtgtgtatgacaggtggaaccaggtattaatagtgcagtatgtaactattgtatggacgagctattagactgactatagttgaattgtaactagtagttggttatactattaaacttgctctaattgcgctgcctgcgtgtggtcctaattaactgactgatctacaacgacaagacaatcagtgcgagcgtgacaaacggagcaatgcagccaaacggagtaatgcagccgagttaaggaagcaccgattttggaggcagtcatggctcaaggcgattccaacttttttttctttagacttttaatttttttatcacatcgaactttcctacacacaaacttctaattttttcgttacatcgttccaatttctttaaacttctatttttagtagcgtgtaactaaacacagcccaagttatactgccagcagcatgggcaacaacatccagcatagctcccctctttaatttcttgggaaatatgctaggtatagtaaaagaatcaagatgataattaaagactatttgagcatgtatattgcagtagcaactagcaaagcaataaatatcgatctgttcatgacttgtatcacttgccctacatggctacattaatcactttattgattgacatacattgggtagcatttgcactccatgtagtggagcaaggattggcttggcatacatgaggttggaaactttgaagataagattgaatggtacgtatgagtagtccttaataatgtaaacaatgaagaatttctatactgtatgtatatgtagtggtggtttttctaccacaccatccctactagtattatataatattccctccagtttcattttaattgacgctttggacattgacacgctctacaagatatatctttgaccttatttttctattataatatatacaataaataaatgcatgtttacttttattatagtgttttgaaagacaaatctatatatgtttttctagtttctttaaactaaatatttttaatgttattgatggtcaaagttataaaagtttaaccttaatcttatccaaaacgtcaattaatatagaaccagagggagtattatattacaccactgactacttcctccatcccaaaatataaaaacattcttatattttgggacggagggagtaggcaaatagattccattaatcaacccacacccttcaacggtcatctcctggctgattcactgttgattcttcttaaattataaaatcacctatttattcaataaggaaaatcataaaaaaactatttaacttaaatatatgtttaatcgaattaatactaaaactcattgtttttttttctcttggttcttggctagtaggatgaaaaaaggacgatggtgggtgtgctaatcattcatttgcttcatcctatttgcggtattgcggtagctgacctgtacgtaacataacatcacaaatgtgacagccatgatttactaccgaaaattaacacactcttataagaaagctaatgacatcacacgtttcacatcttaaatcgccgcaacaactcttacagctacttttggtgccataacatttcagacaagtttaataatcaataccctatgtagttatgtctcgtcatgccttctaagcagctaaaataaataaatgaaatgaagaccaaaattacagagagcagttgtgacttgtgagcaaatatatagaacccaataaaagttatatccatttatttatatattttatttaatgtataaaattcattattgcttgttaaatattatggatccttttctagttattgaaaattaattaattattctctagtttttttggccgggttggccgaagaaacggacaaccgattgtattaagatttgaagaagatatacttatagttatgtactgtatacataagcaccagtatatttttcacgcaacagaaggcagtcaaaacctggaagaacatctagagatgccagaaccacctttactaaagacaacgactagtcacctggttctttgaactctctagcttctctccataccataattcttctctagctaatatccaaaggtttggataagcttaattaagaacgctgttttaaatttgggattatacaatagttgaatgttgtagtaaaaacaaaagtgtatgaaaatgaaattaaagaagcggtgaggaggaaaatgccatctcataccgaagaagctcctctaacatacagttctccgacatgtgtcgttaacctatgagcctacgagctgtgaggctcacatgtcaatcatttaaagttagagtatatgtttccgtcccatgctattgggatgcaaaatgtgatggaaatgatattttcttagcatttttttggttcaaaaagatgtttttttatataagatcattagcattggtgtttttattttttaatgttcgattccaccagcagtacactaaacagtaagaacagagacagactacgtacattcctccattactaaaaaagtaagtagtaagaaaacgtataattttgactttcattatgattccataggtaattttatcgttttcgggaggtaccatatttgtatgtcatgtaaaacttgatatttataaatactctattagagaccgtataagaattatcttattccatcatctatgtgaattacatttttcaaagggtacttcatttacggcaacccaactaatcgaccgcttgaggggcaagaccgtaagagtagtgtgttcatatggacctatcattgcgtagaagtggtcaccaagtttaatgtgagccctggcccctgggatcaaatcaaacttgatgaacatgctgagtattggagtgatgatcccatccaacatcaaaggaggtggtcctcctccccaagctccagggtgatccctggctgaaacaagagaaacctgtaagaattggtaaaagaaccgttgcctggcgccttctctttttcaaaaagaataaaaaaaaggagaccgttggcgccttttctgatggagattgcctttgtcatactctgaaacgatctgcaattacaaatggtactatacagttagacagttagttagtgacccatcatttacttcgaaagagaagttagtgatcggtcaaatgaatatattgctcgatcgactgctcgcttgcttagcagggaaggctctctctacccatattttgcttgcttcacgaggcgctttcgtgtgaaatccaaatggaattggcgaaggcacaactaataaattggttgacggatacttgcgatccatctgctagctcctgctgtctatccattaaccaactggctatcatccttcctccttcgcagcctagctcgcacccagactcttacctcccagtgggcagtcagcgtcgtgcgatctactcctatctcacaccgacgtgttaactgtccctgtttttaatttctggacgatgtttatagctgccactcagtcgctctagtgctgtttctggaaaataaaaagacactgacggctcatttaaaatgtactactagggattttattacgacagtttagcaggaatcggttcaaaactcgtaaaattctcaccagattcctccattctaaaggaagcctaaatgtgctagtataaaactgatgagaaacatcgtaacctacttctccacatcacatatatacaaacatgctgatcaaagattcagacagaaattttctaaaaaaaaaaagaagattcagacagtttatttctggctgatcgaagatccagaattgccagtcagtttttttaggtggcggagtggcggtgttcaattctgatctatctcgtactaaacattaagtcaaaagaaaaaaaattaacaaacaacaactgtaattgtattactccggacaagtggagtccgggagtcaagagtggcatacaacgcgccatgcccatgcatcatggtccagccgtccagccatcaagccgacatgccattaatacctccacccccttctctcctctcctacccgctacctcactaccaccgccatcaatgcgatccatatgctctcctccttaaaacccccctgcgccatcctccaccaccacctccgccgccgtcagagaccaccactccacacatcgtgttatttgagattccggcgagccggccggccggagacgaggaggatggtgttcttctgcttcttggtggaccagaggaggaaggtccggagcagcaagccggcggcggggatctgctcgcggtgcggcgggtgcgcgagcgtggcggacatggagacggcgacgcgcttctgctacctgctcaccgtgcacagggccacgtggcgcgccatcatctgcaccttctgcggcgccatgctcaagtcctaccgccactacaggctctacgccagctagctctacgctacctacgatcgccggccgccggcggtgatggccggagagagagagaggaggaggcgacctacttgctgcgtacgtctctgtgctctctgcgaggtgtgcttgttgcgttgggccttggctactagtactactattggaggagtattaattaattggctttgttgatttcttgcaaaatgctaagctttgcatgcagcttgtaatccctgtgcatgtagtatgttgtacatatgctggagatgaagagaggaagttgattaaatttttgttaccggtttcattagcagagcctatgtgtgatcgatcttttaattatttcttctaatagaattatagaaaagatcagggaggttatgatatttgaaggggcatcactcatcagtactactacttttgctcgcatgactgctcatacatttttcttgtctcgccttgatccatcatatcatggcttgaacgtgattagtcacaccattgagagcggctggccatgagatatttcgaaataaataaagacccatttttctctacatttggcttaaagcacacagcatttaaattctgtacccgaccacccgttggtagcattaactgtgccatgcgagaggatagtttgatgtggaccttcattaccagaaaaccttggtttaatttcgttggcccactgcacacaaacatgcagcgaccactcctcgactccagctggtttttctgtttttttatttaatttttgaaggactcactaaaatttcagtgaaaaatgagaaaaattacaggtaataaaattaaatagaaggaaatgagaaatgagcaaaacgagcaactgagttcatcctgctccagctaagcctgttaaatggtccttgcagtttacagcgagcagtcatcatatttcgcacttaataagtagtgatggaaaaatgtcaacaaacggatatgcggtgggataaaccggaaattaaattactgatgtgagttgagagacggttgaagtgtagatagacgtgtagttcattttctctgtacgtatatatatcaataggtgactatggtgtacctgcgcacttggcctgtattcaattccgtttcttcaatgaaaacagttcagacagagtcctctacctccacgaaagtcaccgtcctcgcttgacgtgtagtagtacattgttgccttgttggcttataccgtttcgccggagatatgaggtcgatgggcctcccaagccgaaatgccaccctcctttgctaactaggagtatctctgtttgatgagtttttaaccgctatagcttttatttaaatctttagctcccttaaacaatataaatttttaagttatattttaagataatataaatttttaagttagatttaagaagttgtagttatagaatatagaaaataaataaagataaaaatttggaaacctagcctttctagtttttcaacttttccagattctcaaaagttagtccatccgtcccataatataataatctataatcggatggaacatttcatagtataacgaatctaaataccatcctatccagatttgttctaatatgaaatgtcttattcagttttggattactatgttataagacggagggaatagctatcaaccagctacttctcagcttctaatgcgatgggggttaagggtgggaggaaggtaacggtgtgtttggttagagtgatatcactaaatgggatatgacgatccagtttttaaatatgtttggttgatgggtaagaatggattgggtggtctaaagagaaaatgtttcacgaagatactagatgagtgggttaaattgaccggatgaggatatccacatttggtaatcttaatcattagtaaatgattaatatctcatccagttatagatttcttatattttgaagcgtatggagtaattgacttgtcaaaattagtgttgattatataattagtccattttattgttaattagtatagatatgactatattgatgataattaacatatttatcattgattaatatgttattgattttactctatccgttcctatccggatggtcatatatccataaaacaaacagaaccaccatattcctacaaatataaatggctatacccgtgaaagggcttgtagcctagtggttacaagagcctcagtagtacatgaggtcctgggttcaactccctgtgggagcgaattttccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttaacggcgttgtgctttcagtggtaggtgacgtacccgtcgacagcgaagcgcgacgttgtgctttcagtcagtggtaggtgacgtacttgtcgacagcgaaacgtccaggatttaacggcgttgtgctttcagtggtaggtgacgtacccgtcgacagcgaagcgcgacgttgtgctttcagtcagtggtaggtgacgtacttgtcgacagcgaaacgtctgtggtgacttcaatctctccaggatttgctcataggggtagggatggctataccctaccacgaatcaaacacacccttaagccgcatcacgtggttgacgtcttggtttctagtataattttctcgtctagactgggccgagtaccgtgtgagatgggccaaccaaccgcaaccagccagctattccggcctagtgtggcctgccacgacacgaacgatctcacgcacgagccgttgcagcgccgcgtgcgacgacccgccctcctccacggccttcctgcacgccgcgctcacctccgcggccttctccctcgcctccgacgacccgccgccctgcggcgccatcagcctcctcaccgcgcgctccacctccgccgcctccacgagcgatctcgccgcgtcgccgtccttcgccgtcgtcctcctcagctcgaccgcgacgcccatggaggccacggcctcgaacgcgttgaggtgctgctcgccgtagagcggccatgtcgccatcggcacgccgaaccacaggctctccagcaccgagttccagccgcagtgcgtcacgaacccgcccacggcggcgtgtcccaggatgtccttctgcggcgcccacctcggccacaccatccctctcccggcggtcgcctccaggaacccctccgggagcagctcgcccgggtccgcgtccgtcgggtaccgcacgccgccggcgggcgcgccgcgcaggacccacaggaagcggtggccgctgcgctccaggcccgcggcgagctccctcacctgcgccgcgtcgaggaagccgatgctcccgaagcagaggaacaccaccgacgccgccggctgcgcgtcgagccaccgcacgcactcgtgcggctgctcgggcggcagcgtggcgtcgaaccagatcaccggcccgatcgcgtggatcgccggagcggggcggcggccgtccgcgatcgcggcgaggaccgcgccctcgagctcaacggaggagttcacgatgatgcccttcgcctccgtgaagcggcggccgtggtactcgaaccagtcgtagttcttcaccgtcttgctcacgaggcacaccggcatgtacgacggcggcaccggcggcagcccgggcacgtccacggttccctccatgccgtcgaacccgacggtcaggtcgtcccggagctccggcagccgcagcatgagcgcgaggaacgcggcggtggaggcgaagtacacgtacgccgggagcgagagctcgtgcgccgcgtcgagcaggggcgtgaagaagaggtccacgacgaccgcggccacgggggacgccaagccggcgatggccgccttgacgtggtgcgcgtggcgctcgacgtaccgggacatgaactcctcggtcgcctcgcagccggtggggtgctcgacggcggggagccgccggaaggtgacgtcgagcccggaagccgcctcccggcgcacgtgggcctcgaccaccgacgcctctatctccgtcggcgcctgcatgacgagcacggtgagggagacggcgcccccgccggcgacgagcagccgcttgccggcttccagcgcggacatgaagtggccggatccccaggccgggaggaggacgatggttgggccagccattgatgcagacagagtaggatttgctactgaattttgtcaattgacagtgacgagctcctgcttgcttgcactgactctcggagtctctgcgtataaaagaacgggcaattgcaaatttgccactattttgaatcgttattataagactgccactaaaaaattgtaaaaatactactaaaactatcattcgagtggcatccttacaatattgaaaaaatcgataacaaatttacaaatgcctcttataataacggtgacgatgtcttagatcgatactgttggattttttttttagaaaatcctggtgcgtgtcaaaccagtattttcggtatttctctttctttatttcgttttttctcttttagataaggtttgttaggtttgttagaatcgcatgaagagccagagcctccctgcgtggtgtgtgaaccgagcgcgtgggatggcacacgctgcgaaccgatcgtggcgcacaaagggttttgtttggggagtctatggtagctccagtttctcccaaaatttccaaacaatttagcttttcatccaaatcctgataaattgtagttataaaattcaaaaactaactagaagccataatctaagaaacgaaacttctccatattcttataaaatatctgcctgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttactctaaaaaccctcttctcccttttttcctctcgtgggatctactctccagatcatccccccttccagccccgcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacagctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccctatatacgcggcgcaaaacccacaaggggtcggggcgccttggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacactgccaatcagtagtttcttaaaatcttaagctctccaaacaaatccaaagttggagtcgtggttaaagcccccgctaacgtatcctttacatttgcaatcaacactatcagaaatgctgccacttgacagcaccaaacaccttgtgttcgttccactggtcatattctggcatagtgttcgacagagagggggagagagagagacaactaggcacgcccgagggctacttctggtcatctttgtgatgttttttttttcttaagatgaaaataaagaataagtttttttacgcaaaacgagatggtattattaacgtataattgattgagttttaattattacaaacttgaaaaatatattaatatgatattttagagtaactttcatataaaaaattttcacacgaaacacaccgtttaacagtttaaaaagcgtgccataaaaatcttaatctttatccagctcttgttggagaaaagaatgggctagtgtcattagtttaatctcttcgtccgatcatcttttctgttttggtcgttcatgcaaaacacgtcaatggtagtgtcttcatcaatctgatcctctcgctcataggatggttttggcattcatccggggcgaggctgtagataaggccggttataagacacccggtctccaccaatacttttcctataaaagaacctttggtagtaacggtgccgatgtcttgatcgataagagttgcattcgtttcatctcttcgtccgatcatcgtctctgttttggtcattcgtgcaaaacacgccaatgatcgtgctcattgattcaatcgaagacatttctgtgcaatgctgtcttcatcaacctgatcacatcttgaatatgccaccaggcacagtcacagcctctcgatcttaggatggttttggcgtgccaaattcttcatcctcgagacctcgacgtcggtcttaggtattctacagtgcagatttcagcatgaggtaacgaattattgatcctcatcagggagaaaaaagagctaataagcgcggcgtcaataataagttgcgctagtgatggaattaaatcgtaatggtatgttttcaatgcgttgttttgatacactggagcaacggtactccctccgtttcaaagtcaaactatttcaaagtttatagacaaatatagtaatatttataatactaaattagtttcatcaaatcaataattaaatatattttcataataaatttgtcctggcttgaaaatgttactatttttttctacaaatttgtcctgactttgaccaaaaatcaaaacgtcttataacctgaaacaaagggagtatataatttcttagtctacagcactcagcacatggcagcaaaagtgtgttcctcgtctaaatcattgccattcagttgcttcaccagcgtctacagtagattttgacagaatgaactgcactcgagaagaaatcaaccaatatcagcatggctaggatggtctagaaacaccatcttctggctctggcgaagacacaccatgtgcatcagtttggtcatcttgttcgtctttgtttgatggtgatggatcatccccttcaatcaagtatccctcctcatttgtagtctcgtttattgagtagcccctttcagctggatcagcagtgccaagatttgctaaacctgacgctaggcctgaaataggagtatcagcagactcccctctatccatagacagaatctcatcaccagtatcaaacaggccttctctaaccaaagcagaatagatgtcatgaggattggcatctgcgctttgcaagcttgcaaaaagtcctgtctgttcagagttatcttcttgtgctgatcttccactcggtgcttcacttgtccctgtcagcataacttggtcctagaatcatcacaaggcaactttgttagggtcataaattatttaaaactggaaatttggaatgagggaaatatctccttttattggtatcatattccccaaatagcaatatcagcatatacttttggacaaaaaaaaacacatccactggaccagagtgaacaatcaaaagcaagagctcacaattagaaacatgttgagcttcgtatgaaatcttacaactaaagggaaatttaaaagatgagagaagaattaacacatgcaagttttttttttttttttgatgttttgggagtaggactccagatgtgagtcatgtgaacaagtcatcagggactcagggttatgacacaacttttagccagacagaaatatcggttgaagatacccatagtccaaactacaatgccacagaaaggttatgctgtacctcacttgtgcttatcttcttctctacagaagcatcttgcgctgtaatagttgcatcatcatctgtgaaaagcacggtctactaaaatcaatgaaaaggaaaatcataacggatttttttttataaaaaaactacatctaaattggactaagaaagaaagataacttttcaaagagaggacaaagcataataaatgaagaagattatagttaacacactatacaggtattataagatgtcaaaattaggacggaagtagggaaagaatcacatacagaacttatagggattaacaagtgcagcctccagcattgccttgaattctcgtgcagcagaaaccacagagtcagtttccccctggattgaaacacgcacacatgattaatggtctggaagactattagtgtcaacgtcaactaggagtactatatattgattagagtttaaacaaactccatatgaaacagcaaacaaatcagtaccagaacacatcattcttgccgcaaactataaatacactgtaccttctcataacctcgctgagccccgaaaatttgagactcagagatatcagcagtccgtgagtctgaagactcactttgaaactcccgcaaccaactgaagtcatcacttagaggctgcatatcatctatttgaaacaaaattgaaaagctcacatgagtatattcacaaagtataaaattgtttccaaagaaaaacaattgaataatacttatacctgccagaccacagctgttatcatgaatgtactcttcagaaccaattatatgtggaagagggccatatgcagacatagccttcaagagtcaagcaacaaagataatttggaaatgctaccatagaacaaacgcttgtgaactatagaatttctgaaataatgccagctgcagttaccaaacagaactaccaaaatttggtttgtcagttttggcatataattagtttgctggaaaaacattggcaatatttacttcacagcaagctttttagttaatttgcttctgaaatctgggtgaccagggggagggttggtggtaaaaattgcattggcaatgtgttccaaaatttggtcatctaataggtcgctgaaaattggaagtgtttcggcaagaaaatgaatttaccataatgtgccaaaaggatgggaatcttgacagaattttggaagaaaaataataaagattcagataatatttggcagctaaaaactggaactagttggcatcaacctaaacaagcctccgcaacaaaattttagtaatgacaaattatggcattaatttgcagggaaaagtttgaggggggggggggggtaaatatttcatcaagaactgcaagtaaggccattaccctgaacacagaggtggtagagcgtcccttgcttcggaagtggtccttacaggaagaaagtcctatgtgtaatgcttctttgtatcttggtaaaatatcacgttcataatcctgagctggcacttgggattgcagagaaccatgcatactctccgttgttttcagatgcatactatcttcatctgaaattttctgcagttgaagacgcacttgcagcagtgagcggtgatatgttattcatctccttgaggcaaagtacagaaatgtgtcccaagcaatttccactgagggaatgaggagatatcataaatttgaatttatgtaaatttgaaatttatgtcttttacaaaagtaatcaaaacaagtatacgacacttgaccatagaagggtgtactacagccaaaagttaagtatattgtcatctgatataaacaaatcaatcacaaagcaagcataactttctagactagaggcatccaaagacaagtgcaatatacagatttggaaccactacttgcatgttcaatgaacctttggcgggtcaggttgttgaaggagatcatcgcggtcttcatatccagctccagcgccccagcctcatctaacaacacattgacttctgcagcggctcctttagctctctcctccaccttatcagagaaatcttgcagccacttcaagacctgagcaggaaacgcgacaacacatgacgagagcagccaagatactgagatgtacagttgcaatcagagccttccagaaatcagagccagacaacgaaatcgagcatgccagcacgcattctcaggtttctgcagaacactgtgagccggcatggttcaggtggatctagcagcgcaaaagagcagccgcagccgcaatcgaggaggcaatcgctgaactgtaaccgcgatggtgcgattggctacgcgcgcttgattcttgcgatgagtatgggcgaaaatccgagaggagaagccacgaattcgtggagaatttgagccaaacgtgtgcaggaatcggcagcatcacagaacctccggggcagcaagcagcaaacgatctgatggagagggaaaggcgggcgcgtgctcacgaggtacctggctctggtttgcgaggtgcttggcgatggaggcggaggagctcccgccgtcgccaccgccgccgcggtctccggctcgccggtgggtcgcctgcgcctccatcttcctccgccggatggtgcgaactgtgaaagcagcaatgcgcaacaccacttaatatgggccgcattctagctctcggcccaactaatatgggccgcacgtagcccgcattcccgttgaggcccaactattataggccgcatgcaagtttttctcaccgtattttaggaaaaagtacaccgaagatccctcaacttgtcatcgaattacaaaatcgtcctccaaccacgaaaccggatacaacgcatcctccaacttacaaaaccatacaaactaggtccctcggcagttttatccccggttttgtccgacatggcggctggctcagcgtgggacctacatgtcaagatgccatgtcagcaccctctctcttccctttcctctccctccttctcaatctcacttttctccttatgtgtaagcagcaagctggccgatgggtggggaaaggtcgccggggtgaggcaggagaggaggaggcggcgggtgatgaggtgttgatgaaaaacacgagccctgggaggtctgcttaactccagtgcagatccaaaactcgccttcgggtatgctagcgtgccagttgatttgatcctgcaatcaacaagaaataaagacaaaaaaactgtggttaaatccataaatgatagtcgatcggctaggtgccgatgacatatcatttatctttgagccgatgttaaatatgtatcgatcggcagttataaatagataataaagaactaaatctattcgatcggctgtagatattaacaatatataatccttatattgatatatacttaaatcaagtgattgggatagatcggttgccatgccgagacagtataaatcacttagatcaaaatatatactaacaacaagactatatatattcatagcatagccgatcagagagatctagcatgtaccggctaatacttcgataccgctctatattaagatatcaacgcaaataggatataccaaacaaagagcctaatatacttaaatgcggcaagatcttaacataaagggcagatttaatatgtcagtaaagcatataaaacaaatatagttaaaccaggtaagaccggctgaaaccccgatactaccctaatcggcaaccaagaagcaggctagagattgagattctaatcacgactcataagatcaaactcaattgatgcagctataagtataaaaagaaggacaatatctagacaatcaagccattggaagtttcatagagtggtggatatcatatataatctaagccaacatcgatatttaacctaatcggctgccctctattgatagatgttagccgattgtaggttagatagcgatattgtcagagattatataagatatatgataactcgacgaattacataaacaagattagagtatcataaagatggaagcactaatcccgagaacgtaagccgtcataacaagttttacctcttgttgaagatcgaaaccgatgcagctcaacctgaaagcaagaactcgtcgaaataaaactaaagcaaaaaggatggcgatgcgtcgagattgtattgaacgtgtgtgttaaattgattacatagggctcggggtctatttatacccgagaattacacaacatgtccatatcggacatgactcttatccctaacaaactctaagataccataagtctttgcggcagactttttcccaaacatatctctaaggaatttacataaaacatcctaactaatagatacaattgcattctcaggactctatccatgcgtggcaatcatcttgaagcatatcaactcgacccaatgtcgtacaccaagtcgtattgtcggaatcggctgtatcacctaacccagtctgactcggacttagccgatctcgatcgtagccaattcggactccagccgattcttactctgtttccgcgacaatcctcatctttgattccgcttcgatctaatcttcttctccgatactgatattaccaaatttggtcgttaacacgaggcggcgacgtggaggctgtgacgctggaggggaggccgccgcgccgaggtcggattctcccttctgccacgccgagaggaggagctagcggccggtgacgcagggatggcagtagcggcgaggcgggagaaggagagggcgtcggcggcaggaacactgcgaggggagagcgaggacgatagggcacctcggcgtcgagaccctcccctccatcctcgggcgcgcgtgctcggtggcgagcggagtggggcgaccccgaggtggagcggcagcgggtggagtggggtgatgacgaggcggagtggcagcgcgcgaagtcggtggcacggagcgcgacagtggtgggcggagccgacgggcagagtggggcgactatcggcgggtagagtggggcgacaatgcgccgtcgccgccgatctccacagcttcggcgccccaactccctccgccgtcatcatcgtgcctcctccaccgagctccactcccgccgcggtcgccgctccagcttccccatctgcttcccaccgccatggcggtcgccgccgccgaagacgacgacggtggatttgagggggaggacgcgcaccacctcttccctcatatgctccctagccgcccgtgcgctgcttctccgccgccatgctgccatcaccgccaccggccaccgtcgcggcgctgcccttctcgtggcgtcgggtgaggagaagagaagagagagaggaggaagggagagagattgacgtggcatcctgacatgtggggcccacctgggtcccacgctgactcagctgccacgtaggacaaaaccggggccaaaaccaccgaaggactgtcacgaactcgattttctcaactgcgattcaatcgttttggagagatttggagatagcggaagagatagaacggaatcgagaggaagaacggagaggaagaacagagagtttcagagtaactggaggagagattggaattgattttgggggaaagttgtttgtacattgctccaaagttaatctctctctctctctctctctcccgccgacctaaatagcacatcactacaaggtctcactcactctctgacagtggccccgtgacagttaccaggtccactcgcttgcagggaaccttctcgagggctgcctctctctgttagacttcctgagctggtcttgtccttgagccggcgtgacattcccccttccttgaaacgaagcttgtccccaagcttcatggtgaggaaaacgatggcgcagttcttgcagattttcccaagtaacagctgttggttcttccccagaccactgaatcaacacttgttcaaccatcttagagccattgcgaataatgcgacgatccaaaatgtgagcaggttcagcttcagcatcagttgtcggatgaagtacaggcaaaacaagttgaaccgtttcagtaggtgccagcgctttcttcagttgagaaacgtgaatgacaggatgaatcagacttgacgctggtaaatccaagcgataagccacctctcccacacgagctagaacctgaaaaggaccataaaagcgaaacgaaagtttgcgatttgtgcgggtcactaccgattgctggacgaagggttgtagtttgagagaaacccagtcgcccacagcaaaagagcgctccgaccggtgatgatcagcctgaaatttcatcctggattgagcgcgcaacaaatgctcacaaatcagtacttgcattttctcgcgttcatgtagccactcctgaagctcagaagactgacaagctgcagtagctgacaacccaaaatagcgaggcttatgaccatataatacctcaaacggagttgtgcccaaagcagaatggaatgaagtattgtaccagtactctgcgagagccaaccatctactccactgagagggacaggcgtgaacaaagcagcgaagaaaggtttccaaacactggttgacacgttccgtctgtccatccgtttgagggtgataagatgaactcatgcgcaactgtgtaccagccaaacgaaacagagttgtccacaatgtgctagtgaaaatgcgatcacgatcggagataagggactgaggcaatccgtgcagacgatgaatgaattgcatataggcttcagtgacgtccaaggccgtgaaaggatgagacaaaggcacaaagtggctgtatttggaaaatttgtcaacgaccaccaaaatgcagttaaacgaagatgagcgtggtaaaccttcaataaagtccaacgagaccacttgccaagcatgttcaggcactagtaaaggttgcaacataccaggatatttgacatgttcagatttcgccttttgacagatcgaacaggcttgcacaaattggaccacactcgagcgcaaccctggccaagcaaacagttgcttaatatgctgataattaacgtgaataccagagtgaccacccactgcagcagtatgaagattggctaagatcttctgctgaagggaaatattatgaccaatccacatacgctgcttgaaatacagtatgccatccttcagagtgtaatcaggcacatcatgagcgctgatactaagagtctgaactttactgcgagaatcgggatcctgaacataaccatcccttacctcctgcatccatgctggaatggccacggacagagcagataaaacaatggtgtcagaagattggcacctagacagagcatcggccgcccgattatcaacacccttcctgtaaatgatcttgtaacgtaaacccaaaagcttggtaagagccttatgttgccacggtgtagtaagtctctgatcatctaagaaggatagactccgatgatctgtcttaatgaaaaattcagcatgttgtaagtaagagctccagtgctcaatggcaagaattatagccaaactctccttttcataggtggacaagccttgatgacgagatcccaaagctcgactgagaaaagccaccgggtgattctgttgcattaggactgcaccaattcctttgtcagatgcatccgtttccaccacaaaaggtagattgaaattaggcatggccaagacaggagctgagataagagctgctttaatgactgaaatgcagtttcagagtcaactgttcatacaaagagctgcccctttctcaacaaattagttaaaggcttactgatgattccataatgtcttacaaatttgcgatagtagccagctaatcctaagaagtgcaattctttgactgaggtaggaactggccaatccctgacagcctgaattttatcctcatcagtggacacaccattaggagaaataatatggcccaagtaagcaaggcgttgctggccaaaagaacacttgctacgtttcaccttgagctgatgcttaagcaaaacctggaacacagttctcaagtgttgaatatgctcctcaagagtagaactataaatcaaaatgtcatccacaaagactaacacaaagcggcgaagccaagggtgcagaatgctgttcatgacgccctgaaaagtggctggtgcactggttaaaccaaaaggaatcacacaaaattcatagtgttcattatgtgtcttgaaagctgtcttatgttcatcttgcacttgcatacgaatttggtggtaaccagagcgtaaatcaagcttagtgaaccactgcgctccattgagttcatccaacaattcatcaataacgggcaagggatagttatttttgactgttatagcatttagatggcgataatcaacacaaaagtgccaggatccatccttcttttttaccaaaagaacaggggaaaagaatggactatagctgggctgaatgatacctttagaaagcatctctttcacttgtaattcaatttcatccttctgtgtgggagtataacgatatggcctcacatttactggttgagccctaggaatcaatggaatggagtggtcatacggtcgatcaggtggtaaaccttcaggttcagcaaagacagaatcaaattcctgcaacactacttgcactgcctcaggaatgatttctgaagttgatgatactgacagagaacataattgcaccagatttgaaattgcacaacgagaaataagcccattcaattgttgaacagagacactggaacaagtggctaactgagatgtaatcccttgtaatgaaatagtctgtcccttccacgcgagagtcaaagactttctggtccaatcgaccgtcatgggattgtgatgcattaaccagtccatgccgaggatcatatcatagttgctcagaggtatcaccttcagattggtacaaaataagtacccttgagagctccattcacaaccaggaatctcttggtcacaagacaacaattcaccattagccaccttgacctgaacagatttagctaatcattgagccccagccaaagaagcagcaatctgagaactgacaaaactggttgaactgcctgaatccactaagatgagtacttcaaaaccttgaacccaccccaacaagcgcatggttccaccagattcagaccccacaattgcttgaacagacacagccataactgacggaccagattgctcctctaaatttttagaatccatcaaagaagattgttcaccatcttgcaacaaggaaaacaactcctgtactgcgtgcaattgcacagtggtggcacatttgtgagcaggtgaccatttttcggcacaaatgtaacataacccttgagcccgacgatgagccttaatagatgacatcttgtcaatagtcctgtagcacgttggccatcctgatgtttcttatcatcagcacgcacacctcctgatcctggaggtaaaggaagtggaaatgctcccttgaaagcagaactgtttttcggttgcactccaccatccgagcgccgaaagggtttactgtgattagactccgggaccacctccagcacctcttcctgtaaagacgcaatagccagagcagtctcgagatcgcgaggacgatgaagcaaaacagcatttctgatttctctatgtaatccctcagtaaaacgatgaatcaagtatcgcatattaacctcaggatcataagccaacagctgattcatcaactcatcaaaatgctcataaaactcccaaactgttcctgtctgcctaatttgatccatttgtctaatgagtaaatcatgttggtccttatcaaatttactggacatagtggcactaaactcttcccaaacaggatacctcacatgagctctagaagatctcaaccatgatgctgctcgtcctatgaagtaaatggtggcgactcgaacccatagacctggatatgtgttgttcacatcaaagtagtgctcacaacgcatacgccaatcctgtggatccgaaccatcaaattttggaaaatctaacttaggcacacggtgattatactgtctctcatcaggatccccatcaaatttcccacctcccgaatcaaaatttcccagagaattcattgaaacaggagtaacttcgaacttacccttgcccggagttgggatcagggtggtgaccatccctgatgccctaccccggtgatgttgtgcaaagcggtggccataggcccacttctctgcttcttccgccgcggtcatcaacttcgtcggcgacggaggtgtgggaaagcagcggcgccttcctttcctcgtccgtcaacggaactcgaggggaagatgccaatggagaagccatcttcgtcttgccgaggaagtccactttctggcggagctcgccaacctcctcgcgcagttcctgcatcacttcctccacttgtggcctccaattattcacaccttgatctatcttgatgacggtggcctgcgtcttgccttgtgctcgattcagcgccaacatcgactcctggatctcgacaagcaccttgctgaaatccacgttttgcttctccatcgcctccacttgaagttgcagccgggatgtgtagcgtggtttctccaggattggttgctctgataccaaattgtcacgaactcgattttctcaactgcgattcaattgttttggagagatttggagatagcggaagagatagaacggagtcgagaggaagaacagagagaaagaacagagagtttcagagtaagaggaggagagattggaattgattttggagaaagttgtttgtacattgctccaaagttaatctctctctctcctgccgacctaaatagtgtaggatcgaatcacaagaactaagccaaccagaggggggatgaatggttggtatacccaaaaaccgaaaacttttagcggaaataaaagttaccctcgaaatcgatggatcgcggtcagaccgagattgatctgtcggtctgaccgcttgatgaacgtcggtctgaccgatgtagattgatcggtcgaaccgccgagaacgcctgctgtcgactcctgtcaccgccagtctgaccgtcgtgtgcccgccggtcagaccgccgcgatgccgccggtctgaccgccggtgcgttgccggttagaccgccgaaacccagtgaaacacaaatcgaagaactcttaaagtggatgacgactttattacttctctctatgtttacaaagtgcaccaacagcactccttacaaaaatttcgactaaactcgaaactctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtagaagaaagaaacattacataaccaatcgtaccaaatttggactccttccaaatttgactccacatcccatacgcacacaataacttcatcgtatgccatatggaatctccatcaaccacgtgcatcaactctagcctaagtatcccgcatgatctctgatcaccacagacgtcgtcttatccccaagccgactcccggtccatcaccgcaaatactctcccgagacatcgagtcacctacacatggaacaaacaaagaaaccatattccgagaccaagctatctccaacttgactcattagtagcaaacaacagtattacatatgtatagtatccatctagaagtcataatcatgaaataatcacggatatccaaacaaacaacccgaaaccgaaaccgacacagtgtcggccggtcagaccgtgggctggctggtctgaccgcgcgcataccgctggtccgaccggctaccagagcccggtctgaccggtcacatgaaataatgaatcctgcgatcacctgtgaaatccaatcatctccaaaaccacttcgtgaataaattccaaataacaaaaccaataatctccgatgcccaattgttcatcacagaataatcatcaaaaacacctttgattttacaaatagcacagcactacaaggtctcactcactctctaacagtggccccgtgacagttaccgggtccactcgtttgcagggaaccttctcgagggctgcctctctctgttagacttcttgagctggtcttgtccttgagccggcgtgacaaggacctattgtgaccggttttgattagttaagggacgcccaatatctggttttacggttgggggatgattttataactcgatgacaagttgagggaccttcggtgtactttttccccgtattttattttcaagcggaaaaagtgcaccaaaggtccctcaacttgtcatcgagttacaaaatcatccttgaaccgcaaaaccagatacaacgtatctcccaacttacaaaaccagtgcaaattaggtctctcgacggttttgactccagttttgtctgacgtagcagctgactcaacgtgggacccacgtgggccctagtgtcccacaagttagctcttcttcccctcccctctccacctttctttttctctcctctcctctctcatcccctctcttctctgatctatccgcgtcacgaagccggtgggatggagtggggcaacggtaggcggagaaggcaggtggaatggggagacagtggacggggtagagcgaggtggcaacgagcggagaagccaggcggagtaaaatgacggggcacgaagccagcggggtggtggcgggtagagcaggtaggcgaagtggggcgacagtgggcaaagcggcagcgcgcgaagccggcggcgcggagcggggcggtcgcgggcggagcaggcaggcctacgaggcgatggcgcgcgaagccaacggcgcgaagcagagcggtggcgaacgacaacgacgatggcgatgggttcgaggaggaggaggaggaggaggtcgcgcaccacctcttcctcttccccgtctcctccatcttcgtgctgtcgtccctcgctacatccgctgccaccgcgccatccctccaacctgctcgccgtcctttgcaccccgtctccgctgtcctccgtgccaccctccgacctcaacggcgtcctcaccataggcaacagctcgccgcgctatccccttgcccaattgctcccctgccgcccgcatgccgctcctcccctgccgcccgccgcccgccgcccgcgcaattccttcctctgccgcctgcccgatgccgtacctcgtgacgtcagacacctagctgcccagcgacaacacgctgcacaccagccactccttgggcgtcgacaccttggggctctcggcgatggcgctgcctcggcgcgggcgtcgcgccaccacctggccatgtaccccttgacagcggcaacgccgccggccaccacctccttgggcggcatgacgagcgggttgtggtcaatatagagaagagaaaggagaggagagagaaagaaaggtggagatgggaggggaagaagaggttgacgtgtggggcccacgtgagtcccacactgagtcagttgctatgtcggataaaaccggagtcaaaactgccgagggacctagtttgtattggttttgtaagttgaggaatgcgttgtatctagttttgcggtccaagaacgattttataactcgatgacaagttgaaggaccttcggtgtactttttccttttctagcattggctttttaagtcacgaaaacacttctatacaagttttactcataaattattttaatttttttttgtttattttctctgggcttatcagctataaagtaaacgatgtagtcgacggcattggcaagaaaacttttgacaccgtagcagcttcaagagaacaaagaatatgtgaaacttgaggccatagcacataaacggaaaaaaaaggaaagcaaatgtgtgaaaacggaattgctcttgcgaggatgcatcggtttcatttcagatttttcaatatgtacggagatgggcctgtccgaaaatcatgtgtgcttttcttcacctgaaaactgaaccgaatccaatgttcagttttcagtcggcacaaagcgaaaggaataagaaaccaaacatagcagtgacactgtttgagcccgtgacatcacagactttggattaatgtcaatttatcatcgttagtttctgacaatcactctgatgagataagcctctaaacttaaaaagaaaaattctaaccccaagtatccgacagctgtccaccaaaccaaaactaatgggaagccaaacaaaagaaaaaaggcaaatggaggaccaactactgcacctgaccaatcatgcataagcaacatactgacatgggttccaactaatcaaatgcatttatgcattacatggaagaccaaataaaccaaaagggaaaaataaagggaaatcattaccactatcttgtcggttagaaataaaatggaaaggggaatacatagtggatggttgactaacaaagccatgggtgattacatgcggctgatcaaagagtggcaatagtacaccactccaggtcacacttcatcaattgctttcagctttggacaattcaagatggagtccccactttggactactgtatgttcctgtcatcttcaatcattttcactctcttctctcaagttactcctttcatcttgagtggttgccaacgaatgataacaaaaacataagataaaatttactatatttacaatagttgattttgggacgtacagcggtttgaagcgcaattaaacattaacaaagcatgacaaaaacctttacagatcatgccttctttttataataaaaataaaatgaatctcataaaaatcttgtaaaattcttatattagaaacgatcaatatatgtaagatcttcataatatttatctcaacctttattttcttttatattgttccagaacatataatgagggataacgtacataacttatattgttatctgacctccaaaaataaccacgtgcaattaattattgaatacgatgagtataagaacaaaaaaaacttgaaagagccaagcatctattttgtactgaataaaacatacacgggactataagataaaaaatcacgtcattgtattgtgttttgaagcttgtttgatcagttgaaaacttttcgggcgatcacaatattcatttgcaattttcatagtgatgttatgtttgttgttgtattgtaaaaactacagcaccatgatttattatttattatattggtgcaatagtcacgaacagaaaacaaacattaggtatttcgacagcatagcaactatacacaatatcctaataattcctttcaccatcaaatagaaattgagaacaagctggatggctaccgagaatattagttacagctaatcactactccggtcgaaagaatatcacgggttaaaacaccagtaaaacgtggtctgcattggttaggccagcaaacccaacgcgccgtcattatcacaccacacatttatttttttaaaaaaacccaaactgttttaaataattaattaaaaaaatatagaaggaaaaggaaaggaaatcggagggaggaggggaggagaagcgaagcgaggaaggtcaagccggggagggcacgcacgcacagatccctcccctctcctcgctgcccatctctctctctctcttcccctcgacgcggcgagatcaggaggaggaggaggagaggggggaagggaggaagggaggctgagatcccgaggccccccaccggagacggcgaatcctggtccggcgcctggtttgcccccggattcgggaggagtttccgttcggggtcgagggatttcgggggcgcgcgcagccatgaacgagaaggcctccgtctccaaggagctcaacgccaagcacaagaaggttcgtatatcctcccgttccgttatatgtcgatttgttcggatcggaggctggccctttcgatttgggttggaaagctacggcagagtcgattcggcgtgcgatttcgtttgttgttaggtgagggagatttgggatccgcgatttcgtgggttcctgatctccccgctcctgaattgcgcgcggttgctttgcaactctttttgtggcgttaggaagagcgtggcgcagatcggaattcgcttcctttgttttgccgttattatgaatcggggagcgggcgcttttgctaatttaagcttgattatatggattttgtgaattgttcgactggtggaaatcgttatttgaaaaattgtttgtaattttatagtaggtatccttctcaatcgtggcaataaaaagttaaacaattcgcagtcaactgtacaagcaacctagctatcttcgttgctacaacatattgttaccattttgattttttcatgacccgctcaagcctcaacaatattaggtattgttcatgaagtaccctgtcttatttaccatgtttatggctcgtccttgatttccagatattggaaggcctcctgcggctgcctgagaatagagaatgtgcagactgcaagtcaaagtgagtgatcctgtgcaattggttctccaaaagatggctattgatgcattatacaagtttatgttttatcattagctttgctgctaagagtactttcacttgatgacgttgttttttatagaagttaacattctgattcattgtccgcttgctgatttgtgttgagcaagttctatggcatttggagggcctctagtaatctagaagcaattatttaagatatttattcttattgcttcatcactggtttgttgcatccaacatgttaaccatctattcctggaaatgaaaattttctgttctatttattgacttatatagtcagtatagttggttaaacctcctctccatcatgtctaatgttacctgtaaattcatctctgagcatgtaatgttagaactgataggtagacacttgcatgtgccatagttcttgtcaactgactgtttccccatttttcaggggtcctcgatgggcaagtgtaaatcttgggatctttatatgcatgcagtgttctggaattcatagaagcctcggggtacatatatctaaggtcagtgaattatgtgcatgagttcaactgtttattttcgaactcagtatgcccacttttttttttctccttcatacaagttctgacaaatttggcttgaaacacaacttgagtactttgaatgaccaacttttcatgaaaatttggtagctgctctatcagtgtcattttttttatagtatcaaagtatattatgcttgtttctttcagttcattgcatcctggctaatgtaagtttatataagattataaacataacataaattcaacatggtagaatggccatcaatccatcatatgcgaaaccgggctgtttggtttggtgaccagagtttgccataccaaaccttaggcgtgctacactttaatagcctagagcctggtttgttacaactgtgacatgccacactttattagctcttttcacatgtcgtacactcaatttggtgcctaactttgccacacttgtggccaacgatttgttggccacactttgtgtggcaaaccacacctttggtagttgtggcaaagatagtcatcaaccaataagcttagctatctggattctgcaacaaccttgacttcgaagcttctgagctggctggcttatctttttcatgtactttgagaactcgtgctcacaattttttactggtcatcattgcaccaaattgtttgtgtatattacaaacagagaacgtgaaacagctatgtatctgttttatgtttaattctttgagatgcatttctttctttcatgtggcctcgccttcaaatctatatcaatagcatgcggtttttgtctatttaatgaaccatttttttccctgacgcaggtaagatcggctaccctggatacatggctgccagagcaagttgcatttattcaatgtatgtattactccctgaccagaaatttttaatatttgccatcaaacaaaggggtaatgcagttctcaatgatgattgtattcccgtcttcacttctttcagcaatggggaatgaaaagtcaaatagctactgggaagcggagctgccccctaactatgatagggttgggatagagaacttcatccgtgcaaagtaatgaacctctccaactttcagtacctataaatctagtacaatccatttgtcttgctataaatctagtacaccaatgtaaatcacctgcctatccaaggcctcccatccccccgcgcaagcaaacaaatacaaaaccaaaataaaggtttaattttgctttttaatacttaccattcattaatgggggaatgaaaaggcagttgctccatccggttataaatatttaattctaaggacaagatttggtcaaatttctaaaattctgaccattaaaaaaaattctaaaatgcttagttttaaacacaaaaaatggccatcgatagatttgacttgaaatgtactgtcataatatcataaacttattggattttataaacttatcctaatataaaattggttgctggaattttaaaaggttgaccaaatctttgtgctaagtgtcaaacatttatgaccagagggagtaatttgtaggggtgtttatggatctaacctttggaacaatgtgttggactaatgttattaacttatgtctaaaatgtagatacgaggacaagagatggataccgaggaatgggtcatcaagaccatcatctggtgctagagatgagaagagctcagagtcacaaactagtgttaacaggggtggccataatcaaagatcttcatttgagcaacaccgcacttcaccagctgcagtgagcaaaattgctccagtggtttctaggacgcccacccaggtaatcctactggattatgacaagcttttcctaggtgttgattatcagttaagtttattgatacttgcctttggtagtagcatctttagatgtaaacagcttgagggatcgacactcttttcttgaagccgagctatatatattccaaattgtagttcttaattactatctgccacttcaatagttaatcgaaaatggagaacgatctataagtttcatatatgtgtgtgttatatgccttgcgcacaaactgtagatttccaaactgaaaaatgagaatgatcatgtgatagcgtgtatcatgctaatggatgatcatgtttatagttttgtttcttgtgcctgaccttgataacttgatgataattaatggtttcactttgcttacatgattgaaaacacattcttacaaccagtgatattttccacattaggttaataagtgttaagttaaagttggcacaatatccattgagtacttcaagtaatttggagacttaagttattattaagttttattttatacttgctgcattttgttgtgtaataatttattactagcttctaatagttttaatctggtacaactggtcaactgcattgaaatcaggcaccacatcagccaaaagcacaaccatcagttcccaaggtttcacctcctcaacccgagaaatcacctcctaatgcaacaccaccaaaggttgagaggccatcagttgcaccacctcctaaggttgactatgcaactgatctcttcaacatgttatcaatggatggaacaaccgagaaagaagcagagtcatcttctaatgatgatagtgcatgggagggcttccagtgtaagatattatgacttaacatttctattgaggaattattcttgttatatgagcatctttttatgaaatgttctgcgagtgcttcaccatattccttacttgcatactgtggagtatcttttaatttgggctcctgtgttctctttctcaattgttcagctgcagagccagtacctagctcagacaaaaaggattctgctaagccagtagaaagtaagccccagtctacatcaggcatagaggacttgtttaaagattcaccagctgtgacagtatcctcagctccagctgccccacaagtaaatgtgaagaatgatatcatgagtctgtttgagaaggtcagcgccagcattacttttactaatgcttttgtgaaatggctctgtcatttaaaagaaagagcacatctatggtttatctgaagaaatacgtgtattttgcagtccagtatggtttcgccatatgctgtccagcagcagcaacttgcttttatgaccccccagcagcttgcacttctgtctcagcagcaagctttactaatggctgctcttaaagctggaaatgcaccccaaatgattccagggaacgccagtctgctaaatggtaatggttctaatcctgccaatggaggcttgccttcacaaagctggacaaatcttgcttatcagaatcctgggttggctccagtagcagcacagaatggtgccaccaaggtaagggcttttagatcatctgtataaatatgtgttttactgtatgttcatcttttcatgtctttgttacttggcaggttgcgaacaacaatcaggaattctcttttgggaatttcaattttagtacacctgggtaagcaatattgcttgactagtttttggcaattaaaacttcataccacagcttacttggtcgcgaaagaaatttagatgtgctttgaggtcacaaatcatggcttagcttttctgatgcttacttttgttttgatgcagagcatacaacactagctcatctgtcccagcaaatggggccgcaagtgcagctgctaacaagagcacatccccgacctcttcttccctcccctctcaatcaggcaaagaatatgatttttcatcattaactcaaggactgttctccaagcgatgaacacttgctatacttggaaattaaacaaatgggcctgtatgcaacgatggacacagcagattttattagggggaaccgggggccttgtacactcttttatgaggcagcatttcttcttgtggatattacgacaccttgtagctgtcctggacaaataagaggaagaatatagcagctaattgcatatgttgtttcctacagctgaagagagtcgatattgttcatgatgccgatctctttgaatagaggacgccttgtggctttgttggacttacatttataagagcataatgcaactattttattctctttgttcatgacatagttacaatacgtgacgccgattattttctactgtaccatacttggattttgttattcacaaaacatttgattgtattattatgccaagtgagctattacacgcactgaaccaaacttaattccctgacatttgttcgtgtccttgatttttcgtgtgacgaatgttctaaggctccgtttggcattgcgatgaagtcactttatttatttgtaggatgtaacagtaaagaactgttttcatgtgtacttaattttttgtgtggtgaatgttctaagatcgtaacgtgatagccatcaactgaaaagccaagtttatgggccaaaactcagcggaccaaacggcccaaatccaggacctatgagccgaattcggcagatcgtccgaatggccagaaagcacgcgaatcatggggcccaagacacgtgctctaatcggtcgaaatcactctcactaatgggctgaaattcaaccgatctatgggccggaattctgagtacgagtgggcctaaatctctccacatatgggccaaatttacgcggacttatgggtcaaaagtcctcggcccaatgggtcaaaattcgagcagtgagcgaaaattctgggtactaacgactcgaaatttcccggacatgaaattccgcacggctgctcaaacttttgaaggaaatgaaattacccattctgaaatattgaaaaaatcgaaatacggatttcaacaattcaaccgctacaaaagagatactacaaatttcaggaaaacaacacgacttcttccaactgttaaatgccacatcttaaaagtggcaaatagttaaatgtctcacaatcactattcactacaagtctacaacacccaattttcagatgaacagatgatgtaactttttattcctccatgcatataactactcgatcaaaattataccacaaatggaagcagcaaaaagctcaagcgggctcggctgcggcctccaacatcctgatttataagcaaaaatgtttcaccactttgacgtaacaatccacccaagtggcagaacaccataaatatcctgaattggctgcgatcgatatatagccgggttacccttgacagccgccacagaatgatatggcaatcattgttgaggcctctcgttcaattccattccaacagttaccgctgcttaccactcatcaacattcagcatgcctgtaaacgttttttcaaaaccacaacacggtcaactccttgtcaatttactctgaagggaaagatgggctaatagtactagtttattcttaacagagtaataatgactcactcatgtgaattggagtataccccggtccaaggcggcgacaatgctttgattcgccaacaggtggtttcactatcagctgactgatgagctctcagcattttcacgtaattctcaagcgtatgtgcattctcgtctatcttgtcgttggatacagtatcctcagccaacttgactgcagccctttgagatacctcaaaattgtctccagccagctgcacctgacgggcggtttcttctcttcccagttgtattagaaccacaagtaggcttttaagctcagttagagcaccggaggtcagagacatccctttgagatgctccacaagtgccatctcctccccagggctgcacaaataaagttgacggtgagttgaaaaaacaaacggagaattgacgtcttaagaaaccactcggattttattttattttatttaaaaaaaaaaactctcaacagaagccgcctaccttccagctcgtatcttgccacctttcttttgtcgccttgcccctcttgacttgctggcactgctagatatgacggaagcactagattcctttgttgacctgcacgagcagcatttagaatttcgtatgggttcaacaatgttactcaacattgattgaagtttcagttgatcctaaagcaggaggacttggaactaaatagtgaaaaaaagaactaaaaacagaagataaaattgggtcagagaggatgcgcagataaaaatggcagatgacacaccttgtggtatatgcactcatttcgctgaagctagtgctgacttctgaaatgctgtcgtcttcaacatccataaatcggtcttcagactggagcttggctgcaagtgacagtctcctctgccgtacagcaacataacgggccagatatttgcccacctttagcaatccttcctgatactcagaaatcagcaaagcagaacattccaaagctgcatctctaacagtatcaaccagatcttgcctgctgtgcatataagctacccgaagagcttcttcccattctcttgccgtgataaagtaaccaacacctctatcgacatctgagcaatactccagtgctattttagcagcatctccaggtttcccaagtgcttggaactcatcacataggtcatgtgctagttgaagaatttcttcctttttaaacttcagaagacctgcaacagtgaacacacctctccaatccccacaatcacgatacgccttcaaagatttctgatacgacgaacagcattgataagttattgcagcatctgcaaagcatttctcttcagaaagttgatcaccccatgcctcaagaatttgatgccttttatctgggtcagtgaataactggagccccaaagggaacaattgagggttagcgttgaggagtttcatacagtcctcatgatactcgtcgccagcagaaacaatgttcttgagagcactttcatatcttccgagtcttaaatcaactgtgtacttcataatagcaggaggaaggcattcaagactcttgagaaaaggaaggaactcttttggatctttttgggaatttaaagctactatagcagaaagattcagatcatacagtcccaaagcagcattaaaaacagcttctggttcggttaaccatagcaagtgcttcagggactcttcagcagatgggtagagctttctcctggcatcatcaaccccaagaagttccagttctcggataacttttattctattcagtgcttcctccaacagaggaggttcgctacgggctaaagtagtcagtatgcagagttctcttgatgagctttcttccacctgcacctcaagggcttttcgaattgccatcagtacagatgtgactttgttgtctgacaacagaccatgagtatttacagtatcagccacagaggttgcacagtgatcaggaaatgatatgtaggtctcatacaatttgctgctgacattctcattctttattgaacaaacaaattcagtgatgtggctaaggttattgacttgtttaacaaaatctgccgctgacttcataaaagatttccagccacagtagtcaacaaccatattgaaatcaatccgatggcgccttaccatgtcaaatgcatctctaaaacgtccctgaaccagtgcctgaacaattgaaacaaggaccagcttcctggggtagatacactccaagttaccacgggtggtttgcattatgacagctgcttcatcaccatggagaacaccaatcagctttgcccccttttcccatacagtgatatgctctttgctttgctttcctcgaggatgactcctgatatggctatcggttgtcacttcgccatttttaagtaaaatctcactgatatccacgatgaataaaagatcctgcttagtagtcacaagcaagtgggtcacaacctgctcttttgctccataagcactggaatagaatgtgaagctgctacagttactgcttaataaccttttgcccacatgcaacttgctgctatcatcaagtccaaagagaagtgtcctaaccattccattttcatggcattgaacagcagtcatccaagggcatgatgttggaaaagtatggtcggaacctgtttcactaacttgtaccggggcagacattctaaacaaattcacttttgagcagtattcaacaacccttcctccacttaactgaataaaggctgaaccttcttttgctggattttgagatattccaataactgcagcctgcagaggcattttcttcgatatttttgcctgccaacctgatgaacaggctgaacctagcaaagaatcctcggaacatacaagttcaatctcattgataaaatatggcgagtcatttttctctagaaggctactagcttcactggacctcattggtgttgaagagaaggcatcagcgcggcaacaaatgccgatcaaggtacacgtatcaatccaagtcaggtgcatatagttattcaatgttgactcagaaaagcaagggtcaacacttatgccactgccttcaaactcttcccaagtatctgccaccggaagtaccgacacacacaagctgccattagaaagataagcagcaatatggtttttcgagttataggatagaaaagaaacctcattcacagcacaaggaaatgtaagatggaacaaagacatggggggtggcatgagacccaaactgagaggagttacaaggacatgggaaccatcaataacaagcgcaattgaagtctcactgacagcagtagtccaagcaaacctgtgcgtaataacctgaccacctaatgtccagcagatgagatgcattggttttgtttgatcccaatagaacctcaccccttctttctttgtgtatcgcagttcttgtttcaagtaccagtgattgttactgcaggaccatactttgataacatcatactggccacaagagactagagcagctaagagttcagaattgcagttccattttaaagcttggatgacagcctctgctggctcatcaatggaaaagtggctcctttctaagccattcttttcatagaatacaatgagagggcactttccctctgtcttccggtcatgggcagtggcaaccttggctccacttggcatccaatcaagtgatgctcctataaaagccttggtatctgaagaagaatgtatatttcctgattcacgttcccaaatagtaagtttctgagagctcccttcaagcccaccaagagtagcaaaaaactttccatcaccccgccaagaaatagaactttggatgtgaccattgggactgttgatatcacctgtaagatcacactggaaacaagcatgtgtagaatgagaacattttagtcatatctttagtcagatcatgtaaacaaaaacttacatgagggtcgagagaagtctcaaacagcacttcccaatcgtttgtcatgatgagcaattgtccaaacccggtcgtaacagaaataagggccccatcaggactagaagcaatggtcttcacaccaccctccagtcgtcccacaacttcagtagttttctcatccacattatacaataatagacaaccggttgatgaaccaagcagcaaagactccttctccattagataatccatggcaactatgtaatctccaggttcaagaacaacctcctctgcatcagagtctagggtactttcgctccattgcagtgattgctgaaagacaaaataggcaatcagcaaaacagaaatactagcaaaagaaaaggtaataatcatatcgactaaaaaaacagattatatactcccttcggccataaatatttgacgtttaggacaagatttgatcaaactttcaaaattccaaccataaaatttatactagaaaaagtttataaaatatagcaagtttatgatattactctccttccatttatatatgacgacgtcgtatataaacagaagcaggaagtactttccaaggaaaatctacaaacaccattacttttgttttaaactaagaatttgagaaattattgatggttggaattttaaaagtttgaaaaagatcttgtcctaaatatcaaatatttaggttagaaggtacacgctcagtgctaccatagcaaattgaagatgatgatgtgtttgtttgtttcgttgtacaaaaaaaaaaaatcatagtgttctgcccaaatttagttagcagtataaacgggtgtattgacccaaaaaactggaatctgagaatcatacgcatggtaaattaacaccatataatatgtgtatccctcttgtactgagcgtggtactactattgctacgttgcgaggcaaacaataaaacgaagatttcaagcagtataacaaattggtgagcagaggaaccgtacctgggtgggggcggggaggtcgacggagtagaggaagttctcggaggagacgaagaaggcgcggcggcgctcggcgtcgacggcggagactaccacggtctccccgtcgagctggagctgaagcttctgcgctatccgggtaaccacctttaggttcttcatccccccgccgccggtggccggtggatcccttccggccgcgggaggagatccggggagagacggagacggagggagggaggagggtggagggcggcgggtggagctcgccggagttgatgggccgcggcggcgggtgtctagggtttggggaggttttggcaaaaatatgagttgggagggcttcaaggtggggggctcgatcccccacccgtgtcgatctgggccgtccacggaagatccgagggttactgttaaaatcgtttttatgttttcaaaagggttcttgctagcaacgaccagggcatatttgcaaacttaaaataacttgggaataaaacttttatatatgtgtttttagtgatctaaaacaaagaatgaaaaataaactaagatgaaaaacttcaaaatcaactccaaatttaaggttggaaattcaaattttagcttgtaaatatatttactcatataagtagaagcgaaaagatgaggctgagctgtgttctagagggttggaacttttcagaaccctttctactcggaaacggagctacaaattaatacataattaattaagtattaattaaaaaattaaaaataaattaatatgatttttgaagcaactattttatataatttaaaaacatattaattataaatttgaaaaacgtgcacatggaaaataagtgactggatgttgggtacgagagaaaagaacacacccgaagtaccgagcagcagtgaaaatcaaagcgccctccctttaaagaaaagaaaatcaaaacacactcaaaacgaatttaaaattttcatttcgaatgtaggaatttcacgatgaacgattcactttaagctagaaacggagaattatttcccgtgcgagcatgttaaattgttaactcagtacaatcgtgcagaaagcctattggaaaaatccaacagaacaaaggtctccaattttggggctgtttacacaacgtagaaatctcacagaatctaagcaggtaggagtatttcgataatttttttaccggtatttgatttcaaagccttcttttgttgcaaacttctgattaagggagagagaaacttcgacaatatttcacctgcacgagcacgattatttgctcgtttgctccatgcatcctgacatctttctcaaaattctttgaggacatcacacacaaagagagagtaagcataatcaaacagtttactctaggtgatcaaaatactggttcgacatcatatgtacatcaaaattgaaactgttacatcctatccggcttcgctgcaccatacgtatcactagtaaggagcccatcagtcaccaaagcaattcttctcacttgaggaaccccaaattcatcactcgacattccaccacactgacagaagatagattgccaacttcctctaaacaggaatgactgcaggagacaacttaaaggctacagacttttgttgttgagttgaaatgactattagttagtaataacaactaataagtgaccaaatggattttctaatattgtttcagtaaatacaccgatggaaacttttcatcattctctaaactttatctgaaaattacatgtacaatggatgggctagccatcactattctcagctctacggtataatgtgtaagcattgtcaaattgccagccagcaagatgcacaatattaccatgtaatcacctggatgaggaagtgggtcagcagagggacataacctggaattttctggtgatatataaaatgcatttccacgaaaagatcactgtacagaattcgcagctccttgtggctagtacttgtaagaaattagtcactatctagcggtaatccaacacaccagcacccaatgtaaatggaaaggttagggaacctgcatgcaaataagatcattaataagatctatggcagcaagccagcaatatagtttttaatggtaaaagaataatataataagtaccatcagcagggccattgatgaaattagtatggctgtgtagacctcctgcgacgatattgtcaattggattttgtgtttgatcacaatgagccccaatcatggcagcgatgtctgggggccttgtttgaagagcttgttctacttggtccataaatatgcttgattggttttccatatatgcaaaagtttctatagaggttgcagccctagctgctgctatgctgaacatccgacacagcaagttataacgttttgtttgaaccaactgaggatcaccatcaagtgggaatgaataactacagtttggagatcctgatttagcatcctttctccaccttttcaagaagtattgaggaggaaggtccttgatattcctggtgtcaagtacctttagcatatggcggcatggaatgcctacgaattcaaaccctttacagctacagtttaccatggaattaagcgaatcaaatttaacaaaatgatcttttggattgtcctcaatgactaccctatactcagaaattgtgcccatctcaccacagttgtataacatgcaatccatgtataactcaaactccctctcgaacattttaaaggcagcaggtgtatatatattggaagcttgccttaacactcgcataggtggtggcttctttgtactctgactagcatccacatcagcctgcaattctgttgatcggcggtcacacaatactctttcaaactgcttgaagaaactcaaaaggtcaaattctagggataagtgtttcttaagctcagtgcccaagctctccttctgctggacacttttcatatcagcacaaaatgcctcgcggccatatggtagtgcccatttctccttaagagagaacaaatctgctagccattgattatcttctaggtcatacttttccaacatttctctccatgctgtcaaaaactcaggctcatcttcagagtcaaataggcatttctggaagcagtaatctaaggtttttgacccatgaaatgcttgactcaactgctgaagagcgttttggtaaatttgccagacacaataacgatgggctgtcgcaggccaacttgctgcaacaccttcacttattgcatcagatctatcagttaacaatgttttgggctgagttccattcattgccatcttaaaagtatcaaacaaccatctgaaagcctccacactttcgtcataaagcaatgcagcagcaaagataacagtttgcttgtgatgattcacacccgtaaataaagcaagtggcctaccatagccctgcaatgcatacgttgaatcaagacataccacatcaccaaagtggacaaaatccatgatagactttgaatctgaccatagaaagtttgtcaagttcccatcatcatcagattttactgcaaagaagaatgaagggttatcatgttgcatcttttgcaggtactctagagtagcacctacatcaccatagtgaggaacctttgtacacttgaatcttttgttacttctaccttctagagatgttgccatgatatttccaattataagattttgcctgtggatattagcatcagctgaaccatcaaccaaatccagtccatcatcttgaccagtttctgtactttgtgatgttgccacaagatcagaaggtactgttgcaccaagctggtgattatggaaggtaacaaattctgttacatgatatttgccattagatgtaagtctaatgaccatacacgctggacaaccagttcgggtctctgggcgaggcttctttactctttttgcccctcttttcttctcacggaaaccttcttttgaacaaacaaacatccttcttgtgatgacattttcagcattcatagtcatgcttgcccttctcacattgaaaccaattttcccagcatacatgctgtaaaattcatatgcctcatcttcactcccaaattctggcgtcctcacagtatcatcaaccagattttctctcgcagcccgtgctttaagcctgattttcttagccttcagcatatgcattgtagatgctgttgcaagttgatggttatggtttggtacaaactctgtcaaacggtacttgccgttggtattaagtctaatggtcatgctcgcagggcacccaattcttgtttcaggccgcgggcactttgcttctttggtgcccctcttcttctcccgaaaaccttctctcgagcagacaaaagttctcctagtgattatgttctttgacgttgtccagagtgttgatctccggacaaagaagcccaccatctctgcatacgcattgtagaaatcgtatgcctctttttcgccatcaaacagcatatctacctttggcaacatcttctcatcacaacaaccaacgtcaggactaacatcagccgccgccacatcctgccaatcacaaattgcagcacagcacaatcaataagaaggaggcgatatatgaacatatccctcaacacctagatcaagaaagtcacataggcaactataaaatcgcagtaccacgttttgttgtggatttgcaggattcaccgctggtggcagggtcggcacatgatgaggccatgttgcatatggaggcaggaggactacatggcccggccaagacagctgtgctgatctcgggtcagcggcaggatcaatcactgcatgaacaggcctcagggtccggaccaacggcagtgccacaagctccggagcattttcaggatctttctccttcgcgctacccccgctattgctggacattgtgttctgtaacctcactcatacaacaagcttacttgatagaaaccggtgaagcttctcctaggtgcccgtctctctcctccttgtcaaaaaaagaaatggaatgaaaaaacaaaagaaatggaatgaacaaatgcacaatctgttatctctcttcaagaactaacattctagtagtagaatgcaagcacgattgatgtcaaaaaagttctactcgacgggtcagaagtataaagaaagggggaaaaagaatgtgcttagaggcggcgcgagactagaagcagcacacataatgtaaaattgtaaagtcaaatttgaccacgcttacaacgaagatcaccgagctaagtaggaacagcacagcgaatccatggcaggctagctcatctcaccgcaggggaatcaaagaacgcacctgtaccacccccacccctcctccctctccggcgatccgagatggagacgcggccgacggatgacacgcacccgcgccgctgacccctctccagcggggctccctatgccggtcgcgcctccgcagccacctgctcctctcgatgcgccgccgcacgtccgcctcgctcctccgcgggtcgctgcgccgccggccaccggcgcttcgctccgctcgccgcctcggtgacaagagggggatctggggacaaccgggctgaggagtaagggaggtggttatgggctattgggccgaaatccacaccgcgtggacccacgggccggatatatgggcctcacgcaaaagcaaagtgggccgtagcatcagcccagatcgtgagttaaaccgcaactgaagcagaccccctctgccgttgatcttgtgcactaatctcgaaacaaacccggtgcagtttcttcaaaacgaagtgccctgttcgtgcttacggtttcgcaaagtgcagtgtctgaagagaagaccgaatactgtactaaatacagtggccagacacgtgtagacgagtaccatgtcatgctaaattgctactagtttaatgctcgatcaagttcggaatgggcagcatgccggccatgtccctattgagtattggcagtgttttcccgttttagttacatgattagtacgcaatcctccttgatttgacagtccaggctcgctggcgcgtgccactagataagcctatccaaattaaatcccggtgaatataacctcaagtattggtgtatgatatcattgattgtttgaggcacgtttaaccattttcttaattaaaaaattatatgtaatgattatttatttttattgtaacttgatttatgttttttaagcacgacttaaaaggttttcatagttttattaaaagtttaaataagatggatgatcaaaagtttattagaaaaagttaatgaaaccatatattaaaagatatattaaaagacagatatagcatatctctgtccatcccactcctgtcgccgacgacgtttacgtgtgacctgccggccggcctctcgctagctatagctcgatgtatatcgatctctcccatgtacaatacaccatgggttacatccgcgagacgaccgtgcccatctgcacagccgtgttgacatgacggctaggcggctagctgatcggtgaacggctagaaattaatcaccagcatatatatatatatatatatgacgacagggagcatttgcatcagtggcattaatcgtagccaaacttaacgagcagtgtcaagctaacctaagctagcacatgatcacgagaacacgctagaatcgacatgtagtacgtattgtgtcccattaattgctgaacatattacatcctccgtcggcagaagcttccaagctagctgcagtaggttacatcgtcccaactgtctgtttgccactctgccgtgttgaaatactttgcatgctcgatcttgatccgaccaacactctcagcaggtagtcgtcgagattcatctgctgctgcatgctattagctctgaacgtctgaatctcctgactttcctctctgcctgggtcgcgatgcaacgacgacgacgtacgacgcgcaattgcgtcggccggctaatgcatggccaggtgcctgtcgctggcggccgaatcgcggcgatttccggttggacgcagaggctaggtcgtcgtgcatgcaggtgtcgggcggcgcttggcttgccggccggcgacgtacgtgaggcggccggccaggatgttataagcagcatatgcagctgggagacaattcgagtgacagtcaaactgtcgataagattcagaagaaaaaactttttgagattgtatcggataaacactctttacttttggtttgctgacgttgaaacggtcactttgtcgtcctaactaaccaactattttacctgcggttgctggtatatatttttcacggtcaatggctcaatgcgataagtgtaacttgcagtgtacacgtctgacatataagatgggcgttgatttttttttcccttttgtttttcacccgcaacaaagctaagtcaatagaacgatatggagcactgcaccttatccagttatccttgactccgtctttatacaatttcgatatgatcgatataatggcacgctgcgatatactcattctattccaaaataaactaaccttgtattataacataatgcattttaatgcaacaaatttaaacatcacatcctaatattttgtacttgtgtacgcacgacatactacctccgttccaaaaaacacttaacgtaggaggggttaatttttttttataatggaataaaacatcccggcctttgctcatcagagctacagccaattattataaaagtaacacccaaacactgagtgtagttcaaatgaattaaacacacccaacaaaataaaagatcaaactaagataaggagagcatatttattcaagtctatttgtgaatctccatccatagtttgcaaggagttgcatgaccgttgtctcaagcctacgacatgcaaccttcataagctctcgatcatcttcacacatttgcaactgtgcccaaaatcggaaccaatatgttgccctgaaaatcacctgcatatatgagatagatagtgatttgtcaaaaaccatattattcctagtcaaccacagagcacaacatatggcagaagctcctacaagtatgagtttactcttcttcttgtctacccccaagagccaaccatcaaacatattagatatggtagtaggaaggtataaaccaagagagaactgtactgctctccaaacaaattttgcataatgacactctataaaaagatgatgaatagtctcatttttcatacaaaaacatcttaaactaccattccaatttcgtcttgccaaattattcttggttaggacaacccctttaagcaagtaccacacaaaaatcttaatcttaagtggcatcttaagcttccaaataatcttgtttctctcaatataaccattattaattaaagctagatacatcgacctaacagaaaatattccattctgatgataattccatctaaagctatcaggggattgattcaattgaatatgtacaatagaagcacacaattcatgccaatatgcaagattctgaccaactaatgatctcctaaaggaaacactgagtggaacagatctcataacattagcaatagtagaacttttccttcagacaatagagtataaagatggatatttgtctttaaaagccaggtttcctagccatttatcttcccagaaccttatttgtttcccattatttacagtctaagaacccatatctaagaaggtatctttgaccttcatgagacctgaccaaaaataagaatcgccctgtttcttattaacttgggttatagactgattgtagagatactttctctttaatagattttgccacacaccttcctcgttaaatcaacttaaacaaccacttactcaagagacacttgttttgtatttccaagttatgaacccctaaacctccctgatccttaggttgacaaatgatatcccatctagtaagtctatactttttttatggtcatccccttgctaaaagaaccgtgatctataataatcaattttttgaagaaccccttttggtatctcaaaaaaagatatcataaacataactaaacttgaaagtacatagttaatcaaaaccagtctacccccaacagataaatgttttcctttccaactactaagttttttctcaattattttctcaatcattttccaatctctattattcagttttctaacatgcattggtataccaagatatttaacagggagagagccaaacttataaccaaagatgttagaatactcatcataatattcttttgcctgaccaaaacaaaataattcactcttatgaaaatttattttcaagtcagacaacttttcaaacacatataaaatcaatttaagattcttcgcttgttgtaagtcatgttccaaaaaaatgatggtatcatctgcatactgtaaaatagataaaccatcatccactaggtgagggactaccccattcaatgaaccagcatttttagccctcttaattaataaagtaagtgtcacgcccagaaattctcaaaccagaatttctaagctgaatgtgcattaaatccctgtccaagaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagtagtaaaacagctgtagtaattaatcaatattaacctatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaattcggcagctggacaaccggacaccccggccgacccaactccatcacgcccaccctcgcccccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcagtgtattttaattacctaacaccattacggtggcaccaaaccaaagctatgctcatagtcaaagtctatgtaataatgtgatccccgtgtgtgtgctagttgaactaagcatggctaagcatttcctaaaccaacatctagtcattttgatacccaagttatcaacggcatatggtaaacaatatatagctgagtattaggacccatcccacatgacattgcaaaaggatgcaacatttaataaaaatgcgggatatttgtaaattgggtacaatatgatcaaacgtattgcatgacttgccttgctctcgcactgacgagacctcagcaacatcttcgagaaaccgcggatcgacgaaacggccgaaatctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcagaagggggggcgggcgccgacaggcgggccccgcttgtcagcggttcaagagagaggaagggggcgccggcacgtgggccccattggcagcggcacaagggagggaggtggcggcggcatgctcggcacggctcaagccggccggccagccatggggcggcggcggcggcacgcgcggtcaccggcggtgaccggcggcgcgggagacggcggcggccggcgcgaaggcggcggcggcggccgaagacgacggcgcacgcgcggagggcggcggtgctcatgggagagagaggaaaggaaggaggagaggggattcctcaccttcgagcacggcggccggcgcgaaggaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggcgggttggcgcggcggcgaccctagcggcagtggcacgcggccgaaggcgacggcaagcggcggcgctagcaacaagcggcgcaagcgcgataggaggcacgggagagcgcggcgaatgagggaaaacgaaagagggggctcgggagagtgcttttatgggcgagggaggggaggacgtggccgggaaccctcccgatttggccggcgacgtggggaggagagagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggagtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaaagaaaaaggattttcctgggatttatatattgcacatgctcatttttaattggttaaaattatttccaaggctctgaaaattccactaaaaatcctgttagcatattttgacatgtagaatccaagaaaaattccacatgccgattccgattattatttgcatttattaattaaggaattcagctctaggttaattaagataatttcttcgggcaatttatttaaccaatttttaaagcaagcaaaagggggaaaacttcagggcgtgacagtaagcatatctgctactatattaaaaagaattggagataaaggatctccttgccttagacctttgtaagtttgaaaattattaccggtctgatcatttactctaataccaacatgtcccccttgaataaaagaagttatccactcacatcatttaggagagaaacctttcattctgagcgtctgttgtacaaaagaccatttaaccttgtcataggctttttcaaaatcgatcttaaaaatcacacttttatttttgcgatgtaattcatgcatagtttcatgcaaaataacaacaccttccataatatttctcccaggtataaaagcagtttgagtagggctaatcaccttttgagcaacactcattattctattcgtagcaactttggtaaagatcttaaaactaacattaagtaagcagataggcctatattgttgaattttcatggcctcagcacacttaggcaaaagaataatagtaccaaagttaagggagaataaaggcaaagtaccattatgaaaatctctgaaaagatccaacatatcatccttaatgacatcccaaaagacctgataaaactcagcaggaaatccattaggagccggagctttattatgttccatttagaaaatagcctctttaatttccttttcagtgaattcttgtattaaaacttcattctctaattgagatacttgtgggatgtccacaaatttattttcatcaaactggagatcagaatcatcaggaggaccaaagaggcctttataataagtggtaatatgcgattttagatttgcatcaccatttatcaattgatccccatcttgaagttgaaaaattctggtttttgtatgtttgccgttagcaaccaaataaaaatactttgtatttgaatcaccctccaaaatatccttagttttagccctttgataccacttaatttcttcttctctcgtaggagtagataatctattcctacaaaaccatctaaaatcaatttcctcctgagttagaagaacagatttagactttttatccaacaaatccaacctatccaaaatctccctttttttttcttttttatacataccacgtgtatgtttagcccatcctctcaaaatgctgtcttaattggcgaatcttcgcctgccatcgctccatatgagtattaccctcatgtacactagaccagacctcctttaccatatctacaaagccatcacggaggggttaatgaatctggactacctttatctgcatgatcacaccattgtataacgtgtacacgtgtgagcgagcttagccgcatgcacgtcatatacgtacgtgcaaagctactctgtgtgtatatgtgtgtgtgtgtgtgtgtgtgtgtgtatatatatatatatatatatatatatatatatatatatatatatatatatatatatatatatatatatctcgagatcgatcgatgtgatcagcattctaaaattattgttgcctagcaagctatatatagctaggaatgaaggctatgcctatccatgtgcaagcggatcgatcggaattcttacgtcaaaagttgcaagccgataattaaaacgggcagcagctacaaataccgaacgatatacacacacgtacgtacacgtatacagatcgacgaaacgtgtacgtacatatagtatctagctatacttgccaaagcttgcttgtttccactagtgacgaagcccaaattttcttgaggccagacaaatcctaatacggctatcattttttctaaaaaaaaataaatcaatcaatcaaaatgtacgatatatatgatgcgtgattgtgattggatcctccactgttttccaccgtcgtcatcatcgatcgtcgtatcatcctagctagcttaactaattgttcttgcaatatagtagtagtagtactatttactaacccattccaaaattaatataaacattcatacgtgttttctaaaatgaatctggaacggagtgatgtactgtttatactatgctgaatttctgatcagcatgcagctgcttgctccatctcacgattctgctgatctgctcagtttctaacctttcacatgggcgttttgtccctagcgagccggccatttcataatcccggaagtgacaaaactattcatgggcaggatagctgggtaggtagtgtaggtcgcgtgaaatctggagatggattctcggattctcctgtctctgttttttccagtttccaaaacagagcagccggcacggtgcccccaagttttctacaagtggcggtgaaccggttctaaaagagagagagagagagaacaaacatacgcagaattttagaaaattatctaactaattcaggtactatacgtacgggattgggatcatatgcagtggctatagccactgcaacttaagcagtcctaagtacaccattggattataaatcaacgtcctagatctttccttgatactgttcatacatgactgtagcaggtactgtagcaattactgtttaaaacaactgtagcatttgtttcggccgttgattgctttgatccaatgatgaaaaatggttccaactgctaaacttgcagtctcttctatccgatgtagtcatagaagagactgcaagtttatagaacaaaagatgagaaattttgccagaaaaatactgggttataaatatggggaaagtaactatattctttttcagttcgtcgttgcttcctatccttagataatgttctttgtgtgttaagcatcaagcatgaaactgttggtatggatttgatggtccgaggtgccgccactaaaccgcactcaccttatccaaatccggaccggtccttgtcaccgacccatatatatgtgcccattaattctcttctcactaattgctcgagtacacgcatactgtacgtatccccacatcctccacccagtgcaaccttgcgcgtgttgacacgatggttcttttcctgtacataccacccctgtacagtacacagacgcacattgaaacagaaacgcggtttcgcgaacagcgtatatatatacgttatacgtatgtatatatatgcactactggtcatatatgtgcggcagtgcgcccgattgcaacacgcgcacagtcggtgcaagccaacaaacacggagagctagcaacgagacctcgtttcactgtccgtatattgatctcgctgtctaaaatctcgtcgtatatatgcatgtacatgtctcccagctagcacggtgacacggtctactgtgtgtcgaagcgttgttgaccaaacacgtattcttctactagtaacagctaactgatcgtgctcagggcttgttcggtacgattctaacttctaaatttaacttcagtagttaggttttgagtggaactgtaaaacaatctaaaaccaactcaacatgtttagtttattttatagaaacattttagccaacctcgttccttttctgggtggagatttcgtaagaatattttagctaacttcactcttttttttaagctgaagccgttaattagttggattctggctctagaagagagataaaactaaaactagaaccgtgtcaaatatgcccatattattggattgaactgtcgatgcaatcactctggcgatggatgggagatgtatcgatcgatcgtcggcgctacgtttgcagctgtggatgagtggaaatttcgtttgcgacgtcgacgacgcgagaaacttacctgggttggtcgttgggctggccggcgcctccggccggaagcttcagaatatgcaggtgtcgggcagcgtttggctcgccggccggcgatcgaggcgaggccaggctgccaggaagtcagggcctcagaggggacattacgactgtacgagggcgacgaaattatcagtgagattaaggatctaattaagcattggataaaaagattgatcaggattaattacttacgtaacatcaattggtatgtaccctttttccatggtcaatgtgcaggatatatctttgcatgcatgtgaagcagatagagaaggataacattaacatacatgaacggcacctggcattaatttagctttgacctgcagcacgaatatatccatgacagatgtgtatatatggcgtccgttgcagggacgaccctgactccatgtgttgctatccttctttttatcttgtctccaccgtcgcctctctcctatggccttcagctacgtgcagtgtgcaccgatgatcccgttgcatcaaatgcgtgagtactagtgaggttaggcccgttcttttctccaacaagagttggatgaatcagattttcgtgtcacgtttttcaaattgctaaacggtgtatttcatacgaaaactttctatatgaaagttgctctaaaatatcatatttttttcaaatttgtaataattaaaactcaattaatcatacgttaataccacctcgttttgtgtaaaaaacttaattttcatcttcattttcaggagaaaagaacaccacctaattcatacgtaagatagatcttctcggcatcactgataattaatctgactctctactcatattgaccttgcagttttgctctattcacttaactaactgattctcgtgtcctatccacacaaaaataagagattgttcatattaatgttatttcaaactatactttttttaagttgttaaagatgtgcatacatttaaatttttttaccagactttggtaaatatataaggaatcctaccaaaacttggtagtattgctaacttatcaaattttttgcggtgctgaaatttggtaatgtttttttttctgaaatttggtaatgtttattttgactgtgatttgaatagcccctgaatcttagtatatcttaatctgcatcgtgatacatccaacaatctattagttgcactttaatctcgatcaccttcacatggttagttgaatttgtcccccatggccggttgctgatactcgtactactggacgcacacatgcatggcagaagtgacaaggtgcagatgagtatagtaggtaaggccgcgtgaaatcgggagatcgatagattctcgcgtgtgtggtggcgcacactgcacagcgcatacagctgcacgctcctcgaaattttctacaaatggcggtgaacaaggataccaacctgcaccaacagcgtgtctacacgtcgcctccaaaaaaggccctcctgccaagtgccaaccggccgacgtacttgctcctagccgggcggcaggatctgatctgccgccccctctcgcagcaatttttagaggccgtacgatcgagctgggtgtacggcttttggctagtgaatttcaggggatttttttaatcatgtaaccgcatatgcacataatcaccacacacacgtacaccacattatattcttgcatatgcgagtatgcctcgtaatacttcgtacatacttaaataaagaaacagaaatcaataaatccctacctcactaaaatcataataaaaatacacaaattttatcacacggaagacacacattcaaacatatcactagacacacatgtcataccctctaatacatacatgctcagatatttatatggttgatggacgattgatgctcgtaacaacgtacatatacatgctccggtcatttatgccacctatttaatcaactactgattttgaatctgagcatagtctatatgtagatttaaaagcaaaagttgatcattttagaccagatggccggatcagtacatactgctagtacttgaacctttgaacctctcctttggtacaccaccgaggttgcgacaagtaggcaagctagagcctatagctaagccaataatattcgtcgagaggacatgaagagttggaagtatacttacaaaagttcggtctggttgaaaaaaataaaagttaggctcatttgcgaggcggagcgcgcgcgctcgctcggccgaaacggtcttgtactctggatctccaaatcgttcgtgcggccgtgttgcaccacatgcacgcccacgccttgggagacacgggagtttgcgtacgggaaggaaacgtctcgcgaagcaacgcgtggtggtggcgcgccatgatatgccgcggcgacgtttcgccggctcgcgaggccgccgtacgacgtcgcagccgcgcgcctcgcgggctcggggttggcagctttggatgaaccgtcgctgtcaccgggatccgccgggtccaacatgtacacgggccggccgctggctaggtagcagctaagattagcttaccctgattagaaactactctctttgttccataatataatgtatttaaattttttacttgtactgtttaaccactcgtcttatttaaaaaaaattgtgtagatataaaaaaacaaaaaagttatgcttaagatactttttgataataaagtaagttacaaataaaataaataataatttcaaattttttgaataagacgaatggttgaacagtgcaaacaaaaagtaaaaatcatttatattatgggacggagaaagtaatatattatatattttatatatacatctgggacagagtcgtctcgtggatagatagctcgttaacgagggattaacacactatgttcaattaagctacagtaaaaaaatacttatgtactgaggttgtgtactgagtactgactgccttgataaaagaagggatggttacaggcaacgtcgtatgcagggagtagttgtttaccatatttcggggacagttcgtcgatcaccggctgagatgtttgcctaagacggagacacgattgcgcgacgtaggtagaacgtgaccgatcgggccacgtagtgcgtcgtacatggacacgcgcgcacggtggaaattaacaattacggagtactccggtagtacgtaggagcactacacaccctcgtatgaaaatcaccgcgcgcgcgtgccgtccaccgcacgtcagtcaaaacgctcaacacctgtgctgctacgtgcacccgtcgtcgaatcgcccatattaacctcgatcgagatatgcagtgatccgtcgcccatcgccacctacttaaccgatatccaataaccaccaagctaggaattaattatgagtcatgtaactaatgatgccgagattagtggtagtggccggcaatatgcatccatgaaaccgcttttgtttgtgtggtgtgcaactgtgcatgtatagaagctactagagagacgtgcagttgcgtgctataatgctgcctactacactacgaattagtgtgtgctcacgatcgatctccctagctatatgacgaccagggaccatgcgactgcgagcacacgaacatttgctacgcgtgttgtgtggttgccgatgaacaggcaggcaggccaaagctacaggctactgaaaaacacagagactaatcagatatccctcacctaattcttgaccggccagggcacacgaccagttcaacaaaactgccgtgtaattaggccaaagcgcagtgtgcacaccagcagatatataatactactatcggcagcacatagtactacaagtcgatttgccgtatgccgtcgccggagccgcattacgtgtggcggcgtgtgtcgacgtgcggccgtaccagctgcgggacgtggtcgtgtacacgtgcacgctgcaccctgcaggcctgcaccctgctgtgcgtgcccttcacatgcatgctcgtctctcggtctcgttcccgtacacgtcgcgatgtgaaagagagggggaaaaatgcgtatcgatacgtgaccgtgttgccgtttcttctttcttttttttttccgtgtgtgtcgtttcgttcttgtttgttcgggtcgcggcgcgggagacgagctaacccaacggtgatgatgtcagctgacgtggcgccccggagcggtccagctcagcaccagacaaaagccggagcggcggcgtcccgaggccggcctacgtggcaggaggacgtgggggcccaccgtcgccgcgcggttcgcatccaacggttctttttttgaccgtttgagctttgcgacgccgcatgatgccccccccctcctctcccatcatttctcacacacacatgtaaaactcccccacgtggcccgtactcccccacagccttccaatcctggccgtccgatcatctcacgtggcatctcgaagcggccgcattacatttttacaattttttagtgcattagcccctgctaattaggggattaagtcggggggcgcggtgattacgacgtgtgtgtgacgtccacatgtcgccaccaccggccaaacaccgcgcggtcactcacacggaccgcaccgcaccgcacaggctggctctatctagaccgttccggtgcggaagaagaaagcggtgcacgctaagccacacggatctcccaccgtccaagcgcccggatccgacggctcacgcgtctccccgagcgagccgtgcccgctataagttggccgctgcgctgcaccccacctcgtgactcgcacgcatatcgctttgctctgcttcgccttcgcttccgcttccgattgccgtttccgctttcgccgcgcgaagacgtaaagaaggaggcggcggcgacggcggtggtggggttgagggatggggtacgcgcggacggtgaaggcggcgacggcggcggcggcggcggtgctggtggcgttcggggtgaggatggcggcgccggctgcggcggggttcgtggcggacgagctgccgcgggcgcaggcggcggcggccacgtggctgacgccgccgtacctgtacctcgtcatcaacgccatcatcctgtccatcgcggcgtcgtcgcggttccagcctaaccgcccgcaggccgcctccgccgacgcgtcgttggtgcggccggctccggttccggttccagtcccggtggtggcggtgcccgcgccggcggtgacgatgccgatggaggtgcccgttgtgccggtgccggaggcgatggctcccgagcccattcccgtggaggtgacggtgccggaggtggtgaagacggcgccggaggcggaggaagcggaggagaacttcacgatctcgaggtcggcatggacgccacggcggaggagcaccgccgaggcggaggcagagcatgaggcgttgtcccccttcgcggacctgacgaactcgagggagaagccactggtgtccactcgattcggccggaagccggtcaaggcgagcccagaaggtaaacaacaaatcaggaattctcctctaatcccgtctcggttctttcgccaattcgccattgattgagctcgcgggattgggttttgcagggagcagcagggcgctgggggtgtcgcggccgcggaaggagcagacgctggagagcacgtggaaggccatcacggaggggcgggcgccgccgctggcgcggcatctcaagaagtcggacacctgggagacccggcccggccgccgccagtccggcagcggaggtggcgaggacgcgccaccgccggcgacggcgatgcggaaggcggagacgttcaacgaggccgccggaggaggaggaggagggaagaaagtgcggcgggagccgtcgctggggcaggacgagctgaaccggagggtggaggcgttcatcaacaagttcaacatggagatgcggctgcagcggcaggagtcgctcaagcactacaacgaaatgatcagcagaggcagcgtctactgacgatgcagagcagcaatagcagcaagcaagagcttgcttttttgttttgttttgtagttttggccttttttttcttcttttgggctccctttttttttttaatttcttccttcaactatcagttgtgtaagaaatggttttgttcaaggatgatagtgatagtacacaaaagacaagactgttcatattaggggcgacagattagtgaagaaaagaacaacccaatttctattggggtcttgtgtattaaatattaattagcctttgcttactgagattgttcatggcacatgttctgttcttctgtgttcatgtgtagcatatgaacctgtttcttagatgtgctgctataggttacactcgagggtgtgtatgttgtttcgtgtgcgtcttacataaaaggtgaactgccaaggcttcacaaatgcaccaaatattcaatgtatttgtttggttgtttactagtagcttacacaaggtggttgtacatatcacgagaagcgtcggtatcaaaatgttaaccacaactttgacaaaattagttaagaatatgagcttttagcatgtcatatgtggtggtattgataaaaggtacggttagccacaactgtaacaaagaaccgagcgtatgtttagaggcccggtttcattttgattattgacgatttgactataggaataaattttaaaaataaacctaacaaacatctcaaacaaactggtgtaacatgcagagagtaaagtattttgagatctttattcgaagtatgtagtaaacaattttttcaataatccgatgaataagttttaaaaaatagattccaacataaaatgcaataaattgatgtatccaacaaaagccgatgattctgtaagactgcagctaagagaagcaatcctcagtctagagcgtggaggaaagagaggatgagatgatatcatatgaacggaatacaccgacactatacatatcacgtcagaattccgtgatttgagtacgggtaaactttgatggtaaacattatcacgtcagatcacactatagatatgaatgcatgctataatgccaaagggaaaccaccccggtaagcaacatagtaaatcctctccttgcacagggatggatgatccggtacatgaaataaatttgcccagaggtacatgctgccgaagggcgccgctctcacgctacatcactacatacagggtaaagcaacgggccctaggcaaacagcaacgggttctactacaacaccgacgcctggttctatggtatgataacattaaaactggatctctcccgccacaggataaactagatctttggtatagaaaggtaacatctacagagctacactacaaatccgcccgccgcatttctccattggtatagacattatctttttcatcggttatctaccatcgccagtatgacttcccttttgggcaggcagccctaggttgggttgtccctgaggagtctcgtcgcatcggatttcggtgactgctcgtcttcccgctcaggctgactgttcaggtcaatctggttcttgacaggagaggaggtcctcttgttgtcaatggacatgtcttcaggaccttcgccgttggtatctgctctctggtgaggagagctagtactggttggatgagcaccagagccagattgtggaactggctcgctggattgacctggctctcttttgcgaggcaccccagagtccttctctgactgctggcgcttctcgcgccgcatcataagcgtcctgaaacggcgtcgcactgtcatacagacgttgcaagtgcacgtctgtttgtgctttggtccctttccgctgggtggttgtatgcagactatgcatgagcagccagggcgatggcggggatgccttgtggttggctgggaagggagagattcaccttcaccaagaattgcaagatttgcgagtgtgtccagcccatctgaaacatcaatattgtcagtatctaccttccctttggtcttttttgcagcacctgaaatgcaacaacatgaattttaagtaaatgctagaacagtaattatagtagatcatttagtgcagttatagcctaccacacagcaaagaaaatatagtggcattatgcaaacattgactactttcatactggtaccacagatagaaatatgtagccccaaagtaacattggggatgtgttggttcaagatggcattctcaacacagtggatcatggcaagtcgtttttgtagttcggcccattgccaactatatcatgtactaatactatgatgcttcattgtgaatccagccatcagtagtgatagatatcaaccagccttacatgcctcaggctggatcatggcaagtcgtttttgtagttcggcccattgccaatgcttcattgtgaatccagccatcagtagtgatagatatcaaccagccttacatgcctcaggctggatcatggcaagtcgtttttgtagttcggcccattgccaactataacatgtactaatactatgatgcttcattgtgacatccagccatcagtagtgatagatatcaaccagccttacatgcctcaggatgtacttttgtaggctctggcatgtagcacagtagcacatagttctatacagccaattgttcgtagtgaacctctccaatttattatccttttggaattcatatttggcatgctatttaaaaagaactactagcagaaatggagcttctacatcagcatagataaatcactagaacatatacataccaggtttgataggaatcatttcgccaagctcctccatatttatctcttgggcagaatcacaggaagacctagtgataagtagtggtggttattagctacgtgtgtaaagtaaattgagactatcccaccatcctaccaaccacacgtgaacagaaagaaaaaaaaaagctattcttgtgttcaaacatgctaaattccaccgtagatttaagaaacagacagctcaaacttcgtgattgcaatatttataaagaactgatgggtggaaatagggttaatagaattgaaattcggtaacaaaaaagaaccataagcataaccctaagagctatccttgaacttaggatgcaagtggaccaacccgcgaaccctattataggccaaattagtgggtaacccagtgggttcactggtcaacccacttgcagccctaggtgtggcaagctgggccatgacacgggaacctacgggttacccacttatttgacctatatgtgggttcacgggtcagcccacttgcatccctacctagaacatttgtaaatacgtttttctattgtagctaatcataaatacagcatacaaaaggctgaatggttctaaaatagcaggtcacctttcagaatcccatttattgtcagagcaggtccacttagagggcaaaagggcgtccaccggcagtttacgccacttagagcaatcctcacattgagcccattgatgattctcactggtaaaaaatgatgatcatttgtaagcaagtaaaaaagatgctactgtactttccaaaaagtaaactgttgggagtcctacaaatggaagtcaagagaatttatattgtcgtctcatcatgcaccaataggataattctattcagatagaccattaatggtttcaacaattaaaagtttccaaaacattgaaaaaaaacacataaaaaattaaggtagctagataagttaagcattatgagaaaaagtgttgagataaatgttactaaaaagaaagaactggaatggtctgtctgggtccttttccacatatataacaaatgcagatagcaaagctaagagcattaccctgattggtctgtcacaaaatatgtcctcctcccaagtattggtggctcctgaaaattataggacgtcaatatagaagatatgtgtttaatcttctataccaagaacacagtaaagcaagtcacgaatgcaaataagcttaagcatgctccaaactatgtctcagatagtaattgtcccataacattgaacagctgaatagggctcaagtttgcaggcctgtgcccactagccaagatctgaatgctaaaagaaataataaaatgcacagcatacctcatattcctcaaactcatggccatcaacaacaacaattgaaggggccttaggaggaggacgaagtaattcttgagcttcctcccatgttatcttcaattccatggattcctcactgtccatgtggaaccgtttgatcttcggaccaacagaagttgcctttctcttgacaggtagtggggaggaacttgaagttcctggcccttccttttgtggtaatgcacctttgtcaattttacaggcagtggcttgttccacagggctggaacttttgctctctgtgttgactttaattggtcgaggtacagcagcattaggactagaatctgggacaacaactttattatttgcttctggagggggtagtacaccattggcaggctttgtaggttggtcctgtcaaatgaaccaaaggaagacttcaacaaactagttaccagttcgacagatctcatattcgttgcaaatagtttgctagtgtagaaccagcatgatataacacgctaaaaaataagcactctctccaggagtaagtaacaaaacactctaaattgtgtgatacctaacatatgatacacctaaatttggttttaaaaacacatcatttttttgtgttcttgaagcccaacatgtgttgccataattatctcatttcatcagtagataaaaactcctagagtcaagcagatctcaaaatttgagaaataatatagtatgcagcagaagtagaacatctaatagtgagcatgtcagatatggtcgcctagtaagacttctagagacaaatatacaaatagcatgtttgtttcagctggaactaatgagaggtacagtacaacaaatatattgaagaacccaaagtccaaaactttcttacctgttctgcagaaagatttgttgcctttcgaaatcccatgaccagcttcccttctggatctattcggctaaaggttactgaaaaaatatggcaacatgaactaggatgtcaaaaaaatcataagccaattttaaaagaaacaaaaatgtttctcatatggagaaagataagcacaatcatgtgtatactaaaaagaagatataggaatcacacagatagcatttttaagaaatgtagcacaactggaactggaataaaacagcaaatacaataaaatcattagaacataacgcatctaaatggataagacgtgccctaatataaaatgtgcagaaaaatattaatgatttactacatgcatgccaaatctctatgcgttagaaataggtttgcagcataccattaactcacattagcaaacttatatactgagtcttttgtagaagatatatacctgtatcgcctgcttgtaactgcatcgattgaatgcaaggtgtgacaccctccaatacatacatcctgctgttattattgggccaaaagcggaactggaacacccattccttaccagtagcatcctgaacttttaagggaagcccttctgcctgagagatggcagggaagtacgcctattcgaaacttttttttttgttagaagagtatttatgcaataaaataaacaaaattggaggtgatcagcaaagtatgtaaaatgactgcacatccaattataatgtagcatcaactgatttcaacccacttttggttaaaacaactaaaatgaaggcaatagttgctggtaattctaaataacccacatttctatagaagttcccatacatcagattagttttaaatcacaagcttattcacatatatataaccaaatcacgagattatgtcaaatatctgtgcatgactcgggataagttgcaaaacctagtaaaagtaaaaggacagattatataaccatacatcatacatgggttattagtaaacactaatgagggcagatcccatgcatggcaagcctagcataataaacagttcagtaatacaatctaataaaagaaaagacagtttaaaacgataactgaataactcacctcagcacatttctttggcaacaccaaacgaccaatccgtccagcatcactagcacttaacattttctcaaacaaaggggtaataacagaatttgagctgttggagggttaaggaaacacttaagaacaggcaagagtttaaacaaaaaaaaacacgtgaaaaaaatgacagtatttactagtaaatctatattatctagaggaaattgctgatgaagatacatagaattttttggatactctccagataggtgctgtagctcttgatctgttattctaggccaatagcgtggaagcaactgagatctcgcctttgcatccattctaggccttccattgcgcaattgcgcttgaaaatcgttatcaatcacactatgggaatagaattgtttctgcaatgaggaggaagccatttgctgctgctgctgagttggtccaattctgatatggtcttttgggccatttgctgatgaaaaattagaagacaacccagctggtacggctgatggatcatctttcaaaatggacggatggtgtgaatcaagcttgaaggtagtagatacagaggaacaaggatctgaagttactcctttccttgcagtcaaatggtcattttctcctgcatggtgactatggtcatgaagatttggatttgttccttctctgtgatagagagtgtaagcgtacgtcggatccagggtggtgtgctgagtatgcccattggcatacctctccctcataatctggttcatgccagcaggtgttgttgatctgtcatgcatgtcatcaaatttcttctcatgggcatgaataaaagtgcgccctggaagcaatttttcactgccactaggcctatcaaactcaaaagctaggcgctgctgcaagtcagactgcatggtggacatactccacatattattctgccgccactggcttgaaaattgcccggcaggaggtctccagctcttgacaaaattgtcttttctatcagctacattttgagccatatgcatggaagatgaccatatctgacttggtgcctgacaaacatgaggatcaaggtataatgataattaaaaagtacgaactacaaggtataatgataattaaaaagtacgaactacaaggtataatgataagtaaaaagtacgaactactcccaaagaaaacaaacccggttgcaaaagctgttgaattcaaaaaaaaaaaaatccatgcatagaagtagatgagaaacaccctttacatagttcactgaacagcttcaaagtaaatggcaagaaagatatatcaacagaacatcagctacataatacatcagactttccctaattaatgctgccaaccaagatagactgcaatttagttaatgatggatgtttctcagatttccatttcaatgagaaaaaaatagatgccagaaggtgacaataagtggaacacaagtgataaaacgaaccatccagtacttatgaagtttctgccaagcaatgcatgcaattttatcaatcaccaaccaaggatcaaaatacacatgaagggagcacaatactacataagacatctatcccccatattataccgtcaatccaattgttacagccaatattcacgcaacagtagcaacagccaccacaaacataccattgcagcatgcgacttgcgagcacacatgacgcactcgacccctccggcgtcgaggtgaacaaatgcatggaccgacacaatgcacccacagtgcagcctctgcaggataagaacagagatacaagggagggatcagccaggaagcacaaatcacgaacaccaccacaaggctcgaaagattagagaaacgagcatgcatggggcaccgtaccttcccgcaggattcgcagttcctccacccggcaacctccaaatggaaagtctcgcaaaagcccccatgctcgaacgagtgactgaaacagaacacaccatgcatggcatcaggagagctctctcggagtcgcacgcgagtcaaaccaccacgaggaaccccaaaaaaattttacagaaaacccccgcgtattccgcggaaattacaacgacgtggcgatcactccacgtagatccggtgggcgccataggcgaatccgcccgcgcgtggaggaggagaagagccggcctccccgcacgaatcgagcacgcgggggggcgccgccgattgcgcgcgggagggggaagggggagggaggcgattaagggggttacccgtacgtactagcatcggtcgcagagctcggcgaagtcgccgttgcggagtcgccatccgcggcggcgcgggccgtcggatttggggtccttgcagtgcgcgttgaagcagatcctgggccgctgctgcggcggcgcgtgaccgggggggccctgctgctgctgctgatgctgcggcgtcggcggcggcggcccaaccccaaccgagacgaccgcctgaggcggctgctgcggatgcggcggcggtttcggctggagcgggggcggctgcaccgagatgggggccgccgccgcgagggatgggggcggggcggccaccggcggccgcgtcgggggcggctgcgccggcgacgacatgggcctcgaaaccctaaggccggccgcgacgagtccccccggggcgcgcggcgccgcgcggcgagagaggagaggagggggggttttggggtgtgtgggaatcgtgggggacggacggaataagacgagagagccagaggggaagcgagacggaggaggaggcttttaaagcgagacccagaagaaaagaaaaaaaaattgccgttgttgttgtagtagtactactactattactactcaaaccagcgcctcctcctgctacgtgtacacgacaccccccccccccccaacacactctactactctctcacccaattttattattattcgtaatctcgctcataactactcatttttatatactaatctctcatcgttgtactgtgattgtctacgtgatggacgaataatcatattcttttttttctgtccaacttggaacgagagagagattaattagagatcaatcgatggatgtgtttaattagggtcgatctaaatctaatctaacactaaccattcttttatatcggcgtggagtcaaccgccgcatgcctggctccatgctctctctgcatgcacgttgcgagttccgaattcccgatcgattcccctctctcggccctcacctcccaccctgcatgcatggccgccatacacaaaaattcgatcaatccaaaaccaaaccagaccgcgacactgatcaccaccatgcatgcatgcatgcatctgaacatcttgatcggtgagcagctgcactgcaccgcacagcacacacgacatgtcctgtgcgttcgtccatcgtccctagccgccacggtcactgacagaatcattatggcgcgtacgtaacgttgtactatactacgtgtggtcactcgtcaccgccggccggtgcatgcacgcgtcggtgcgcggcgcggccggcggatggctcgccgccgacgaggggagggaggtgggtgtgtgggtgtttgagaacggtccaaaaccatccgaatcgatatccttttcagaaacgatactcgatcgatcgataattaataatgtttatcatttcaactatacgctatcaacgtcaatgcgatgtataaataaattagaaaaacaaaatttatatataactaaaaacaataattataaaaaacgatacactttatacgaaaacgattctcggggaatttccgtgaacgttttatagggtgcggtgcatgcatgcgaaatgcatgcggagagtgggggcgcgcggtacggtcacgcggcgcagggggggcggtgggtgggtgcgcgccgcgcgcgggcggtaagcctaccggcgagagccgcagccccatgcacgtagcacgccacgccaccgcaccagcacaacagcagcaggtcatcggttttccccatcacgaaaggggccgggagagagaaaaaaaatatcgtatgctactactactacaactactgctacaattatactactgctggtatgtactactgatataaccataatatactactccctcgtatcgataatatttatcgttttagataagaataagtttaaactttaaaatctttattataaattattttaaaaatattaatctttcaaatatagtgactatatatatagattagttttaaaaagtactttaacaaaacatattaaatcttatgtttgttaacactgttatatatattataatagaaaataatatttaaagttatttttagagaccgtatttttatccaaaataacaaatattatcaagccaaaagttgcgtacaactacaacagcaagaaaaacaaagcgttctagctgtactcgttacgtactaatagtacgtactactactacctgcgtaaaaacagcttggaacacgccgtgccgtggtgggccccgccccctcctctcatccctggctcctccgtcgtacaagaaaaaaaaaagaaaaaatatacgccccataaaacattaattagtaccgaatataatgtttaagagcaagtttaatagtataacccaccactaactccaaactatctatagctaatataatagcccatacatacaatagttgcttactatactattaatatctggtcccatctgtcatacacacattacatcttggagttcgtgctgcagctggctacagatctatagcccgctgctcttctcttttttcctttatctttttaaaatatgtttatagttggcttatagcctgctattatacctgctctaatagtactacaaatctaattacaaacttatatctagatctgtcagatgtaatgtattccaataaatctggttaaaacttttccggaaacaatgttgtatactactccctccatttcaaattgatctacatattttataggtacaccaagaccaagaaaagctaataactctctcatactatatttactatatcaacaaactcaatacatgcaccatccccaatatttcctagccaatagcaaattaagatattgcatgtgggttataaatacttgtgtgcatggatgcatgcatcaatgtctattttactccaatagacaaataacgaatagacttaataaatgaacacaaatatgtatatcatttaggaataacctcaaaaagcctatatgtagatcaatttggaatggaggcagtatatcatatcgagtattatgttggtttttatagaatggaagggcgtattccgaaccaacagtatagtagtagtactagagaaacatattatttaggacccctttgaatcaaaggatttatataagaattttagggcccctttgatttgtaggaattttggaggatttcaattctatggaaaaaatcctataaaggcctttgaaacaaaggattgaatcatatcaaatcctttaaaattcctatgtaatgggtaatcctatgcacattttggaggaaagttagcaagaggtctaacctcttgaaacatttcctctgagtctatctctcttatccgatttctgtgtttttcctgtggtccaatcaaacagtcattcctctgttttttctgtgttttgcaatcctatgttttacaattgtattcctgtcagaatcctatgtttttcctattcctctgttttttcattcctacgattcaaatgggcccttataggattcaaatcctatagaaaaatttcctatttgaccatttgattcaaaggattgaagctttccaaatcctatgaaattcctatggaatgacacattgcatgtggattttggaggaaatttagcaagagctccaacctcttgaaaaatttcctttgagtctatctctctcatttgattcctgtgtttttcctgcgctccaatcaaacgacaattcctgtatttttcatgtattttgcaattctctgttttacgcttcaattcctgtcagaattctgtatttttcctgttcctccgttttttctacctgcgattcaaagggcccttactgatgttattttagtgttagagatgtacgggagcgtatcctatgcacacaggccctcgcgtatacacaccgtgtacactaactaaaaattatcacaaaaaattctagaaaaattcatacatgtactttcaatagtattacatctacgtgcaaagtcgcatcttcaaattcattctacatagagaataacaaaaaagataaaattctgacaaaattgcaaccttaaaactgtcagattttttgtttttttgttacggctaaaatataatgaatttgacgttaagattttaaccctaggtgtaatacaattgaaagtatgtgtatgattttttctaaattttttggtgatattttttagttggtgtgcacgtgtgtacacgtgagggcctgtctgcataggatatatgttgccgagatgtactccataaatcactgtatcaccaactagctgcatgcaggtagcgctgatgcgtttttttaattactgtcatgcatccgtgtagtgcagatcagagccattacagagctagagaggatggacggacgtactatgcgtgggtacgttgtattgcgtcttaatttatgccgtcctgatcgcgagaacagtggtgtgattagacgctaaatagtctccgcgcacacacaccacgcctcaggataaacaccggatcgagtagacgataaggcgaggagaccgcgcgcgcttgcgtcccttccttttcccttcgtgtgtcccgcacgttggttttttccctcttcgtgtggatttttctcgttggaaggatatatgcaatgcatgcttatgctgagagcagacacaataacaagctataagctagctataaatatattttaaagagagaaaagcagcgggctacagatctatagccagctgcagcacggactccaagacgtactatatgtatgacaggtagtaccatgtattaatagtatagtaagcaactattgtatgaattggctattacattggttatagatgatttggagctagtatttagctatactattgaacttgctcttatgggctctgcgaaggcacaaattaaggtaattaaacttgtagcactaataaatgtgatatgaatcgtctcacaatgtgaatatttaagacatcgttgtcgacgtttgatgtcgcgattccggtatttgcatagtatggggatcgttggtactaggatatacgcaagactgagataaaagagacagatacagagatttttatataggttcgggcctctgaattgttaggtaataaccctacatcctgttggccgaagccggtattgctcttattcaccataatcacaccattacaatatttggggtagcctatctaactgttgtcgacatggcggtctgaaggtctgactcgtagtcgacaacagggtagtcttcctcctcgaatccgtacccggcgagatcaaagacagcgctagatccctatggccggcctctgtaggtaccggatagggtcgatccaggcgtatctctaatgtcgatatccggcgtcttgtcttggcgtatgttggcttgtattggcttgtggcgtctatgttaattgtggtgggtgttgattctgtcccctctattcctagggagccttgtatttatacccataggtgttcccttgtccaagtagaactaaggaaaccaatatggatacaatccgagtagtctttgtcgtttccatatagaactctggttgtctttccttatccggaactcctcctatatccacaggttgtttccgtataagacatggtatgtggtgggtcctgccgagatttagtcaagtatgtggtatccataatcctgacaatcgtaaatagtcctaaattaagtttgatttttttatatatgattgataaaatattttatttcatactatcgaaaagtgtgcaccgagcttctggtaacgcgcatgcgtcacaatagctagatgtttccatccataagagagaggataatgatcttacacacaccgttcttttgcataggcgccagctatattcatagcatacatgatgtccacgtgagatgaagggatggagggatggtccacatggcattcacgcttgatgcataccctgagagggatcgtggacgcgcattccacatgtcaagacgcatgcaccataagcggcgcaccccacatggaatgaaggttagccccacagtcctacacgtcactttgttctaggaagacacatgcatcgtaagcggtgagtctacatggaagggaggttggcacgatagtcccacgcgtcatatgtgccacgagacatgcaccgtaggtggccaccccgtccacctaggaggttaggagggaggtttgcctcacgtgtcatcttgccttgtagcacacaaaaagaactaaatatcaatttagtaatagaagcgattataaaacgaaagaagctacgatgccagctatatatctcatatatgtcagcttcctttgcacgcaaatatagatggaataacgcaaatttatttttttcttagatctatctatatgtgcctatgcatgcacaagggcaaacatacactacaacaaaaatgctttgcagagatatttttctagtactatagaggcatttttcaaatgcgaggcattttaaaaaatgtctaataagtgtcttatagtgaattgtctctacaaacgaagagacattttataaaatgtctataagatggtagaggcattttctatagacatactacaacttataaaaccaatgcctttacaatattgtagaggcattttaaaaaatgtctaaaaagtgtcttatggtgaattgtctctacaaacgaagatacattttgtaaactgtctataagatggtagaggcatttttttatagacatacctgtatgtttgtgcctttagttacttatatttagtcctttagtacacattatcattctaaaaagtgtctctacatagtttaaaatatctcaagaaaatgtctttacatatcagactcattttacaatgccgaaagaatgtctcaacaagataaaatctaataaactgagttgaaaatatctctagagtaaaagttttctaggcaatttttaaaggaaaaagtacgaattacccggtcaacatcctcgttgtcctcctcatcccccgccgccgccttcgctgacccgtgagagagaggggaagagtgagagagagaggaggacatgtgggtcctatatatattttttataaatagaataatgactggactgccacgcgtacgccacgtagaccaaaaccacagcggattgggtcaaggggggttattcgtccggtttatatagttgggggtgaagaatgtccggttttatggttaggggggtaattcggacgaccgcgatagttcgggagtgtaattcgtgcttttttcatttttaaagtgcctctataaagtgtatttacactataaaactactcatcttagaaacaatttacaaaacatctctacgaaagttcctctgtatgagtttttttttgttgtagtgatatggacaacttatttgggtcatggtccgagggtttgggctaaaagacgacctacaggcttggacaatttttcaccatcataggcctagcatagatctatatataataggctataccgtcttgtgccttagcctcgttggttcatgcacgtagcaatgttgggttgcccttccgttcttttatgagctgcttatgttcatacatggtttatttcgatgaagatatggttagattgttttccttgcgaatcaatggctctaaaaagagagtagagatgcatgatattaaatggcaatatggtctttttttttattttcctcttgcgtggtctctttaatttgtatgtcttgtacatgaatcgaatttcgaattgcccctaattttagactgttcggccgtcaacttaattatctctccatcatttttcgcatacacgttttaaaactattaaacgttatgttttttctaaatttttctatagaaaagttgttttaaaaaatcatattaactattatttaaaataatactaatacttaattaatcacacgtgtcatatgtgtgtgggatgagttcatgatgcctcgtagagacggtagcctctggctcaacaatattattacctatatatagtcctaatgtcctacgtacttatttatagatagcaactacacatctctatttcgtaatcatatatccagtgggctcacatacgtgcaattttacaaatgcacgcaaagggcccgtccaatgacacagacgctggctggacgccatttgctcttttgctacgacgtactactccaatataatcccatagtataggttagttggtgcatgcatgcacatgcatgcatgtttttattgcatgccttgttctgaattaattaatttattaattagtagttgttgtagtagtataatagtatttttcttcatgcctgtatcaatgatcgtggctaactagtacccctccgtcccataatataagtgattttaacatttttgcttgtactatttgatcactcgtcttgttaaaaaaattgtgcaaatataaaaaacgaaaaattgtgcttaaattactttcaataataaagtaagtacaaataaaataaataataattctattttttaataagacgaatggtcaaatatgataagcaaaatgtcaaaatctcttccattataggacggaggagggagtaatagtaaagcacacgtaagtaattaggtgcccctatactttaatggtacaaatttgtttactaaacgtaagttctgtactaactgttcccataattaacccaagtagtataaaaaatgagtgaaatgtactttttgtttatgttttattattaaagtttcactttgtatcatcctatatccaacgttttctctttgaactaggtaactttacttttacttttgttgcataatagatcaccctaactctattcgttttcttttttgctggcctatctctatccgctttaacgtctcattcgatgaaggtatagcatgaatatatagatatgaaagtttgtcggtatgtcgttagttaacaatttgctactacctccgtcccaaaaaaattgcatttctagctctaaggctttgtcccataaaaattgtatttctatccatgtggggccagcaaattgattcattataagtttccttaagttctctcagcttgtaatttaagtatgctaattatatgggttaattctctcaaacttccttttaatcatttgtatatatggaatatgtgcatgcaatgggttcattaaataaggtcattgtggtcattttctaatcctaccattttgtcctaaattagctagaaatgtaatttttatgggacagagggagtaaaagtcattgaaatgctaaagagatgtggtttggggtgattcattgtgcaataaaaataaaattacctagactaaagtgaaaagattagataaagagtggtccaaagttttactttggaaataaaacatggtgcaaagtgaaattaactctaaaaaaaatcacactagcgagcacatatgtacgagtacaagttaacgtaaattaatcgaaccggttacgatgttacaatcaactgtatacagataaataaaaagtcatgtaaatcatacggaattacggattatataattaagctcgatgaaaacgcaagttaatcaacaataatttagtggagctcgtgtaaccgcgatcgatcatgctcacctcagctgatcgatgtacgtctacggagttgtttatttttatattagccctttcttagccagtttcgtttttttaattaattgtccccatcagccacgccaaaaggaatcacgaaactaaaataaactgaattattagtgcaaatacaaaatgggagtgatgatggattaataaggagacggccgggtgtgcgcgccaaataattcgtgcgtgcatggcccgcagcgtggcgaggaggggggaaaaacaaatgaatgcatgcgtgtgcgttacagcgcgcggattttcagtggcagcttatccgtgttgccgatttgccgtcactgatgagcatttgcggctttgccgtccatttgtttttgtactgcctgcttgaactgctgaagtttaggggttgtctggttagttggtcgaagattggtaagcacaaaagattaggtatgccataattttttaagtgtcacggagtatgtttggctcacatttcatatttttaattttttaagttaaatttcgtcaatatgagacacaacgtactgtctacagcacttacgataaaataaatatgtggcgaagttagctccatccaaataaccccttactgtttcgctattaattcttccgttttctctttgtgagaagccaggaaatagtttatttctttataggtgtgtagtacatttgagtttatttctttataggtgtacatttgtttgttgaaaactttaagtactttatgggagaaaatatgttcgatgaaaattaatacaagagcataatcgaaagcaaatcacttattcaaataataaaccgtctgtgtgtttagtttttagaagatcataaatttttaaagcaaaagaaaaatcaaaatatgacccacttaattgaaattatgtaatgggtttgatgaaactaattatgtgttttagacgctgttataattttttcataaattcaatcaaacttaaaggagttggacttaattagaaaagacttaaaataacctactccctccatactcataaaaaaaagtcgtttaggacaatgttaagtcaaactttagaaatataaatcatgaataactctcaagttgttgagtttgaaaatataaaaattatatgaatatatttgtcttgaaaaatactttcataaaagtatacatatatcacttttcaataaatatttttatagaaaaaaagtcaaagttgtgttttggagaccgtgtcgctgtcctaaacgattttctttacgagtacggagggagtatgttgagattgatcaggagagattgctacgggtgtgcagccacaacagcaacaaacccaacacaatttctactatttgtagtgtagatgtatcatatgcgcgtgaccgtagaatgaagggagtaataacgtccttcgaagcgaagagacataattaaatatgcgtcgtctaatattactactgcattaatatgatcgatttcattcatgttgtccaacaacgctcaacgttttcaccccctcaaatcgagttccattcgtacttaaagaatatttgatgatgaatcaagtcataataaaattaataataattatataaattttttaaataagacgaatggtcaaacgttaaatgaaaagtcaatgacattatacattaaatatataccggcgcgtgcatgcttgcacgggatcgccgatcgatcgatcgatcgcccgcagtaccgtcgtcgcaggcaggacgacgtacgcatgcaggggtcccatgcagatgcagctagccactggtgtgagtggtgtatctactctccctcacccccggcggtttctctctcgaatacaatcatttttagattatactatttgttagtaattattgtatcgtagtttgtaaaaataaagaatatatattaaggatagataatgcatgggaaataaataattgtattagaatttaataaattgaggtattataatcttttcagttttgtggaaccgtgtgaaataaatgaaaaatggacttaagttgagcaaaaggtactaccccgttttaaaatatagatctaagacgggataaaacatatcctatcataataaatctggatggatatatattcagatttatcataataagatttatccaatttaaatttgtcgctatattttgagatgcagtaagtactctctttgtctcaaaaagagcaactcctaggtatgtatttgaatataacatatgtctagctacatagttaggatcgtttttttttaagaccgagggagtacatggattgtgaatcttgcattcagacgagagaggacgctggcatggatggatgcatgcatgcagctagctagacagacgactccacaagtcctcatgcatcgtgcatgcatgcatggcacgccctttaaaaacgagcttggcatgcatgcatctgcatgtgccatgtgaatcgtgatcacttctctatctctctctctcgtacagcaacctagctagcgtagtgtgtgtgtgtgtgtgtggtggggtctcgcttgatccaggcacgcttttgtgtgtacacggaaaactgctctttaatcggtttcgtacgagctgagcaggtgatgtttgaattttttttatttataattttttttattaaaagttttacaaaaataattttccattttgaaaattgacggaaatagtcgcctaccgccctctgggagggc

SEQ ID NO: 42974 - DNA, 12758 bp, Oryza sativa
  unsure (1)..(12758): unsure at all n locations
agggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgatttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtggaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattcggtgatgtttggtgcgcatatgctctgtttttattactaccagacgattccaaacttcctgtgtagaagtagtaggagtactttatttgagccctgcctttttatgattgtaaaccatgaatttcttcaaaatcttagtataaggttttcgcatagatcggttcaatttacaaatggttattgtgtgtgttggaaagaggaatccggtgttctaaagataatattatgggattcgagaatgtttaaatctcaacactattcagtcgaagctcgacgaatttcacatctccaaaaaaaataaaatcagttcaataaacgattttataggtcggataaaaccatcttcaattcctacgagccttaaaactggtgagcacgaagtactatatagagacttgtacgatttcattggatcgataattcctacttcttccgtccccgaaaaaaacgaatctagtactgaatggatatattctaggacaatgaatctggacataggtatatccagattcatagtactagtactagtatgtgtcacatctagtattatgttggttttttatgagacggaggggatagtttcctaccacgtgaaatatgacattgtttgagtctgatgaagataaatattaaattagcgcacgtaaaatgagagtcattggtatataattaattaacttatagttattacaaacttatcaaatgaacatactcaatttgatattttaaaacaacctctacgtagaaaagttttcgtaccaaacgtaacgtttaatagtttgtaaaaggtgataacgaaaactaagataaaagggtgtttgaaactttctatatatatatctatccctcaccaaattctagggtcgcaatgaacagttgttgtactgcatccgtcactcactctcactcacaccaacatccccaaatcgcaatcgatggctgcaagataaccaccctttttttttcgatcggtaccacgcaacgcatgcaacgcatcgaccggttgcttgcggccggcgactccccttccctcccaaaagattctccccatctcggggtacaataatgccgcgtgcacgccggccggcgccaccgcatcagcagcagcaagctagcgggcgtcaaaacaccaggacccgtttttcttctctttttaatttttcactcttcctctttatgaccacatgcccctctgcgtggtgccaatcggcatcacgaggcagatgatctgcagctagctgaaaaaaaaattgaccaatgttgggttgtcattttttactactgctaaagctgttttgttactcccttcattttatattataagtcgtttgatttgtttttcttagttaaatttttttaagtttgatcaagtttatcatatagtagtattttcaacacaaaataaacataatataaaatatatttaatgtcagatttaatgcaattcgatattttggatgttgctaaatttttctataaacttgatcaaacttaataaagtgtgtaaaaaaatcaaacgacttataatatgaaatggagggaatagtatccacatgctgtatgcaatgacgcgcagctgctgcaaaaatcacagttgaacaagaccattcgcatttcacgtaggaaggttggagcctctgaaatgagatgcaagcagaacagcccagcccgtaaacacacctgtagtaggatattggtggttcgcaggttggcctctacttgtctttgcaaactgcagtttcagttgtattgataagtatagtagcagctgtaggcttgtaagcatagtagcagcattgatcaggaatcttgtggtatacaaatctctgtcacacttttgagtaaagcagctatcactgatcagtgccaaaaagagagagaggaagatctcgccggacattgcgcttttgggtggctctccttgtatttgtggtgtgtgagtaattacaggtgtaatgtaagtatgtagcatatgctgtgaaagaagcgaagaattcagggcaggatcaaggatcatcatcatctaggggagaaaatggtggccaagccctgatccaccgtcagttggatgggagggccataggccatcaggtgctctatctcgtcgccagtgtgtgatccatcccctctcgcgatcacctcgccatcggagtcgatgatgccgcccttggtggtgctgcccacccgcattcccggctcaatcctgagagccttcacctgtcagagattttacattgggttgagaaagaaaaaaaaggagaaagtggcacggaatcaaacgattgaatggcattatctcggtggattttgctgtgtgaaactgcagaggccgaagatataaaccatttccattatctaaaaaaaatgtctcggtggatagcatggcattttcttttacactgaggaacagagatggagtggtcaggaaacagaggggtaagtaaacacagtaccttgaagtactccacatagggggatttgacatagctgccatccttcatctgaaacatcagcccagcaagagccgacctagggcagtccttgattatggctacatccaagtagccatctccaaactgcaatgtaatgaagaatagtcagggtatggactgtggacaatcaagagccttgtagaaatagcagaaaatgattgacaacaccactgaatgattggcgaccttttgacacttgtattaaaaaaaactaaagagacagctttagggcttaataggatgtagacacttttaaatacagtatttatttaagcgtctgaatattcattgctactaacccaatagccagctttctattgctaaaatcacttgaattcctaagtttccagcttatcttttaacaatattttggcctttccggactaaaagattatgaagaaccaaaacagagtgagattaacctttgcttctggtgctgtcatgacattttcactagcaaaaggaacaccactgacccaaaccgaaacaaatgggccatccagtgatctccactcatgatcagtttcatcaattgaagggcctgcgtaagcacatgtttcgtcattaaaatcatttgatctgtcctcttgtacaccagtgctagccccatttgatttgcaactgctaatttgctctacaagatcaccaagtccttcgtatcctggggctggaacaaaaagaacacgcccattgtaccgccgcaagctcaccacacggagaagggactgaaataaagtcagagcatagaatgaattgctaagtatccagaaggggctgaataagcgaatacaaggacactacaacaatctttgcattatactttagacagcctctaaatatgctcgatgaagtactaaagctcacgatgacatttttttagacatcaaggcatatttttgtgttcaaaagtacacaacatttttcaaagcaaaataatgcatgcataaacatgcattccatttaaagaacatgctccacgatgggaacgtcataaacaaatgtatctgttgattgttattatatcatcagcacactgatgcaagcctaaccattatgatcatctaattttggaagcacattacagcattgtgcacatgactgaccatgaggaccacataaataaaggagaggaaagagagaggagagaaagcatatggatataattgagtgtttgatagagttatggtagaatgcatacatagaagtcaagacgagcactgcccatccacctgtacttctctgactcaatatcgatatcagctaccagacctgcagttcataaatcgttttctcttagtgccccagaaatagatagtgggagaacaagctctgagagtgacagtcagtgttatgggggtatagacgtgtagtttaagagagaaaaaagcttagcatcaagctaatacacggcataccccaagtaagcatcaagacactaaaaaaccttgtctttccctgcacaacagaggtaacatcaaggggacgcttgtgacctgtgcaacagaagctgccatcagtactttattaacacagaaaatggaaatattttgagaggatttacaatatggaaacacagatgactatttacgttaaccgtggggatttggggggggggggtagagacttgcctctgataattgcaagcacagcgttataaacggagaaggattcaccagcaaaatgcacaagtgattgcaccattccatttccggtacctatggtatttgtaatgggtgaaaactctacccagagaacttatagtattgagctgtaaagaagctacacaaggctgaacaaaataaataagaaatcacaagctactctctagtgtaacacaactttatgatgttctgcagtgatcagaaagaacaaacctaaggcatattacagatctcctaggtgtaactttgcatcactacaataaagaatagcattgtgaattgtgatcacatattcaaacacctgccgggatgatgcctaatggtatttttattgctgtgttccagtcctctctttgcagcagaccattaaccacctaaaaacccaaaataaaataattaaatgcaagtaagaagaataaaggaaattcacccttctctaaaaatatctgaggataaagaagactactgcctataattcgcatcaggtttttgtacgaatcatctttttttgctaacctctacaagtacaccatctccactgacgcaaacaattccatcatatttcctaagatccagtgaatgagcaatttcttgagcgtgaagccgatgcttggtttctgaacacaattcataattcagaaactttgtatacagagaaactgggtgtcacacttagattaccaaaataggaagattttgaacagatatcacaaccttgcatggtgtaaaggatgccagcagcttcaatgagaggtaggacctcagtctggaaaatcttccgcccacctctctttccaccataagggttaactatgatgaacaatctctttggccgacctattcaacagcatatcacggtagaataagatagatgtcaagaataattagaagtccagcatgtcaagaataattagaagtccagctttagttgcagtgtcaataccctaaatagttgtctccatatgcatgaagaagaacaaattagagatgacacgttctttttcctttttttcctaaaaaaacactaatagaggggctctggaaatttatggaggatgtccaggataggttcagggaaaaaagaatttactaccagaaggaaatcaacaactggagcaaacatgacaaaccaaagaaactaacttttaggagagttaggaccttctgtctaagttcaacatcttctttgatgcaacagaacacctcctgaagacctggatggactacctagtgctgacaaaaagggctacatttcactccttcacaaattccaacaggtgtatataatcactccaaccatgcgggattcctattatctaaaaaaaggggggcaaattctattccttcttccttggtattatttgcattacaaattaccaacagactgttattctggattttgggacatatgaatgttgccaggaaataacagcctgccaaccgtggcaagcgaagaattcaatccaactttgccagcaaaaaacccaattccaaagagagggtcattgtctctgcttcaagtatgcataagacacggttggtgtgagtgcagaagaacaatgcttagagataggatagaattacattgtgtgcgtgagagcagtagaagcaaaatgcttgaagtcctataacaatcctataataaactaatgagtggaaaagtgaaaacataaaaaccaccttcatttttttattgaagtctaatgaaatacacaagggtgacatttaatagcaatagcgacactgagaaggacatttgaccaacacatgaaaatcaatgaagtatccaaatgatcattacaaaaaatatcttctcctacattaatcagcagcagatgaaaagagctcatcaggatatcagatggtatgattcttggacctggctgaaatttcaagttcaaacaccacaatctttgttatgccaccaggagctggtccatttgattcaaaatatatttaaaaaaaacaaaaactcatacacaatttaaactatctagtaaaagttgatctatggtcagtgaaacttgaagaaacaatggggtaaaaagaactccctattggaagtattgtacgctatccgtacatataaagtagtactgtacaattgacgatttggacaaatttgtgcaacagagctgacaggccacgttacaacagcacggacaccaagaaatatccagagagatgcagtactgtacatccctcccgtcgattgtaaaaactcattacattaagtttttgtttatgaaggtgatcaactaaacaaagtgaataatcgatatttgggggttctttccccactacgttactccgagtctccgactgagtcaacgcaaccaccgcccaattgatcaaagatcaatcccaataaaaaaggcgacacttcgtgaccaaatcacaccatgaatcaaacaataacctaaacaagcttaaagatcatcgaacagtagacatttctgttactaagaacaaatcaagagcagatgattaccgagttactactactactagtgattaatcagtgaatttaccaagcgaggcgaggcgatctctcatggcgtccccccacgccgcggcggcctcctcgctctccatctccaccaccacctccctctccctctccctctccctcctcctctccccgcccccgcacgtcgccggccgcgccgccgccgccgccgcgtcgtcgcccctcgcgaaggtcgcgaccctgagcgccctcccgtccacccggaccccgagcacctcggactccagctccagcctccccgcctcccctcctcccccgccgcctcccgtggggcgccacgccagctccccgccggagagcgtggcctccgccgcggaccccccgacccgcaccggctccgacagggccttcgcccccgcctgggccttggactgctcctccgccatggatggaggaggaaggaaggaagctaagctgcctccggtggtgaggtgagttgagcgagagtcggcgaaggtttttttgtgtttgtttgtgttggggaggaggaagacgaaggcgacgtggtgaagtgatgaggtgtgtgtgtgtgggctactactataaaaatggcgccttccagctagtggggtagtatatccgtgttggggggggggggggggtgtatttatacgtgtgtgacgtatgtaaacactggagtatatagtgtaccgtatacggtatacccctggtgtaccgtacagtaaacgataacgatgtcgacttttgaacacttgtctgactattccgtcttatttaaaagttttgtatcaatatataaaatataaatcatggtttaagtactttttaagtgataaaataacacacagcaaaataagttatgattatgtaaattttttaaataagataaatgatcaaatatgtgataaatcgttaacggtgttatctatttaaaaaaatgaggtagtagatttctgtattgttggaggccttttttgttttttttttggaggtccttgtattttgggggatttgtgtggggatggatggatatattgacgttgccgtgatgccgtccatcttatcataggcttctagaaggagtaagctttttttcttttcctcttggaattggaacttcgcttctagaagtatggagtggtactttaccttctagtactactactaggtgcagtggttctatgcacgtgggccgtggcaattcttcatgtggacaccttcaacagtgcttgtgtttgaaaattgatttctcagcttgaaaaaaatgtgaagggcaccagcgcaccaccaaattagagtagggccaagaaaaaaaaacagtttttaggtcatgtttgaaaaaagaaatgaaaacatgataacaaaaaacacattttttttaagaatggaatatatatttcttgtttttctcaacaagctacaaccaattgttatatcaaatcatcaaaagcattcacgatgtaatgagaccaaaaacacaccaagttaacataaaacaaacacaaactaataagcaacaacacaaaataaaagacccacaattattaaatccgagaatgaaaatacatgaatatgatatagtgtaaagttgaaaactaaggaattcaaaagacgggaagatgcaatttaggcagtttaaatcacgtccccttatgcaagcatgaagcaaaggatattttccttcggatcaaagtagatgttttatttcctatgaatggagaaattgctacttttccgaaggaatccaacaaacctattcctttcttccaaacaagctcataagaaacaattccaaaggattgcaaacctccgaaaatcatttaaaacctatgttcctcaacttagttttttaaggatatgaaggtagagaaagataaataacactaaaggttctaatatttgccctaattttctttaaaaaaaatctgattgctcaacttagcttttatgtcagctttggtttcatataatgaaaccctcacattaatgaaaggttaatgtctctaaaggagaatacggaggaaatagccatgctgaacaagaatgctccttcagagcacctccttcatgggacatcgacgctaagcctcttccttagtacaaaatctttttatatataatttgattggtccataaagtaggaattatattcatcgcgggttttattagaattggataggagaatgatcatcgtaaatgcactagtgaagctaacaataggttgtcgtgagcaattgcttaagcgcagcagcacacaacacatgaggtggaaatgccatgtcgttggtaacgaactaggtaggtgattttttttttaagtggtttcatctgatctttaaaaaaaattctagaattgttattgacagaggaatcatcagcacatcaagcataacagattcgtacaattctagtaatgtgtcatagtgaatttcatctggcttaaattttctagatccgtcactgaaatgggagtggggggtccatccgcaatcatacaggacagacgtactgcttgccaaccacacgaggtaagacgagaccaatgtgtgccgataattgagagaggagtgacacaagggaacaaaggcggataaatgagagaggagtggagggagagaggggctgtaacctctactcactataacaagcttaatttgcagtgttcgtctgcttgagactttgagcccatccacagtatgacatgttcttggacgagtggacacaattcacagtgacttaccagaagaagtcaccgtgatgcgaagatggatcaaccatggacgctacacacgtcggctaacctcgtgcaaatcgcgtagatcaaaccggccagacacattgattacgcacacgacgggcaattaaatagtcgcgcaaagttgttgtttcgtgcctggaaggtggttaaaaggtgaactagctaggcatctagcactagttgtttattgtcatggatataaaaaaaacacatgttcttatgcttcttttttttcaagttgtacctatataaacaagcccatcgtttcacctatatttatccatactgttattaataaaccaacaaataataatttatatatacatgtcactattgtaaaaaaaactacgatggaaaaagtatgccataaaatcaactttaaacttaagttttaaaatttaaattttgacttgtataagcataagctccaatgaattagactcaactatcacggtgtcaccgtcggatcaatcccttcccagaaaacgaatgaatgaaggcgaaacatgagtgctaaggaaaaggagtcgttttcgttcatagcctcacaggaacacataggtatatccagggttcaatcttttgttttcgtcgatacgagggtactgatataccaaaaattttgaacaaaatattgctaaattaatttttttttggctaaaatagtatccatatttgttttttttttggggggggggggggtgagggttgattttgaaccctgggtatatctatgatctatccatcgtagctctcacgatgcaaacggggtagcctcatcttcgctgtcgacgtcgccattggggcatccagaagaattcactcacacggtgacaattgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42975 - DNA, 708 bp, Oryza sativa
ttacaaccaatccacacacacaccaacaaacaaaacaaagctatgcaacatgccgacgaccatggacaaatcttatatccgataccggaccagcgggtccttgaactgaagccgcccattatacaccctccacgcaaggtcctcgagtaaaaacgagtgaaatctccacccatccccatcatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacgggctgcag

SEQ ID NO: 42976 - DNA, 782 bp, Oryza sativa
aattcctgcagcccatgtggcgcaaactgctaagctacttctgaacacattatgggtatgttcagctgccggggctgcggctgcactgcagccaaccggaacattccggtaagcacaaacacagcagcagccgcagctgcagtcctggcctgccaagttaaggatcctcatggattaaaatatacattgacttgcaattaatttgccatttcccttcttttgttaccaaagtagtatatatgagtacaaatatacaatggcatttactttatcgctatacgcctaaactttgcctttattttttcctttctgcttttacagctgtttacctgttattctttccctgtatggatttctctaactagtgctatgtgatgatgtacttatgcagtgcttgttcaatgaatggagaggcatctttgggtggacctttgatctgcatgctctctttttcaaatcaattaaggagcagattataacatcatttagatgggtataccatctgtactttgtaagctggttattgtttgaataatcttggcctcaaatgttaaccatacctttccttttgcaaggttccatttgttcttgtagatcctgaaaacatgactggaatggtccatgtgaagttagacagggcaatgcaaccattacctcttacaactgtgtatcataaacttaccccagtcgactcaactccttacacattgtttcagactattattggcaatggttacccagtaagttcctggctgtatattggaccttttttttgtatggaa

SEQ ID NO: 42977 - DNA, 4963 bp, Oryza sativa
atcagctcatgctcagaaataccttttttcttgtaagggttcttttgtttggcatgtgttttcatatcttatctttcttttactgatactccaggattcccagaacattggtagtttataatttatatggctaagatatctcttgtggttaaccgaagtaggacatgcatatgaagatattcttttggttgagttttattgctttttttaactctttaccttcaggtctgaccttaccaaggatgagatggaagccgagttgtcttctcgtgctaaaacactcttttgggctagtgttgttcttggaacaatgtcagtttgcttgctgggctttgcgacttacaggtatcaaactgtgacatttttgcaattgttaatgattttattggttagtattcaattagtatttagttctgaggataatctacagcttgatacttcaatcttactctctttgttagttatttcgtacatcttgtgagttccagatgacttgatgttgtactgatgcaggagctggaagaagatcaaagagcggagggaggcaaggcaagcccaagaggtatttcgacaaactactgatgaagttacagacgatcagtctagcgatgaagaggctggtgaaatgggagacgggcaactatgtgttatatgcttaaggaaaagaaggaaggcagcttttattccttgtggtcaccttgtctgctgctgcaaatgtgcactgattgtggaacgtcagttcgacccattgtgccctatgtgtcggcaagacatccgatacatgataaggatctacgacaattgaggtacgtgacaagttttcttttagccttttggagagggactactcatgatgtttgactcacttaaattgcaacatattacttgggttacactaaggaaaatctgcaagtgtatccttttttggctgttctgtcacaaggaaatgaaattcttgccgatgtgaaaattatttttttggcagacaactcctggttaagctttaagctaaacagtaagtagatgaacagcactgtagatacatgtttaagtgaatttagtttcctgcaataggcataaaatgttaactcttctatggaggagcattaactgttagccgcattagcctgacttatttgatttttagcatctgaaatagtggaatttggagatgacttatttgatatttgttgcaggcttcttgatgttttgctgataacccttcgacactgtatggtcacccagattgtctgcgagcctgaagacctcaactgatcatcctgcgtgcactagtctaagctacttggctaacaaaactatgttacctgaattttgtgtatatatatgacgtgttagtcactcccaggagaactcatatgggcagagatcaccggatacttttcatagtcgcatagaatcctgtagctagccaaactgccagagtcatgagctgacgcctatagttgcaattacagtactaccaagtttttgttggctctcccttctcatgtctgtgcattctgtaaagatggttttgccgctagcaaaagtatgatggttcggatttttattcttgttctgctgatccatgaatttccagttcctggtacgagtttcaggttgtcgtgtttgcaaatttgtttcaggactcgggagtacgcaggagattaccgagtgatagaatttcgccacttaaagagaaagacagctgtgctgggaatctgggacatgaataaaatgaaattgtaaataaagtatctgctatacaatccgcactatgagagcttattcatatgtgtttatatagttgagtgcacacgtatatttgagagtttatgtgcttatacagatgagtgcacatgttatttgagagtttgcgtttgtagtgtatttcgatttttttaaaaaaaagaaatcaataagggagtctaccggtagagaggcgaaaacattgatttttcaccagcgaggagataaaccttgtaaacctttttctctaatccaaaaacaaacttgaattatgtgtacttacttgcgccctgcgaaacctcccgagacttaaacgtaacgcaaacgtttgaacaggctgaccgcaggattaacatcgaacgatcaatactgcaacgcaacaacaaccatcagacaaagatcggacggctaggaaggaaccctagcacccgtgagtgcctatataagagacaatcctctcgccctaatccctcccctctcccatctcaccccgccgccgccgccgccgcagcctcctcaaggctgctcccatcctctccttcgaggtcagctgcagatcttctctcttctgttgtttgcgccggttcatggtagttcgtagccgtagatctgattcgatggagcgaggtttgggtgatttgatgcctgggcatgttgtttttgtccattattagtaactttttctgtgtattcgtctcactgctatgatcttagtttgctgttcgttgacgcgatgatttattgacttgtcggtgaatcatttatgtacgttgaaaattatcggtagaatcggactattaacttgatgtgctgcagaatcatgtacataagttgaaaatcatcggtagaatcagtagaagtatttctatctagaatccgttcgaatatctctgtttttatgttcgaatagatggtgttatcgtctatgcctggttcggtttggtcgattactgcgcgttagcacttataattgatgtcgaagttcatctgatctgtgagcttgcctgtaatattatttggagttagaaattatgcacgcctgttgtttctaatctttgtttcgttctgttttgcagttagcttcctccttattcaaccatgggtaaggagaagacgcacatcaacattgtggtcattggccacgtcgactccggcaagtcgaccaccacgggccatctgatctacaagcttggaggtatcgacaagcgtgtgattgagaggttcgagaaggaagccgctgagatgaacaagaggtccttcaagtacgcgtgggtgcttgacaagctcaaggccgagcgtgagagaggtatcaccatcgatatcgccctgtggaagttcgagtccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatatctgtagtgtttggtcttttgttatgattgatgagcctagcacttgtttatacatatttgtgatgctattgcagaaacttttggttacataaatgatttactgctatattcagttggaaattggaaatgaacatattcgtgatgctattccagatattcttgttttctgttatgattgatgagcaacttctgtgaatattcatgatgctagtcctgaatactgttgattacatcaatgaagtagcattttcttttattgatttatccctctgtgctagtttttctgactgtctaccttctatgcatctaagactgcaatttaccatgcatctaaggctgctactgttgattgttgcttttgttatgactgtctgtctttatgatgcatctaagattgcaattgttgttggttgctttcctgctactactagctttagtaatttactgctgcaagaaactatacatatcttctgttagatttggttaagttcatttagatatcgtgctgtatgttactttatactagacttgtattgatgttgctgtccacctgtatttcattacatattggttgctattatttcattttttgtatcttatatggtgtttataatatgtttcataccatttgtagttagtaatgtatttgtatgctggtgcctgcccctgatttgttttcctttgttctgttacagatggatgccaccactcccaagtactccaaggcccgttacgatgaaatcgtgaaggaagtctcatcctacctgaagaaggtcggctacaaccctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgggtcgtgttgagactggagtcctcaagcctggtatggtggtgacctttggtcccagcggcctgaccactgaggtcaagtcggttgagatgcaccacgaggctctccaggaggctcttcctggtgacaacgtcgggttcaacgtgaagaacgttgcggtgaaggatctgaagcgtgggtacgtggcctccaactccaaggatgaccctgccaaggaggctgccagcttcacctcccaggtgatcatcatgaaccaccctggccagatcggcaacggctacgccccagtgctggactgccacacctcccacattgccgtcaagtttgctgagctggtgaccaagatcgacagacgatctggtaaggagctggagaaggagcccaagttcctcaagaacggtgatgctggtatggttaagatgattcccaccaagcccatggttgtggagaccttctctgagtaccctcctcttggtcgttttgccgtgcgggacatgaggcaaacggtggctgttggcgtcatcaagaacgtggagaagaaggacccaaccggtgccaaggtgaccaaggctgccgccaagaagaaatgagcctcgttcaagtggtgctttccatatctgcatttgagatatctagctcttttagtactcgttaagtttt

SEQ ID NO: 42978 - DNA, 15199 bp, Oryza sativa
aaactgaaaaccgagtgggtgtcggtttagcatattgttttgtttagttctttctgtcccataattgtttgggttgaattatgaattgattgggatttaaatttttgagattttgtttaccggccaagctaccgaagtactacaggatgaggtgacacatctgactgtttaccgctgaaattattctcatgggtcgtgtgatttctcccggatgcctatataggaaattgagttcaataaaaaacgatatttaatcattagcgaatgactaattaattgttaataattgtgacttaaaatataaattggagtatgatttaaaataactttcttttttaaaaaaaaaaacgagcgaaaggttgcttacaaaccttcttcctcctttgtaccgggctatacaggcatgggagaggaactatggacgagggcatgactctagttgtgtgctacctcggcgtcagcaacacgagagggagagctcgtcatctttataggccgaggaggtcggttactgggaatggatagaggaagaggacgactatgccgcgacgggtctagtgatgatgaaccgatggcaacaccggacatcggccttcaactggccaacgacatttgtttgtgcggcggcaatggcttgcaggtaacacgcaactagtgaggtgtagaagggagttggattggtggagggaaggaaaaaagaatgcatgggccaaatataagggatttctgcccatattaatagggactttgtaatttttgaagggatggtttgaatatgatttaaaagaaatgggatttgggataaattgtttagggactatatgagtttggaggatgaatttaaataaggtttcatgggctctaggggtgtttatattatttttggaatagggattcaaaggaatttaactttatggcaatgattggaggactaggacaataggattaaaaataaactaagggttttataaaaaaaaatgaaagaaatttagatgagaggctttaaatattgaaataaaacattaaatatttaggtcaaagataataaaagaagataaaaagaaaacaagatggctccaatttaaatgaaaatcaaggagggtgaaataaaaactttttcgcataattttttcttaaaattttgagtacgttacagagtaggccacacattcagctaggtgtggtaaaactaaaccaattcactatgtgcgtgattggattgagcggcatgtgtggcaagctactttatgccccattcttgatgggtcctcacttatgcttgccccaaggcttaacggtttcggaggcttagcatggcaagctctcaaacatactcaggcccggtttagtttcaaactttgaaccccaaaaacgtcacatcgtacttttctacacacacaaactttcaactttttcgtcacatcgttccaatttcaattaaacttctaattttagcgtgtaactaaacacaccctcagctcatggcgggccttgctaaggggtcggcccatgggccgacgaaactagcagataaaggagctgctaacaaaagttataatatctaatagtgatacgaatcaaatcttcccttgggcttgggtcatctggtgtttcatggagcaagtataataggagaaccgagactaaggaaagggggttagatcataggtgttacacatccagataaccataaagctttataatcccgtgcgttcacttgatctagcgatttaggggggttccctaacctcatacttattcctaactactccctccgtttcaggttataaaatattttgactttgttcaaagtcaaaatgctttaagtttaaaagtttgtagaaaaaaagtagtaacattttcaacacaagacaaatttattatgaaaatatattcaattattgatatgatgatactaatttagtattataaatattactatatttatctataaacttagttaaccttgaaatagtttgactttaaccaaagttaaaatgtcttataacctgaaacgaagtaagtaataactgtccgcttaaactcactgaatggggccttggatactccacaatccagatcattttgcccgacaccttggtctcaaaacaactatatagaccggtgcaaagtgactatttgcaactaaacgcccatctacttgttgcaaatctacttctcccaaacatcctcctctaaaaaaaatttaaatatacttatcacttgagcgctgcgaaacctacagagacttgaacgtaacgcaaacgtttgaacaggtcgaccgcaggattaaaatcgaacggtcaatactgccacgcaacaataaccaccagacaaagatcggacggccaggaaggaaccctagcacccgtggctgcctatataagaggcaatcctctcgccctaaccccctcctctctcccatctcatcccagccgccgccgccgcagcctcctcctctcgccatctcccgtcctctccttcaaggtcagcttcagatcttctcacttatccttgtttgcgcctgttcatgatcgttcgtagctgcagatctggtttggtatcgcgaggtttgggtgatttggtgcttgggcatgttgttttcgttcattttttattgtgtattcgtctcactgctgtgatcttagtttgatgtccgttgacgcgaagataaacttgatttgtccgcgaatcatgtgcgtatgttggaaattatcggtagaatcgaacgataaacttgagttactgcataatcatctacataagtggaaaactactggtagaatcggtagaaaatctgtatctagaatccataatttgttgttaaactactgctgagtagatgttgttattgtccgtgccctgttcagttgggtactgaaattctgtatctaaaatccaatccgtaaatttgtttctgtaaatttgttattgtgctactgctgagtagatggtgttattgtctgtaccctgttcggttgtgtcgattactgcgcgtctgtgtaaatctcatgctgattttgatggctattaacgttctgtggatgtccaagtgatctgatctgagatcttgcctgtgatatttatttggagttaaaaattatacagaaaattgtttctaatctttgttttattacgtagaacagtcagctacctgcttaatcaaccatgggtaaggagaagacgcacatcaacattgtggtcattggccacgtcgactctggcaagtcgaccaccacgggccatctgatctacaagcttggaggtatcgacaagcgtgtgattgagaggttcgagaaggaagccgctgagatgaacaagaggtccttcaagtacgcgtgggtgctcgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatctctagtgtttggtcttttgttatgattgttgagcctagcacttgtttgtacatattcgtgatgctattctagatacaatgaagtcgcataatctgttttattcactatgcatctaatacttcaatgtttgattcttgcatatctatcttcttttatgattgatctgcacagcacttctgtacatattcatgatgcttgtcctgaatactcttgattacatcaatgaagtagctttcatttgaacgtctagttgtttgttactttatactaagcatctatttgattggtttaagttatattttaaattatctggttgtggtgttgtacttcattttgtcatttttatcctgctggaagttgcagcccctgtcctgtttcattacatcttatctggtcactgtgtatcttatatgctgttaagtaccttttgatactcctacatctggtccctgctcttgtatatcttatatgctgttttaagtattgtttcatatgatcatatcttgtatggttatctttgtttggttgccaaccgaccccctgctgaggaaagttattgatttgttttcctttgttctgttacagatggatgccaccactcccaagtactccaaggcccgttatgatgaaatcgtgaaggaagtctcatcctacctgaagaaggtcggctacaaccctgacaagattccctttgttcccatctctgggtttgagggtgacaacatgattgagaggtccaccaaccttgactggtacaagggccccaccttgcttgaggctcttgaccagatcaacgagcccaagaggccatcagacaagcccctacgtcttccccttcaggacgtgtacaagatcggcggtattggtaccgtgcctgtgggtcgtgttgagactggtgtcctcaagcctggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgatcctcgttcaagtggtagttttgtgcacggccatggcactcgttgcattgaccgttattatcatatgctcgctgtgtgcactgtgtcgtttaaaactctctattttctgttcggtttaaacttgttctgagcctgattattgcccttcggctgttgtggaatgcgggtatttacattgctaattcctatgtctttattttggcttgtggcattcgcttgttctactgctattgaaaactgtaatctgtttctgttattaaaaactgaaccttttcttctgctatttgaaactgaagcgagtgggtttcaatttgctgaaatcctgctacttgctatttaaattatttatgttcaatttcgttcagtcccatatttgttggattgagtgaaaaactgactactctggtttcgcttgaattatggaactgatacgatagcacaccgtttcaatttctccggttaagttctttcattaacagtttaactctgaaattagttccgttattacaatgataacttttgatgaaaacaaacttttgctcccttcttggtaatgtttcgggaccgtgagaatccactcaatacaacaaacttttgttaaagtaaaatggtggattcgactgatttaatttcatctctaaaatggatgaattcttcaagataggtttggagtagttggtattgacctttgatgaatttaggtcaaggaatttctatttttatcactctgtatttgcgagatataaatttacaagatctatatgaatgtcaaactatttaagctctatttaaatttagatatggtttatgtccaagttctgttgaatttcaacgataactgcatagagtatgatttccctaaggtgcctaattttgtgattctaacaagttctatttcagctcattttggagctggcatctatttacttttaattttacaagttttagataaaaattaggatatttatatgctacatagtttttagaggtgtcctatgtagcataagtgccagattctaatctacagttataaagagtagccgtaacaaaatttggttgttcttaattagaacttaggatgaattccttgcgagtattacaaggctctgttcgcaagaaaaggtttccaactcaaacattacgtatggaaaacggaacagtctattagcacgtaattaattaagtatttactatttttttaaaaaaatagatcaatatgatttttttaagcaactttcataaagagactttttttttataaaaaaaacgcaccaatttaacagtttgaaaagcgtgcgcacgaaaaacgagagtagggagttgggaaacagctcttgcaaatagaacctaagtctcggtacatattatagtaattatttactacacagtacttagagggatttcccataccgaaagtgcataattttagtttacaatattaacaagcacaatttgtttaatctactgagatttgattcatcctatttggagctaaaatgaaatttctatcaatatataggctgaacatatttttcagctgaacaattaaagctttagctactttcattatattttccagattttaaaaacatcggtccacctgtaagtgagagccaatatgcaaaaatgcccctggttttcacgaggagtcaactttgcactccctcacgtagtcacgtatctatgccaggttttaaaaggagtccctatcttcttttttatatctagggggtatttagatccagggtgtaaatttttggtgtgtcatatcggtattatatagggtgtcgcatggggtattcgggcactaacaagaaaaactaattacataatccgtcagtaaacaacgagacgaatttattaaacctaattaatctgtcattagcaaatgtttaccgtagcaccacattgtcaaatcatgaagcaataaggcttaaaatattcgtctcgcaatttagtcgcaatctgtgcaattagttgttttgttagcttatatttaatacttcatgcaagtgttcaaacgttcgatttgacatagtgtaaaattttgagttaatcagatccatgctattacaaatttatctattcagaaaaataccactacaattcgtatatttatagccgtgacactgaaattttataaaattagaaccgtgccactaccgtaacgttttccttccatctcctttgttttccgtctttcttccttcttgttctcaacgacctcagctgttcttgtgctcatcatcccaaccattattccttctccaaaattgtgagcccaaatccgacatgaagacaaagccaaggccgccatcctctgtcggcacgacacgaaacccacacacctcaaaggggcggaggcgaagccgaggcgacgcggcgcggtggcgatgacgttggggagagggctccggcgagctcggtgcctcggtggagaccgagatctctcttcgcaacggggagatgctgaggacgaagaccccacggccgcgtggtggcaagtcccatcgcgccacggctgcggcaggggtgcgcggggaaggggaggtcatcatcaggggagctgtcgctgcagcatgagcatgtctcactcttctccttcctcgtcgattccctcgcgaaggcgccgctgcggtgggcggcgcgcccaccggcatactaccacgcactccgcacctgcttgttatcatgtcgtcgacgtcccagaaggcggagcggcgacggcggcacgacaaagaagaacgtgagttagtcagtggcgtgcgagtgtgataggggagcgcctgcattgtggtgctgccatgccgctgcaggggggaggtgcaggtccacgggggccgctgccgtgccgaggacgacgccctgcccaccacgcggacgccgttgaggaagaagagctcgccctcgccggccatctccatgtcctccacgagtagctcgtcatccttcacacccttcgaggagctgcaaccgcctttgcctctacctatgttgcagccgctggccacgccaatggacgctgacaaggtcgtggaggagaaggattgtggcatccctggtgttcttggtgctgtggatttcgatctgaacgagcagaggctagttgtgattaatgtgcccatggctgtaagtgatgccgaagaggtgcgcatcacggcggcggtggtggtgggcgcaaaagcgacagaggaaggcgcggtcggcagtgacgaggcggcgctaacgcgtgcaaacagccgcggcaggaggcgggggagtatctcaggagaagaagacgggagaaagaaggaagaaacggaaaaggaagggtaggggtgggcgttcggtcagaccgaaaaattcggtctcagtcttcggtcttttggccatttcggtctttgaaaactcgagaccgaattttatccaaaaaaatctcaggaccggcaaatttggtctcggttttttcggtctttctcggtcagaccgattcttttccggagatggatgcggccgacgggatggaggctggctagaggaggcggcccgcgcggcgccggcgtggtggaggctggaggcggcccgcgcggcgcagtggaggactggagggcggaggcggcgaggcggcgctggcgccggcgcggtggacggcggaggcgggaggcagcgccggcgcggtggacggccgaggcggaggcagaaggcggaggcggcgaggcggcgccggcgcggtggagaggcggcgccggcgcagtcgagggcggaggtggcgagcgtgacacgatggccgatggggatgggaggcggcgccgcgtgagggagtgggagggagtggctgtgtggtattggttgcctctagggtttagtttgttgggcttattgggcctcctaggtctattgggccacaattcggttttctcggttaattcggttaaccgagggtaatgaccgaattacccgaataaatttcggtctttcaatggctgagatagaactactaaccgaatttctcggtctcggtcttttcggtctcgatctcggtcttttcggttcggttcttcagttcggtcttattttgcccacccctaaggaaggagatagatggaaaacgtgacagcgatggcacggttttaattttataaaattagagtggcacgactacaaataaataaattgtattgatatttttctgaataggtaaatttacaatggcatagattgaattaacctaaaatttttatgtgaaaactaaacagggccttactacccaagtccatgtcccttattttatataactccaagatggccgcgggaccgcggcactggaacagcttggtggtggcgaacttcagcaaacggtgacgacggtgttcggcccacgagctaccaaaccaatacgtgcaagtgctccgtgggatcctatggacgcttactgtttgtacagtgattgacgccttgacagcgacgtttgacgacgggagcagaggatagacagacaaatgtgacacaacttagtacataactagatttattatacagtatatatcatgtctgatactagtggatcggttttttatgagacggagggagtatgtggtttaggaggtgagtcagttttaggattaaattacttttggttccaacatgtaataaggataaataagaggcgggtcaacttccaagagttgaataagtagttttttcttttgtgttaccaatttgacacattcgaaaatacggaaactaaggttaatgtttggagtgcaatcgatagtactttatctaccgagttttaatatggaaatccaaattgtcgttagggttgacctaaccgttatttttgagtttgcaaatattgggatacggtgtaacttgctataatgtcttgctgagaataaattcaacaatcactcactctcataattggggctctcgctctctctagaaagctcaagagcgtcttctcaagcgaaaagaaaaaaacttccccttccgcccagcccctttccttccattcccgatggcttttcggtcgccggcgagggagggagatggtctagctcctttcttcgctagtaggcttagatttagtcttctttgatagtcgggttaaccccattttgtatagcttgagggggtcatcggcgtccgactccttcattctggttgcttctgccatggatgtcctcgtcgacttcttctccggtgaaggttccctgtcaatcgttttacaggttcaccatcaacgcccgaagctaagagtgtggtgggtttgctcaaaagaaggtagcgccgaccacttgcttcttcttgggcgagctttccgcaactgcgttgttcttcttcctagtcttcggcgtcagctttagaagtgtggatgatgtgtttctccgtttgccttggatgcttcaacctccatagagaggcctcttttgggtttgcatctaggcatcattatttttttttagaattacacagtacaacgcaaacactcataacgcacgcacgcaaaccttacccctatgagcatcttcgaatactgggccagcaaattcttgagattgacaaagtcaccaccatctaggcatcattacatgcagctagccaaggattatcagctccggtcgtcgttcagtgcgtcgatctggtcatcgttgttgtggacatggcaaagagaataacccgattaccttttctgtttctttctaggtcctttcttgcatatttcagggttaaagtgtaatttgcccatctgtcaggggcctctatgtaagatttgctgtactcttagcttgcttaataaaaacctgaaatgataaattcaacaatgccttcgtcgtaagaccatatgcaagtaagtgcctatatgcacggagttggatagagtgatagacaacgctgacttctaataactattgcgggtggaagctatcaattttagtgtactgagttttgtttcaaattgtgttcacgcaaggaattttcatagagattgatcatacttgttttacctggccttaatcttcattttgaagtattttaatttaccccatattctttgagtatgcactagctagttgaagcttgtttttattttagggttaattggatccattccattgcaactttgacaaattaaaaaaaaattgtcactactattcgtcatatcggttacatatcactataaatctctaaaattggaaccatgcaactctcgtcaatttttctgccctcatcgacccgcccccctccctccacgaaagaaggcgcatctgctgactgctgggcaccttcgccacttgccgagatggttgcgcgcgtcaaacgtgttggcgaggacgtatgtcgggagctcgccaccgccgtcggcgccgcattcgagtgtgtcaatgagttacacaaacttggagagcacaaaggcgaaggggtcatcatcggaggtgatggcgaggaaggacgggatgtcgcggaagcgtagcagcgagagccccgagaggctcacctcggcaaacgcgtcccttgatgcggccgccgccaagagggcgtcgcgtcggccacggaagtagtggtagtacgcggccagcgtggtggttgactggaactagaacacggcgatggcaaccactctatggttgtgtgcgacgtcagctgctgcggtgcacgacggggcggccaccgccatcaccatcgccgagattcggcatcgttggcgcgccaggcggtcgttgctcatcgcgctcgtctcccttcttagggcggcacctaacacctgcgccaccaaggacatgctcgccgacctctcccgccaccaaggaagccggcgtcagggacgacactaccaccgtagtcgtcctcgccggatccttgctctgccgacgccctccacctgctcgccgtcgacgccgccctcgccatcttcaatccggctaacccggacctcctcgatctccgcggcaggggcggtgaggcagacccggtgccgccaagcgcttcgtgccattccattgcgagggtagggacaacgacggttgcggtggtgctcggaggggatggcggcggctgcactgtgcggaggaagaagaagaggcggtgtggctggctggcgcatgaaggaggcgcgctcggaggggtcggcggtggctgcgccgcaaggctgaagtagaagcggcgactacggcgggcggaggaacggtagcgccggcaggcggaaggaggaagcggcggcggttgctgctccatgtgcatcttcatgataggacgaagacggtgatgctacggagtggcacggttctaattttagaaaattgtagtgatatatgtccgatttcgtgaataatagttgtatttttctaatacggtatatttgcagtggcatggattcaattaacccattttataaaaaaaagactgtaatatattactttctgaaagcattttaagtattttattgcaagctaaatttcaaaattctcaatttggataattgggaaaaaaatgtttgaattaggccattagggtacctacttgcgctctgcgaaacctccagcgacgtaaacgtaacgcaatcgtttgaacatgctgttaccgcaggattaaaatggaacggtcgatactgccacgcaagagcaaccatcagaaaaagatcggacggccaggaaggaaccctagcacccgtgtctgcctatataagaggcaacacggcccaaaccctcgtttctcccgtctcaccctagccgccgccgcctcctcctcctctcgccttctcccgtcttctccttcgaggtcagcttccgatcttctctcttctccatgtttgcgcctgttcatgatcgttcgtagctgcagatctggtttggtaccgcgaggtttgggtgatttggttcttgggcatgttgttttcgttcattttttagtatttttttgtgtgtattcgtctcactgctatgatcttagtttgctgttcgttgaagcgacaataaacttgatttgtccgcgaatcatctgcataggttgaaaattatcggtagaatcgaacgataaacttgatttgatgtggaataatctacataagttgaaaattgtcggtagaatcagtagaaggatttgtatctacaatccgttcgcttagatctcttcctatgtttctgtatttttttattctactacggctgattagatgctgttatagtctgtagcctgttcggtccggtcgattactgcgcgtctgtgttattctcctgccgattaactgatttagcactttgatagttgtcgaagtttgaattaggtacctactttgatagatgcccaacttttttgtgtgtattcgtctcactactatgatattcgtctgctgttcgctgacgcgaagataaacttgatttgttggtcaatcggtagaattggatgatgaacttgatttgttgcataatctagacaagttgaaaaatatcggttgaattgttggaagatttgtgtctataatccgtttgcatagacctagagcttagtttctgttctgttttttattctactactgctgctgagtagatgctgttatcgtctctacctgtttcaattgggtttattactgtccgtctgtgtaattccttcactgattttgatgcccattaactatgttagcactttgttagattaagtaacctgatctgtgagcttacctgtaatatttatttgtttctaatctttgtttcattctatgccgcagttagctacctccttattcaaccatgggtaaggagaagacgcacatcaacatcgtggtcattggccacgtcgactccggcaagtcgaccaccacgggccatctgatttacaagcttggaggtatcgacaagcgtgtgatcgagaggttcgagaaggaagccgctgagatgaacaagaggtccttcaagtacgcgtgggtgcttgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatctctagtgttcggtcttttgttatgattgattagccttgcacaagtagcataatctgttttcttcactatgcatctaatacttcaattgttgatgcttgcatctctctactgtttgtcttattttattattgatctgcacagcacttctgtacatattcatgatgctagtcctgaatactgttgattacaacaatgaagtagcattatgtttgtatggatttatccctatatttgctttttttttatcttcactacgcttttgcgcatcttctaagactgcaattattgttgtttgcttttgttattactgtctgtcttcactatgaatccaagagtggaattgctgatggttgctgtcctgctactactagcattagtgatttacctgttcattcagatatctagttgttttttactttatgctagacttctattgaagttgcagcttgcccctgtttcattacatcttatatctggtcactacttttttgtgtatcttagatgctagtattaattttttttgtttcatatcatgtatagttagttatctgtgtttgtttgctagtccctgcccctaattcgtttgcttatttctgttacagatggatgccaccactcccaagtactccaaggcccgttatgatgaaatcgtgaaggaagtctcatcctacctgaagaaggtcggctacaatcctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgg

SEQ ID NO: 42979 - DNA, 4641 bp, Oryza sativa
cagatcggtaacggctatgctccagtgctggactgccacacctcccacattgctgtcaagtttgctgagctggtgaccaagattgacagacgatctggcaaggagctggagaaggagcccaagttcttgaagaacggtgatgctggtatggtcaagatgattcctaccaagcccatggttgtggagaccttctctgagtaccctcctcttggtcgttttgcggtgcgtgacatgaggcaaacggtggctgttggcgtcatcaagaacgtggagaagaaggacccaaccggtgccaaggtgaccaaggctgccgccaagaagaagtgagcctcgttcaaatggtggtttgcatgtctgcagttgagatatctagttctagtatttgttaagttttgcccacggccatggctctcgtttcatggaccgttaatatctgctcgcaatgtgcactatgtcagtcgtttaatactcgtttatttctgttcggttaaaactgatgctctgagtccgattattgtccatcggctgttttggaatgcgagtatttacattgctacttcctgtgtcgttattttcgtttgtgctattccctgcttttgctgctattgataactggaaactgtctctgtcattgaatctcagacaagttttctgctattggaaactgaaagcctaatggatttcaattatgatgattgctttttctgcaactgccacctaaattgtttatgttgaagttcgttcggtcccatatttgttagaaaagggtcggggcctcgggggtttgcttgaatgatgaactggtcggaacttgtagtgcttcaattgttgtgattttgtttccaacaggatgtttacagcctttttaaattgagaaattagcctctcaaacaatctaatctgaaaaccttttaaattaagaacttagcctctcaaacaatctaatctgaaaatttgatcctactatgggaggctatatgtcctttcgtaagatgtagattgaacttttgtcatatacagggtatgaagtatcagatggaacaacgtagattgaactcaagtccttgattttaactctaaagatcaattaattcagtccactcaaaatgctgataatggaataaccctcctgggaatagatgttttgttgatgcttcttggaaagatcaattaggatttggaatgtttttgcatgatccacagactcgtaaagcgatttgtgtccaagctagttcaatactttatactaatgctctccaagcagaacttgcaagtatatacttagccattggcgtatgcagaatgcttaacattgcaggtatggttatgctttctgataatttgcctctagtgaagctccttcgtcaaaggaattttgcttcccagccacatcactggagtcttcatcctctgcttctgaaattgcaagattttactcaaggaaaatcaattagcatggtctggaactctggatataaagaaatctaaacaagatggcagatttttagaaaaagggcaagagaagcaaatgctcgtcaatctgtccaactagtttgtcaaaatgtatgacatgtctcgcttcaaagtagctgtgctactacggcagctcttcaatcagcttttatagctgacgatgtacaactgattcatgtactgtgcttctaagtttccaataaactttgttctaaaaaaaacatagattgaacttttgtcagatattgttcttaaaaaaaaaacttctgtcagatattgaggacacacgtctgaagtagtatcagatagcacaccgtttccacttctgttaagccctttcattagctctgaaattagttccattgctgctattacaataataacttttcatgagaaagtaatcaatctatttaaccttagcccccatcttgatgaagtttgggggccgtgagaatccactttccgggtgatttcagctgtatgcgtctgtaagtatatatgaactgtacaatacaacaaatattgttaacagaaaaaaaaaaggggctaacctgcttaaacctatatacgggtggacggttgagccatagttgttggtccctaatatgatcatgtccatacttagactgtgttctttcctaggtgatctaggtgattatgagtgagttttgtttcgttttccgcgcgcacgtttcccgaacttctaaatggtgcgttttttgcaaaaaaaaaatctataggaaagttgctttaaaaaatcatattaatccatttttaaagtttaaaatacttaatagtcaattaatcatgtgctaatgactcatctcgttttacgtatctttcccatctcttctatctcctctcctcaaagccttagagcagttcgctaattcctatcctatgtagttttttcgtctcgtgaaacgatccatgtagtacagctgtcttgtgaaacgatccgtgtagctgtacaagtaaaattgctgacaataaaaatcgagcacacgataataccaccaacaaaggctgcccaagttctcgagcttctcgtgcctcttcgagtcgtcgggatggcaacgaaagcacctctaacttgagatcgcagatgtgatttagttgctggtgctagggtggtgaaaaaacagtatcttattttaactccacctctccacacgaaaaaatgttacccattagtgcgtgattaattaaatattaaaaaaacttaaaaaattattaatataaatttttaaaataactttcctatagaatttttttaaaaaaataaaatgtttagcagtttgagaaacatacgtgtggaaaacgagtagaagttgggaaagtgagggaaaaaacacaaccacgctatacaatgacatttttgtgattaatggaataataactccttcctctacatcgtgggatgcgctcgaatcatacgagagagagagcgcgcgcacgtaacagtataacccttacatttctccctactctttcaactgtctgatgaatcctgatagtattaagtgtagcaatttcttcttggtggatcctgacaattaaccaaaaaggaaaaaaaaatcagtacttagattgtacagataggcatacaacataaactaaagttgatacagtcctttcccgcaaaagaagttgataatagtcctgtccataccgatattttcgggttttttttttacttattttctcctcgaattgttgggctagtttgcaaaaaaaaagtacttagattgttgggctagtttgaaaaaaaatcctcgtatatattcaaaacctttcatagttgtgtttatttttcgaaaaaaaccttgtctataatgcgaagagaaaatctcatttctagtctagaaataacgcaataaacacgaaaagtatataaaattttccgcaaaacaaccatcgttggagatatagggtctgtggtcgtgttgtagatgacatcaatagtgtcccacacacgcagcggcggtgtagccatagctgcctgcctatcgatcaggtccatatttgtgtttctgttgaaaagtttgagaaaataaggttaaataagttagcacggtcacgttaccttcataaaataggtccagcagaccagcttttcgttttttaaaaagaggagcaagtgagctacaactcgaagaggcatctaattcaaaatagggtcgaaagcgtagtgcaagaaaaaaaaaagtttgaattaggtacctacttgcgccctgcgaaacctccagagacgtaaagttaacgcaaacgtttgaacaggctgaccacaggattaaaatcgaacggtcaatactgccacgtaacagcaaccatcagacaaagatcggacggctaggaaggaaccctagcacccgtggctgcctatataagaagcaatcctctcgccccaacccctcccttctcccgtctcatcccagccgccgccgccgcagcctcctcctctcgtcttctccttcgaggtcagcttcagatcttctctcttctccatatttgcgcttgttcatgttcgttcgtagctgcagatctggtttagtaacgtgaggtttcggtgatttcgagctggggcatgttgtgttcgcccattttttgtaacttttttctgtgtattcatctcactgcaatgatcttcgtctgctgttcgttgacgcgacgataaacttgatttgtcagtgaatcatctgcataggttgaaaattatcggcagaatcggacgatgaacttgatttggtgcagaatcatttacataagttgaaaattatcggtggaatcactagaaggatttttatctacaatccgttcgcatagatctctttccgtgtttctgtaattttttttattctactactgctgagtagatgttatcgtctgtacccggtttggttgggtcgattactgcgcctctgtgcaaatcatccgccgattagctgcgttagcacttttatagctgcccaagtttgatctgtgagcttgcctgctatatttatttagagttgtaaattatacacttatctttgtttctaatatttgtttcgttctgtgctgcagttgttagctccctccttattcaaccatgggtaaggagaagacgcacatcaacattgtggtcattgccacgtcgactccggcaagtcgaccaccacgggccat

SEQ ID NO: 42980 - DNA, 3841 bp, Oryza sativa
tggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgagcatcgttgaagtggtggttatgctggctgcatttgagatatcttagcgttcgttaagttttgcccacggccatggcactcgttgcatggaccgttaatatctgctcgcaatgtgcactatgttagtcgtttaaaactcgtttatttctattcggttaaaaacttggatgctctgagtcttattgttgcccttcggttgttgtggaatgcgagtacttacagtgctaaatcctttgctctttattttcgattgtgctatttggtgaaaactgaaagctcttttgcttggtgaaatctgaaaactcttggtacttttgaaatctttaacttggtatttcaattgtagagattgaaaactgatacctaatgctacccaacggtgtttaattgaagctctttttgttccaaattttgtgctgattggaacattatttaggcatatgactggatttcgcttaaatatgaactgactgttagtagtctttatcagatacatcgagtacactcgtgtcggatagcagctatgtaaactgtaccatcgttgctctaataacttttcaatgaaaaaaaatcaagctctaataacttttagtcccccatgataatgttttggggccgtggcaatacaacacttgggtgatttaggctgtatgctatatgaacagttgacaaaaggctaacttgcttaaaatctatacgtatggacgcttgcgccggagttgatggtcactctatgatcctgtacatgtgtgcgatctcaaagcagttcgccaattccatcctacggatgcggcgatatgcaaactggaccaaatttgatgcggtctgcgagcaaatttaattcagcctggagttcagatcttcccgttgtttttccgtactctgaaatgatccatgtagttgtagaagtaaagaattgctgacaacaaaaatcgagctcagggccatcaatccccctacatgataccatcaacaaagacaatattaaagctcataattttaagataatggtgggatgcaaacaaaccatacggatactgaaatggtggagatgcatacaatagcggtatattgtacctgatagagatggtgtcatggcgaaatcaaattgaggcagcaacaccccggcggcaatagggatagctactatgttatatgcgacagcccaggctaaattttggtgaactttggccatagttgctttcgaaagtgataaagcatccattacctaagccgtagggtggttcttgtttattagcacgaatgccacttgaactatgcagttacaatatcatagagaacagaatcctacctgagaaagtctgtttcctaatagaacaactgaagccgcgtcagaggcagcactctcttttgagtttgttcgcatagctactcccacatcagcagctgctaaagatggtgcatcatttattccatccccaacctatgcaacagcaaattccactaagacaataatacagagtagtttcatccaatctaaaactttgagttagtcaaactttaatttttgtttactatgctcaacatttaaacactctccgaaagtcaggacgcggaataattttagtgcaggcaatttcagtatgccatagactagcaacaactgtacgtgctgtcaataatagataaaagcacatcacagagcattaccattgcaacccgacgtccctctccttgcaatgcagttataatgcctgccttttcatgtggagttaaggatgactttatgttttcacttctgatccctacagttctcccaatgctttcaactgcttctttcctgtctcctgatagtagaaatgtcaagatttcttcctgctggagcctgttaattaatcagaaagggaaaatacagtatttaaattatacagacaacataattagtaatagatgaacatttgcataaaaataggaaaaaaaaaacatttgcaatatgcgagattttaggatgcaacatctttttttttgtggatatcactcaaaagggttgcatgtcatatagagagtagatgcagcattcatagcaaatgtccaaaagtataagagaaaactatgaattctgaatatgtcccgttaggaagatatgtttgactgaattatgataaagcaggagacactcgataaatatacagacagatggtatctgcagtaaatacctgtccacggttgctttggcatcatcacgcagaacatctgatacagcgatagcacctattattccttctccctcacggccaacataagcaattgattttgagtgattagatgatgcctcactggaagacacaaactctagatgatttccgagatctgtcagttcagttgacgatgccttggtctcaaatcgattgtggacccagtccaaagtgcctactgcaaccaagcacccatctacttctgccaaacagccaaaaccaggctctgtaagttgaccacttgtggctgggatatctagtttgagaagttcggcctcctccattatagcatttgcgataggatgcaatgctgttttctccactgcagcggcgagacgaagaatctccgcctcctcatatgctaaagaagctatagaagtaactactggtcttccctttgttagcgtccctgtctaagaatcacaatacaaataccaactgtaacacaatacttaattttgaggagactagtttagcatgaaaaattaaatgatgtatgtagtgtgtaccttatcaagtacaatggcatctattccagctaaacgctccaaaacatcaccccctctaataagtagtccccgtttagcacctagtttaagataaaaggtagttccatgagggttagcagctcataaaaagcaaagatcagagaaggatcgcaacaaagtagcacagtcaatatgctgaattgactttagtaatgcaagggcctctttatcgtatttatgatgtatgagcatctccgaccccattgtatcagccaaatatcaggaacaaacgaacccaaacattatgacatagaaagttacccagtgaagttcctatcaaaatagctgtaggggtagctaatccgagtgcacaaggacaggaaacaacctgcagggtgaacattatgagatcagcccaaaaatcataaatgcaggcatatgcaaatagtgcccttcatagcccacaacttttcaaccaccaccgtccatcgaacaggtatcgtattgagaattcaagatgtttggcatgtacatcaatcatgtaggatttcaatgatgattagttagtttgtgcactg

SEQ ID NO: 42981 - DNA, 73079 bp, Oryza sativa
ttaataagttgaacaaagaattctcacatgagcctgtgtactttatgagagagaggggcagggagttaaaattaaacaagcgtaaaatggacaatctaataatttcactgaaacatgtttagttcttttgctttgtactaaaagcagggccttgtgcctcttatctaactgaagcatgtttagttaaaaatagcttcgtcaatcaatcaaagcatggaaaagagagtgaatagcctattatttttttggtcaactcacaatagcttttgcattggcaacatgaccatggatgaaaaatatacatatgacaaagagatcagcattttaactaagaatacagtttttgaaatgaaagtaaagcttaagagctgacacaagctaatggaattatagaatgtggagtaagaattccaggcagaaaagtatgcacatacccagtttacagttccagcaaatacaggaaaccctttttccttggggactggcaacgattccccagtaagcattgattcgtcaacaaaacttgatcctccaaggacatttccctaacagaagatatgtcaaataattacgtgcaagaacaaactgatgtagtaagaaaatgcaacagaagaaagacaagtgtgtccaaccatcagtgaactagagcagccttctagcattttcacctctacaaataaatcatgatatgaaccttaaagggtatagtactataaaaatacatgatcaaaaccatgagtggacatacaaattttacaaataacagaggatatccaagtttgagaaagagagagagagtaagcaatctatggtgcattcattgaagacagataggcattgctgataaattgtctaaaaataactaataaagaagagggaaaaggagatatattcaaatgatctgagcacacgcaattcatttgtaagattacttcactatatgaaattaatagtaacaaaaaaggggtcagtcaaacttaggatttatgcatattcaaagaaagtactataacataaaaccagtgtggctccttacatctacagggattgtttctcctggaaggaccaatatgaagtctccaacacgaacatcatcaacaggaacctcaacagtgattgcatctgaattcaaaacaccatctgaggatggatcgtcacttgaggaagtaacgaccaatcttgactgaggtgataagagtgactgcaacagaataaggcataagtagttgccacttgccaacaaattcagtcttataatgaagaacatgcagaactgcagataaattacttcactaccatcaactaccactgcaaagtttctccaatagtgtttgagggaatacatatttacttacttttattctacaaatgaaaaataagtgtctctgtaaaggaataaggtgtatacttacaacgagctcattcatatcgctagaagccttaagcctggcactttcttcaagagatcgtccaagaagcacaaatccgagaagcatgacctgcatgctacaagaaaagtttcttcaacattattatgcaaaacatattcaactgttaattcatcaatcaccaaatcagttcaagtaatgcggtaggaagtaattaggtttatatttgaacaattcaacaacacaacgggatgccatattaacaatacaccacaacatagacaaaaggcagacaacattgacaaacgacaggagtgtcaacaagaagatgaaacgtgcgtgcatggaagatcactcaccggttcatcaaaaaaggttgaattccattccagttcagggttcagcaaggacacctgcataaaagaaaagctgcatcagtattcttgtatgactgacagacgatttgggcactgcaaatgcacttactgaactgatagcaaatgccgctgcagatccaaaccctacaagagagttcatgttgggggatccttgcttgaatgctcgaagaccatcaaaaagtatatctggtgttacattgaacacattttgagaaaaggataaaaagcctgaagatacacattgcacggtcatgctgaaaatgttccagagtaatgtacaacacatctagttcttcatatcatctgccattctgttgtttcttaggaggctttaagaatatgtctcctttactacccacccaggcacccaccaacccaaacaaaagcccgtgaatcgaagtgatgaagtatttttcagggcaaacaataaggaaatccttgttgtgtacatacattagaaatatataaaaaaacaaaggagtgtttaccagagaaggaatgtgcaatctcccccatcaagtaaggctaccaaattttatctagccatgactgccatctcagagaattcaatgatcatatcaaggatgactacatgtaatggtatgagttttcagcatctcgtgtcagacaacctagtgacctgcttgctgctattgagttgtctatttttcattgtttagagaattatattgttcttaggaactaagttaatttggtcaagttattgctagtccctatctggtttgatacccaaaaaactgtgtagaagcctatacaaaaaaaaaacagtacattactatactatacctcttccaggcccaaacaatgccgctattgcaatgccacatttcacatacgaattatgcaacagatccaaaaacgttcctgcaccatgcataaaccgatcagatagtgatcctagtggaaaaacagttcaatatagcatgtgcatcagtggccaatttagactttcactaaacttcattcatgtccattcatctattgcacaaacgccacacaacctgtgatcacgctcccgtggtttgaactcaccatggccgacgtggatgccgagcgagtgtaggaaatgggttgcgtgcgagccgcagcagagcgcaacgagcgtccacgcgaaggcgacgcgcccacggctccgcgtgaggagctccgccttcctggccgccatctccctccacttccgagcgctgtcgctagcccccgaggccgcgccccctcgccgcgccaccgaggggaacccgcactccgtcagcctcgccgccagctccttcccggcggccggctccggcgacctcagccgcacggccgccgactccgcgaggaggttgaccgccgcggtctccacccgctcgtccgcggccaggatggtccgcacccgcgccgcgcagccaccgcacatcatgccgctcacgtcgagcagcacggtggcagcatcactggccccctctccttctcccgccgccgcggccgcgtcgaccgcgctcgaggccgaggcggagggatcggccgtggagcggggggtggccaccgctgggccgcgggggaggacgacgaggcagaatcgctgcgcagtcgaggccttaccacaaccgccacctcgacccaaccggagacgccggagcaacagggggttaacgccgcgaaccggagcggtgacatggaggggggaacggctagcggtggcggccatggaggcggtcgcccgcgagcgcggtggggaagcagctagcggagaaggattaagcttaggtgcggaggagggaggaggcggccatggaacgcgccggacgaggagtggtgggtggtggactggtggtggtgggaaatgcagtgcaggggaggagaggggaaaatgtggtggtggtggaggaggaaaacgggggagatggcgacgtgtgcgagggatgaggaggaaaacgggagtaatctttgcgagtcggatggatttggatagcaatctgtcgagacgtttggaggttttcgtggttgaaaacgtggtgggcgtgacgcacgatgcagatccacaaagtttcaaactcccatgtggctttgcaccgtatcgctcgcaatgtgccggtgaaactcccgtttattttgatgtaaaagtaagtttgcggcttacccaagtaccggtgtgtccgtgcgtaggagcatcgtgcgtcggtgcgtgtcatgttgctcgatcgcgataagcaacggaagctgcattctcggggtagacaatatattgtcacgaatcacatactccgtatgctcgtatttcatcgataactcagtaactcacaatatagccttgtcagtgtctaactgaccataagcattgtcagttgtcaccttgatcattcaactggattttcgtatgagatgtttgcgttgtaataacacctctttaaagaacatgtagcttattttttaaaaaaatcgtacatcgttttgatctatttacgagcgcatatcatatctactttttttttatttgagacacaactaaatggtcgtggactcgtgggcttgtggctcatcagatacctcctttctttaataaataacaccattgactttttatcacacgtttgactatttgacttattaaaaaaattatctaattttaacttattttgttgtgagttgttttatcactcaaaatacttccaacatgatttatatcttacacattttgtataattgttttaaataagatgaatgattaaacatatttttaaaagtcaacggcgtcatctatttaaaaaataaagggagtaattggtgcccactaataattattacaaactacttctccgtcaaaaaaatcctaaatatgtatatggacaacatttatatccagatacatctcaattggactttttttttaactgtgggagtaaaacttaagatacaaatacgacgcattatcatccactaacaattactcatgcaagcataactaatcatctaaaatatgatattgtaaagctcaatatacaagtatatcaaatcatattcctcacattgttttcataaatactccaacattcattatttctatagtatgcaacatatatcatatcttactataaagttatcccccactaatttattaagcttaacatgcaaagatgctacatcatcatccactaaacaagatgtcacatcatcatccactaattaacaatatgtcacatcatcatccactaacaattatcacatttaaacatcatgcaaacatgctatatatttatagtttttataatttaagagctttttaaatacaaacatgttaaattatcatccaacataattcatataatgtttcaatgtatatatttattatgttttatgatatcctatatatttatatagttcatcctcacttagttagtgcttaaatgattaaactatggtccaaattatctttctccttttttcctctaattaatttatatcacatcaattgtttttagcatttagattattaatctacggtccaaactatctcccttcttttcttcttctataaagtcataccaccttactttttacgtttgaatcaccattctacatactatttaaatttaaattatcataaaccacattaatttacttaatctgttgttatccagctatcttacacgttattttttatttctatcataataaattcccacagcaatacgtggggtttcacctagtttactcatacaatttgtaacaaaacgtgggtatcacctagtaatgctcgttggctaaaactccaatattagagggtgtggatagtgattgagtgggatttaggtcctctcactaccgcaataaatgctagtgcaatctttcgtagctacaacactcgctattggattttgaggcaaatttcacttggtgctcttgccatatcaattgatatgatgcatacatcacaaatcctaggtgtatagtgtctctaatggtgttacggcagaggatctcatttcacttcgatagatctccgcctcctattaagtagttcttctattaatgtcatcgctaatataatgttctaagtggctcctttgacaagcaatgtcgttttatcctttacatataaccgatggtaaaataatttcaaatttaatcaaatttttacagcagaaatagacaattaggaagtcatttgagcttgtctttaagtcaaacttctctaaacttaactaagtaaatagacgcaacaacatctacaatatatgttctacaatatacttattttgttttgaaaatgttactaagtttttatttaatttaatcaaattaaaaaaatgacttggagtaacaaaatgagcatttccaacacaaaagtagtactagttcagaaatactagaacgtaccaggggcaaactccaaaacctcccatccgatcacctccgtcccgaacgttatctctaaccccttcgtttcccacccaccacctctctccggcgtgctcgctcgcacacagtccccaatggcctcccggaacgccgacccgccgcgtcaccacccctcgacgccgcctctcctcctcgccatgcgccacctccccttcccgggcgtccaccggccgcgcgcgctccccgccccggacctcgcgcccctcgccgcccgcctcgaagagctcgctgccgccgcggccgcgcacccgctcctgaagccgctcttcgccttccactcccacctcgccgccttctcccaggtaggtcgacgcccgcggcctccttgagctcgatcacacgaacagacgtgtatgtgcgagggttgctcacgacgcgcggttgttggtggaatgagcagagcaggaggcgggcgatggcgacgatgcgccggcggcggacgacgggcgagtgcccgctgtccggcgagcactgcttcgcggcggtgctgggtgactccgtggccggtgtggtggtgtccagcggcatcaacaacttcctcagcctgtacaacaccgtcctcgtcgtcaggctcgtgctcacctggttccccaacacgccgcccgccatcgtcgcgcccctcaggtacatagtactcgtatgtatgtatacagtagctacgcacacggcgcaacgtagcactttagtgacagtgtttatggagccaacaattagcctggtctaattcagaaaagaaactcaaaaacattctccctccgttcataatatagacatatagtgcatattttcgtagtctaattttaagcttagacaaatcattcaatccaataaaaatgataattctgaattcatatcgaaggtactttcttattttgtaactgcaatcaaaatagtgcaaaaaaaaaagtgcattgacacatctgactttgtgcagcacgatatgtgatccgtatctgaacattttccggggaatcatcccgccgctggggggaacgctcgacctgtcgcccatcctcgcgttcctggtcctcaacgccttgtccagcaccgccgccgcgctcccggccgagctcccggacccagcaccgccgacgtctcgcggcgcaacctcgtcaagctccgtgctcaccgcaaaccggaggaaatggatgcggagaatccgcccggtaaaatcgcaggaaggagaggaggaaatgtgatgctctatctaggtgggacttcgtttgaaccagtttggacagatggaatcgctgtctcactgacatggtggccatcagactaagagtctgggcatgttcagacgcgaacgatcatcaattaagcaggcggaattgttttggttgtgttgcttcagaagatttttgcttgtacgctgtagaatccatcccattgaggcttcgtgttttctgcatgtatgcagaggaacaacctgcttgactagtttgacatgttccagtcttttggatgagtttgttactttgttgatgaatcgcatgctcactgtttatactacatcacagcagtacacgaagcatttttattctgtatgcatccagtgaatttgattttggagttgttattaggctattaacatcgtacatcacacttcaagcgtgcccctcccccccaaaattcttttcttgtatttttaagggtcatgggttttctgcaaagctgaatcaaaccagtcgaccatatgtatctaatgctcgtttgaaggggaaccttgagatccaagcaagaagtccaacacgatcttgttgaaccgatccgggtcctccatttgaggcacgtggcctgtcttcttgatgatctccaatctaacatgatctcccaagcagctgcaaccgtcataagcacaaggaaaaaggttaatctgcagttgcaaattttgtattgctgtgaattattttacctcttgacagcaaatgccttatccaaggggaatatctgatcatggtctccccagataagcaatacatcctgagccaatggtgtaagctggaatgcatccgtgcccacagttgtagcattcataagctcgatcttctcttccctcttgtccgaaaaaagtttctgcaaattgctgaaatgcaacattagtgtgtttgctagcataacagtgcacccaagctatgaaagaaacttgtgctctgcacaatgttcaaaatataaacatgagaacacgaggaattcgctggaattttgagtgatttatatggatccttcgtcaccttcatgatgtctcggatcacgaagtccggtagcatggcgccggcctgcttccggtagaaggtcagctccatgagccggcgagctccgcgcgcgtccagcggcatgagcacgtcggccgggtgcgtccacccgctgccggcgcgctcgaggaacgcgccgtcgtcctccgccgtcttgagcaaatcggagttggatatcgccacggggccgaccctctcgggccccgccttgcgcgccatggcgtaggccacgaacccgccgtagctggtgccggccacggcgacgcgcgccgccgtccccacgagcgccgggagcgcgtcgagcagcgcggcggcctgcgccgactcggacggcggcggggaggaggaggaggaggaggcgccgaagcagaggaggtccgggacgatgatgtggaagcggcgggagaaggggcccacctggcgccgccactgccacgtcgccatggggccaaagccgtggatgaggaggagcggcgggaggcgcggctcccccggcggcgcccagtagtggatggtccgggcctcaccgtcgccggaggtggaggggagcgtgacggtgctggggcggaggccggcggcgaggaaggcgcggcgggcgatgtactccatcagcgggatgacgccgaagcccatggtgacttacgtggacgtgatcaagtgatcgagacggggctctagtagagaaattggatagtagcaggtagtactagcttggcatacgctgatacgcaacgccgccacggtgagatgcatacagaggagaaggaagagcggtggggtgtaaatgtaatgacgtataccaccctaaccagctctatagctgcttctatagagggctgtatacatagggagtggattttaatcctgggtgggacgtcccctcgtatatttttcttctaaatttgatacaaataattataaaaaaagcctataaaaattaaatgtagagtatagttatatctattggttcataaaaaattaagttcaaattcgatctacacaccaagaaactaaaaagacatattcaaatgtgaacaatatatggtactattcatatgttaaatttgtttttttaatctcgttgtgtgagttgagttttgatctaagattttgtggagttgaatagagtgttgtataagtattgttaaatttttctagattttttcataactatttggattttttttttgatttttttaagtaaacgagggatattccctcgagggttcccctatatatgcttatttgattgatgttcaccagaacttttggtgatgtgataaatttagtcattgtttggtttgctattagaatcttgagggtgccaatctatttgaagataggatttttggtaagcatgttgatatttaaaatcttcacatcaaacaataatcctacctactctttcaaagttttgatttaattcagcaacagatacaaacgagatgcaccaacattaccaaaacttcacagaatttagcttactgatattatggtaagctaaccaacatttgccctgactctccattgactccattcaatgctttagatggctaagaaaacaaatcaacaatccacccattttctttaattatttctcaatgtgcgttctcaaataattcgtagtacaaattttagctatgaatggacgaaggtggctaaccatcttatttcaatcaatcaaatattcgagtgggcatccgacttattgcgatgcgccatttgacgaaggatcaggcttgtgagtagccagcaagaagtctagcaggatcttgttgaaccgggttggatcctccagctgtggagcatggcctgttttgcttatgatttccactctagctttcccatccaaagaactggacagagcgaattttgtgcaggaaacgtcaatccgtgttcagttaaatactgaaatggaagcttcgtactagtatgttactatccattacctctgaactgcataagccttctcaaccgggaacaactgatcttgctctccccagacaatcaacacttcctacaatgccaatgaaacatgaaaggtttcagctacggtaagtgtcagtgaattcactggttgaaatactgtaataagtctgtcacttacctgagatattggagttactgggaacttgtctgtgccaactgtgatccccttgaagagttgaataagttgctctctgttctccgtgaaaagtttctgatatagtagaagataacaaaaccatctatttcagaggacagtggcgtttggctacttctgtgagtaatctgaagttctgaatgatatactaccaatctcaacaaacatgagctgtgtaaactgtagcacccgctaaaagtagttgggtattattgcagtgtgcatggctttgcctcttgcaaatggatgctagattcattacttagctgtgagttgtcgtcatttgtttagatgccagtgcaagttcaaaaccaacattttttttacgagaaccgaatatattactgtgacgatccagccaaatcgctggtcaccagacgttccaggcccaggcggaatatcggcccagctggaaatgttttggagattgcatcccatggctgccaattcatgcggcaccttgttacattcccgaggacagaaattaaccgaaaaagagagaaaacaactggaaattacatttttggcttactactgagaacagaaaaaaaaagcaactgcgtatttcgatcaacagttgcatattttgattcatgcatttcaaccgtcagatggaaatgacaggatatataatcttctactatgcttatttggtactccctccatctcataatataataagttttagagttgagcgtggttatattaagaaagtagatagaagtaagtggtggagggttgtgattggatgagtagtggaggtaggtgggaaaagtaaatggtggagggttgtgattggttaagaagagaatgttggtgtaaaagttattatattttgggacggagggagtactactaagagcaaggtcaatagtatagccaactattagctccaaaacatctatagccaatctaatagatcattcatacaatagttaaatataaaaatatactacaccattaatatctggtcccatctctcatacacacataacattttggagtctgtgttgcagccggctacaaatctgtagcccgctttcttctctctcttcacttttcttctcgatatatggttatagctggcttatagcctgctattgtacctgctctaagagcaagtttaatagtatagcccactactagctccatatcatttataactaatgtaatagccaattcatacaatagttgcttactatactattaatacctggtcccacctgtcatacacacattacgtcttggagtccgtgctgcagctggctacagatttgtagcccactgttcttctctctcttactttatctctttaaaatattattatagctggcttatagcctgctattgtacctgctctaaatggtaggagtaatttacatggttgttttcaacatgattttagtaagattatagatatattgttggtttatgtctctttgaatatgtgttggacgagtgtgattttgtgcgtgtaatgttatgcgttcttgttcatccggcgtttaattaaattaaaaaaaaaacatgtttgctctccactgtcagtcttcacagttcagagcgtatataaaaatgcgagcagcagttccacggatcgaacaggaacatgatgcccttcttatactttttttttaaaagaaatccaactttatgctacgtacgagcgattcgagacggcctagtttttgaattgtcagcgcgagaagtagtgggagtggtttcagttttgacctggatgaagtcgcggaggatgaagtccggcatcagcaccggcggcggcggccggcacgaggccatctccagcagcttccgcatcgcggcgggctcggccggcaggagcacctcctccacgccgctccacccgtcgccggccctcttcaggaacccccggtcgtccgccgccgtcttgagcaggtcggagctcgcgatcaccacggggccaaccctcccggcccccgccgtgcgcgccagccagtacgccacgaacccgccgtagctggtccccgccaccgccacccgcctccccttcatccccggcagcgcgtccagcagcgccgccagcgccgccgcctgcgtagcctccgacggcggcgaggcggcggagtcgccgccgaacgagctgccgccgaagccgatgaggtcgggcacgatgaggtggaaatgccgggacagtgggcccacctggcagcgccactgccaggtggcccgtgggccgaacccatgcacgagcagcagcggcggcagcagcggctcccccgtggaggcccagtagtggacggtgcaggtcgcctcgccgccgtcgcccgggtacggcagcgtgacggcgccggggctgaggccggcggcggcgaactcccggcgcgcgaagtagtcgaggagcggcacgaggctcaggctggcgcccatggtggtgatggtcttctccctccactgagctctcgcagtctcgctcacgcagcagcagcgcgcctcgtgtgataacgtctggtcgaggaaaaaacgtaaggctcacacttaacactggtggttgggcgtgtaccaaacttaatcgcgagttaaggaaaggaaaattccggttcgttagttggtggtgggcttctttgaatgggaggcgatgttattgacggggttaaggagagccgtccgtttggtgagggcgggctccatgatgctgacacgtgtatatcgccagtggtgcattgtactagtactccgctagtggaggtgagagagtagcggccaagggaagagattgccgcactggccttctcaacaaaaggagaaagatagtcgtcaagtgaaggacagcatgagattgccatctgagctgcactgtgctaaataataccaagtgggcagtagcaagcagcaacagattaattactttatcgacctgtcaagaacatatgcatctgacgatctcagaatgatcacaacaataaattagccactttagtggtactgccatctgcctgcagttccatagtcaagaggaaaaaacagagtccgtgagcatcacatttttttattgggagatttcatatttgacaattaatcaatagttcacggtatatattttttacatcccaaatagggtcattacactatcggcatctgaggatagagggcaaatccgggttacagttggattggtttgggcctttccgagagctcctgcttctagtacttcttagcagggctctagtactgggccactcccaacttccggcccatttcacgagtccaggaggaaagacttgatgaagcggttcacttggtcggctccctccaactgcaacgcgtgccctgcgtccttgatgatctctagccgtgacacgtctcccagatgcctgcagccacagccatgcgaaggcacagtgatcactgcttttttttgcaatcaagcgtccatcaattctgcattaatgcggtataccgaagtggtgaaattaggtacttgatgtccaattttacctttgcagtctgtggccgagatccaacgggaacacctggtccttgtcaccccacagaatcaacgttttctgtggtgcacaccaaaacttatttaggctgagtttgagtgggaggagattgagaagattgagaagatacgcaaaacgaggtgagctattagagcatgattagttgagtattaattattttaaattttaaaaatggattaatatgattttttaaagcaactttcgtatagaaactttttgcaaaaaacacaccgtttagtagttcgggaaacgtgagcgcgggaaacgagacaaactcactcacaatctcctcctgccgaaagctcccttagttgcttacaaacaataaaattaaataaagggtccaagggaagatatcgatcgggcaacagtacagaagaagagagagaaagtacagtgtagacacgcatatgacagaatgaagtaatgaacagcattacagcaacagtacgggatgatgacgctttctgtgtggactccgtttgagattgatgactagacaaacgatcatgggatatcgatcgatcagatcacctttttttttttggcccggcaatcagatcatttgcattagagtatttattttcttttgttgagtgctgtgaaagcatggcatatgagatgcacttaaagtacagtgataagatgggtgtgattttaaccctaaaatcctgtgttcaattttcaatgtggtgggacgtttctttctctaaatctcgtttttaaaaacatgatatatgtatgctattttttgaaaaaaaaattatccggcctctataaccatattggcgtatgtatgtatacacagcccatacactggaaatgtggatgtggcatacctgagtgagaacggggaggggatcgatgccagctccgttcttgagaagctcgtgtagcagctcggccctctccttcctctgaaccacgcacatcaactgtgcaaaaaaaaaaaaaacagagtcagtacaaaattacattctgacatactgaaatgccatatatctccccgtttagaatcgagtccagttcgaactgcatatgtcctgaactcctgatcaaatgctcatcgttaagggagggaagcacacgtgagtcccctatactttttttaatgcaatcagtacgagattgtactattttattaaatatagcggtagaaaaatacaacctctaaagaaagaaagaaaaaaaaaactatacagactatacgtgtggagaaagaaactcgctatttttttttgcttcagcgagaacccaagttcgtgcttcttccttcattttagccaacagcctaggaaccactctttatatttgaagatacgctgatttctctccttccaaatctcccaaacaacaaaaaggagtagagtacgcattgatctgctgattggcgaccaactcggaaaggggcacacggctgatagaggtgggtgcacatgcaattcattgctcgatccaagcggcgtatcccatgtaggatcgagttcatcgcgaagatcgtatccctccataccgagggacattctatcgtccgtgctagttgctgatatgtcccctgcatatgctctgctcttggagttactatgtgctactgtactttgccgttgtatacattcagtgcgtgcaccagctggcgtacgcgcgcggtcgagagctggtcgttcttcgcttcccccacccccgacgttattacgcacggcggcgcacggcatggcgtcttcatcttataccctttgacttggtcggatccacgtcaatggtgtccatacatggggttttgtttgttctgttttgcaaagttaaaatgaggcaaagctttttccctccattgaaaaatcaaagaaagttacgagaaatgtgagatcttgtgctacaagttcgtgtagtgcagattggtgctgtcgtgttgcaagcttgcaataagaaaaggttacgctttcaccgtcctagaccagctcgaatcacacgccaaagttcgaggccatactttaattggagtgcttgatcggtgttacatccaccaaaaaaaaaacaaaaaaaaacaaaatacgagtaagtggcagctagtggagcagcaacattattttggggctggccctcgcctaattttcgagtcgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatacaagttacactgtagttacatgcaagttacagtgtaattacatacaagttatattgtaattacactacgattatactataattacatctgtcaaatttttagtagaaaatttgtcgacaaatgtataggtggtcccttttcgagtagtattcctgaagacgacacgtgggccacgtaagggcccagcgcccatgacagaatccacgagatttgacgtaacgtacggcatcaccgccacgtcagtccagatctaccggagcactttacctttacgtgcccgtgccactctcctccagcactacacgtgtaggagtactgaattgccgatctatattttactctagtatttttcaaatttgctactaaatgcaaatccaaattaatctctggtggtgccgtatggtgctgtacgatctgattctggaattgctcacatgcaaaggatagcgtgttctactctggcttaatttggatgtgtccacctgaccatgcaatttatatggcactgttatcaattgttctcgcttaattcctgctaccatgtttggcctaactttatattcaaactcgtggagatctcaattaggcttatacttaaaagtcaaacgcatatgtatatacagtacgatctaaacgaacactccagtctaagctggagtttcgtatataaactctactaacctcgctcgaccggcaagattgctcaaaaaccgatcaatgtacatgtttttcgtgagaaagaaacttagggggttctgcatcacaatccggcacgtgcacaacacatgcatatacgccaccgtacaaagagtgcaagttccccgtactgtttttgtaccaattaacgaggttttccttaagaggcttgttccattctatcagtaagtggaaatgttgcatgtgaatcttgcaggaacaattaaattgctccccaattttaaatatacgtcactggtgatttttaaaaacaagatgtttgcctgtttcggattattaaaatggatttagtacaaatataaaaatacaagtcagattttaagtatcttcatatcaatgcaacatactccctctgtcccataaaaacgaatctagaatcggatgtgacatattctagtactacgaatctaaacaaatgtatgtcccattcatagtaggggcatctgcaaatttgccaccggttttttcaattttgcaagaataccacccgaatgatagttttagtgatatttttgtaattttctagtgacagtcttacaataacaattatgttatatatggtactagattagttttttatgagacggagggagtaaataatacttgtataattttattaaataagataaatgatcggacaccatttctaaaagttaacttatatatttaaaacccgatgacgatactatatacaacatcacgaagttaaatttgtcccacatgatttttattcattttcttatcttgatgtttgagatagactaaaatataagataaaattagtgcatgcaaaatgaagcacatgtaagttttaattattacaaacataaaaataacttctatttgctaatatttaaaggcagcttctatatgaaaagttattttaagaaaatagcgtttgctagtttaaaaaaacgtgctaattatctgacgctaatttctagctaaaaaacgtgctaatgaaaaccttggtaaatacacatattaataaaaagaaaagaacggggcctgtaattaagacaaggctttagtagtgaaagttaatcgtgccagttaattatttgaaaacggcaagatgtactcttgccttgcacaggctagtcattattggatggattagcgagtgtggtagtaggtgctggaatgtgctgagctgaagcaaagcacgtgcatgctgagctagcgcgcatagcacagcatctgctcgatccatgggagtagcaaacaaaactgcgcctaaaaaaccaagcaaacacacaagacgacacgggccatcgatcggacagaggcaaggcactgaccttgatgaaatcgtcgagcacgaagtcgggcatccatggcggcgggcggtgcatggaccggcggacgaggcggcgcagcccgtcggcggtctccgggagcagcgactcctcgacggccctctcctcccgcgccgccatctccctcatctcccccggcgtcgccgccacgccgctggtcatcaccaccaccctcggcacccggtccctgccctccacggcggccagccggtacgccacgaacccgccgtagctgatcccgaccacgtcgtagcggtcgacgccgaggagccgcatggcctcggcggcgcaccgggcctggaacgcgacggtgcggagcggcgaggcggatcgggagtgcgcgccgaagaagaggaggtcgggcgcgtagacgtggaagtggcgcgacagcgccgggaggttgcgcgcccacgtccacttggagtcaccgccgaagccgtggaggaggagcagcggcggcttggcggacggcgccgcggggcaccagacgcggaccgtggtggcgtcggtgcccgggaggcggaggtggacggggcggatgcggaggcgggcgaggaagtggagggacagcgcggcgtcgcggaaggcggcgaggcggagccgcacgaggaggacgagcagccggaagagcagcagcgacagcgggagcagcgcgaagagcgccgaggcggtggcggtggcatgccgctgcttcatggcgcggacacgcggtgcactgtgcgtgcacacgacgagcagaggccgagaggggtgtgggtgtcgaggggcagagaggatgatggcctgccgttgctattaatagcgggctccttggcttcacagaaaaatggctatggatcgatggatcaattagctcgaccgcggagtatatacaattaaagaattggctttgattctgttggaacttggacagttggagtgttgggataattcaaaactcccttttgcagtagtttccagaaaataaaactctctgttgcagtagttccattaatcatgtactctcttgctccaaatgatctatgtggtgccttctctgtctcagctaactacatctggagggcgataacatattagcatacatggttaatttcatcgtgcgacatgcttcgtgcatgccttgagctgctatgtcaattacctcttcaaatctgtgtgtactctgcactggcatcagagccatcaagtgcaagggaccatgcaggtacagcggcgacacccagacagggactcaacgaacggtgaggagcactagatcattcgtttttgatccgataattggcaggaaactggtgacaggctgacagcgctctgcattctcaaaataatgatgtcaaattggtctcgatcgttttgatttgtttaccctgcttgttttgttagcgcttcatggcctgctttttctctaatatgtcaaaacgatttattagaaaataaaaatatatttataggtaaaacttttatatatgtattcttactgacttaaaaactaatgtaaaaaaactatgctgaaaaaaaaatctcaaaattaagtttaaaaattttaaatataactttttctttgggttaggccatcggatgggagcatccaatgctcttgcctccgtcagacaaagaccacggaatggtatggtcgtctgtgcgtacgccaaacagagtcactgtctattattcacgtttttttttaaatattgtctagtgtttggttctgacttctgagaggtgctcatgaaaagaatcaaggctgtaaacgattctagacttgaggtgtttataacaaaaaaaaaaaggcaatattatactccctctgtttcacaataaaagtcattctagcatttttcacatttatattgatgttaatgaatatatatatatatatatatatatatatatatatatgaatgtattcattagcatcaatataaatgtgagaaatgttagaatgatttacattgtgaaacggaggaagtagtaccgaagaaaatcaaggcactcgttcaacagaaaaaaaaacatcaaacgttggagggaagaagacattgagatataaaaaggttcagattagagctatggcatatgctgtccttgctggtggaaattcggctgagagccgcgcagccaaggcccatgggccatggacaacaggccacgatattggcccatctgtcacgcgcgaatcataatgggctttatccgcacgaatcctagagccttgtcgttggcagaacagcgcacattattcggcgggcatcgccatacaagtcttatactccatgtaaatttgatcctaaataaaccattctaatccatgaaattgatcgtatggagatttagaattcaagtttcctgtttcaatgaaccataaaaggttccattaacgatgaaatcactccacaatccaatacaatgcaactgtgcaagtgcttctaatgtcttcttttgaaggttaagagtcatcatccctgatctttcatggtccaaatctaacagtggacttcctgtgaagttgtgaaccacattgtcaccagcaatacttagtgtggggcaagcaatacttaaattcatcaacaccaagtttccagcactgccatttttttcgtggacgcgcaaaagtttccagcaccgccatcacccagtttactcaacaaatcataatgacttggatcatgaaccatgatttcgtcaaaactagccacgctgttagagtttgtgtcgaatgtgtacgtagttggttacagtttaggacttggagttgtaataggtatgagtcggactctatcctaggttcactcataaatagaggggcatgcctgttgcaaccgcatggcgacttagcatagcgagagggagcggctgccggcatcgaccggccgtgagtcgttgtaactctgatacgctgtatatgctggatcggggaggagcgcccgtaatcagtgccccggagatgtaggctacggctgaactccgttaccaaatatcgtgtctcggtgtcgtcattgttttggatctcctatggcgttttcttccgcgtttagctaccgatgtcgatttcggggttggtttttataacaagtggtatcagagcctgcgggaggtccatggtagaggcgcgatggaggtgctccacactgcgtagcctgctgtaatgcccagggaggggcattggcgcaaggtggagcacggcggcgatcaacggagtcttgatcggtggatcgaacacttctggcggtggccggaaccgtcgatggctgctttcaacagggagatgactagacgtggtgctcaggttgatggcggtggaagcgattggcgatccaatcgatgggtcggacacttcgggcgggtggctcggactttccggtgagctactctcgacagggaggcgtgcggccacacgctcgggttgattgaagctggaggcgatcggcgttctcgatcggtggatttgaacactctgggcagggtggcccgggcctttcgatgagttgcgttcgacggggagatggctagacgtaacgctcgggtcgttcggcggctgggaagacggcatgtgacttgtcggcttcggctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaatcctggagaggttttggttcaacctgtttttccctctagcagacaagaagtaaaccacatgggctgtagatcaatgacaacagttgttggtggagtcgtcggtggtgcttggcattggtgctagatgttgtcagagatacgaagaagcccaggaggtcagggtcgcggcggtgtgcgcgtcttgcgtcgaagccgagcaggtgacggagatcagggcgatgccgagaaggagctggctagggttttagctaggtcgtgcagggttcggtcttgagggtttgtggtgtggaagacacggacatggagtcgtctccggttcagtcatggcacggacacaatcgaagacaagcagtggataccaagtttcaacatgaaggggaatcggatgaggactacgattcgttcatgaatcggactcgatttttcccaaataaaagcagcagaggaccacgggattgcaacaacgcaatcgaaacaaatcacctagcagagggcgagattcgtacccgattttcacagaggcggaggtggtttgggcggtgaggtcacgggcggctggaggcgcatccttgcaggcggtgcgtggcggcgtggtactcggcggcgtccgtcggagctcgagcaggagcttgcggcggcggctgcagcggttctcggcgaggaaccggtgcaggtcttcagcggcggcgctccaaggcggtgcggcagcctcttgcggggccagcggctccccaaggtccggcggcgcgacggctcctcgcaggtcggcgcaggcactggacggcggcgggaggcggtggtggtgtgcggcggcgcaaggcagcggtgtgcggcggctttggcaacgaggcggcggcgcatcggatagggcggcagcacgtgcggtttctgggaggagcgagaaaggccgaaggaggaaaggggatcggctcgatctgtttccctttaaccgcacgtttgactggtttttttactagaaaagaaaaccgaccggtttttttctggagaaaaaagaaaaaggggttggttttgtccggctggtgactgtgcaagtttagtcggtgggtcaattaatcagggcagatcaatttaatagggcaacagctgttgagttgattatcgtcgatggcggtgacagttgtttccaaatttgaggtggtgaagttcgatggcatcgggaattttgttctttggcagatgaggctgaaggatctgttggctcaacaggggatatccaaggctcttgaggagacgatgccggaaaagatggatgttggcaagtgggtggaaatgaaggcacaggcaactgcaataatacgcttgagtctctcggattttgtcatgtaccaggtcatggatgaaaaaacgccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaaacttgatgatgaagacaaggccataattcttctgtgctcgcttccaccatcgtttgaacatgtggtgactaccttgacgcacggcaaggatactgtcaaaactgaggagataatttcgtcgttgcttgcacgagacttgagaagatcaaagaaaaacgaggcaatggaggcttctcaagctgagagtttgctggtcaaggcaaagcatgatcatgaagcaggggtgtcgaagagcaaggagaagggggcacgatgctataagtgtcatgagtttggacatataaggaggaattgcccgttactgaagaagaggaaaggtggcattgcaagtttagcagctcgtggtgataattcagatagcagcagtcatgagattctcacagtgtctaatgagaagtctggagaagcgtggatgttggactcagctagttcctatcacgtgacatcgaagtgggagtggttctcttcatacaaatctggtgattttggtgttgtttacttgggcaatgacacgagttatcgtgttattggagtgggcgatatcaagttcaagatgtatgatggaaacgaggtgctactttcagatgtgagacacgtgccaggactaaggaagagtttgatttctcttgggagcctacatgagacaggttggttgtatcaggtggattctgataggaagaccatgaatatcatgaaggacggcaagactgttatgactggtgagaggacaagctcatgtttgtacaagttacaaggaagtgctgttgcaggtggagtcatggaagatgggcatgctggtgttgctgtgcacgatcctgaaggcggcaagcctggcgtaggctcgtcgggcggctcggcatgagctgtggcagaaccaactcaagtcctggtacacggaggttcgagcaagtaacaaattcaggttggagtggcatattcgccaaggtagagtttgttagagtttgtgtcgaatatgtgtacgtagtcggttacagtttaggacttggagttgtaataggtattaaaactagagtatgagtcggactctatcctagattctctcataaatagaggggcgtgcctgttgtaaccgcatggcgacttagcatagcgagagggagcggctgccggcatcgaccggccgtgagtcgttgtaactctgatacgctgtatatgctggatcggggaggagcgcccgtaatcaatgccccggagatgtaggctacggctgaactacgttacaaaatatcgtgtctcgatgtcgtcatcgttttggatctcctatggcattttcttccgcgtttagctaccgatgtcgatttcggggctggttttataacacacgccttgttccaaaagtatccgtaaaccatcctatcctatatcacggcccggattaggagcagctagcgtctttgcagggtggttctaagtccgagtcatagagtatgtttgcttcttccccatggcgtcttctaccttgagtaagagatgacaaccgtaattagcacatgacaagcaagtctaagctctacacaacactactagttgctcggctagtaaggtgcagcccgtcgttgatgccggctgccaccaagatcagtgcgccagggccgcatgctaataggttgcggaacaggtttagaaatggcccgtggaagatcattcactttccaatcacgaaaagaacctgcaattacagtagtacaattagtaggaaacaagagcgatttgataatttaacacttctcaaaataggattcgattatttgatatactagtccactttcattcactcagatggaccaagcagtactccttcctttaaaagcttaatgattaattacctggacttatcttcaaatactttgacagcgtacaaggtctgtatgggtggcaggtctttctttcaggaccatatagtgcaagcgcttccactgtcttcctttgaaggttaagagccatcatcactgatcttccacggtccaatttgacaatggaactcatatgaaccacattatcaccaccaatacttaatgtgggggaatcagtactcaaattcatcaataccaggtttccagcactgccatctcctaattcacttaacatctcatagtgacttggatcaggaaccatgatctcatcataactagccttgcaaaccttattccaacaattcccataaaccatcctatcccatatcactgtcctccaaccaacaaagcttttaagccagatatcaggatcaggagcatcttctttgcagggtggttctaagtcccagtcatagagtatgtttgcttcttccccagggcgtcttctaccttgagtaggttcttgagtgggttcaacagtaggtatcaaaaagtgctccatctcaataaacttgatcactccacccatacaatgaacatctcgaatcatatgcggagaatcatggcaataattacccggcatgagctctggcagacggatgaaacgtaccacagggtgatcagcaagcacgtcgcagatcaaaatgcccttccaaagatctacccatcctagcaggcttcctccaagctggatcgtcttgtgtggtaaggctgggtaatacttactatcaaccctttcaagattgcaagaagggtccaatggcactgatttcatagtccactgatccgatgccgaggaataaaggtggagagtaaactcacgaatattgcaagaggtgaacaggagagcagccaggaagaattgtccatggtcaccacaccggatgataccaatgtcctcgccgcgattgtatcgtggatcgtgggttgggatccggcgaagagacggcgactcggtgccggatccggccttgtacacgaagtactccttgtcaaccctcccggagaacatccccgagaaggccatcggcatgagcagcaggagcaggtcctccgactagcaggcgacggagggcgcggcggtgaaatcggccgccgtcagggtggggctgtgcacgcacgagatggccggtgggttgtcgacgcagaaggagacctcgacgacgtcgccgtggctcgtcgtggccgtcgccgtcgtggcatttgtgcactgcgcgtggtgcaccttatcctcgaggagcatccacgcgggaggccggaaggcggtggcgaggcgggtttgaatcatcatcgtgtaatgatctaggaactagggttttggagtacctctctagggaagagatcgaagcagctattcgatttatgtacgggatttttttttttgggatatgtacgggaaaattaattttccgatcttgaattattgattgggatttgctacgggtggcgccacccttttctccctggacctatatctactgtgtgtggattttagtttaaaaaactcggcccattccttgtggataaggcccatccaacagcatgtctactaccacgcggcccaaaaagcgcttggttgctattgggcccatgggtcagggtgtgaggcggtttcaccagtcgctagctcaagcctctaaacccttcttctccccagctcaccccgttcgccgccgccgacgccgctcgccgggggctatcgccatgtcgccggccgccgcctcaccggatgatcgcatccggagctacgaggatttcgcgagggtgcacgcgtacctgctggccgcatccgggatcccgccgtcgctgcaccagcggctttaccgcaagctcgccgacgaggtgttcgacggcggggaggccttctcggtagagccctgcgagggagggaggcagcggaggctcgttctcgccgctgagtggactctagggagggagtccgatgtcttcctcgtcgaccacgcctggtccttccgcctctccgatgcgcttaagcaggtactaatactatccctgggaccgtggtttacttctgtggaatcagttgcgctagtttgttgggaagtgattagtgcgattttggcggcttttgtgctgcctagctgtattatggcccataacgtagtgtattactgatgaatgggagcgcaatgacgacattataacggacttgttgatttaatttgtttactcttgtgacttcaagtagggtttatgctgtactattatgccatttacttttatgttggatacatggaacgattttagcatggtccttgctgattgttaatgtgttattactgtgaattggagtattgactagttaagtgagcgcagctacagttcgaactaacttaagagtgtcatagtttttttttttgggtgctgttaacgtcttgtacttattagctttcttatgctggttaataagtggtcgacactgcaaaatcagggtccgttttattcttttcatgctatcatctgatagctatgtcgactgaccaacaaatacacattttgtgagtgttcatttacagagctttttacttccatgagtgctcttatgctcttattttggtgatatgcagttgagggaagtaccaggactggctgaaagaatggcagcattgatgtgtgtggatctggacgagagaactgaacttgaagaagcagatgaacaggacaatgggaatggagggagtttggagagtgccttggaggtagttgagaaagaaaggactagaatccaggagaagggaagtgactttgcagcatggctggaacttgaggagcttggaattgatgatgacatgctaatagctttggatctatcttcaaaatttccggtccgttccctttatatattatttattcatgtttttactttttagttgccgttgtctgcaacatacaccaaaaagttgtttatctgccttatctgataaaaaaaaaaccctgctgtgcatatctttgtagatgatccaatccaataattatggtttgaattattcttcaggaaaagaaactttccagtgttaaagatcgtttcagtaaaaaaaaaagtactaatgtttagtactggtcttgctccccaaaaacattatgactttgagatgtgtatttttaccataatttcatgtttctttgaattttgtgtatgttctgaagttttccttttattttctttgtatgccattagaatatggtagccctcaacctatggggaaacaagcttcaggatccagagaaaataatgaaaggaataggggaatgtagaaggctaaaggcactttggttgaatgagaaccctgcactgaaggaagggtcagaatcaagccttatttgtttttgttgaagttttaattttgttaattctgttgtgaatatttttcatttcaagtttttcactgttatagcctgataagtccaagtaggaaaataactctgggggtcctgatggaagttgaccagcaactagttattgtggaatcatgtagttatctcaacatgattgataggagaaaattgtaacttctgtgcttgaacagaaagcaagtgaacaacatcttaagataattgagatattattttgcttagttatagtatatgtcctctttaatttgaagaataaaaccatcttaggatgagttggttcatcatgaggtcttcccatggttttagtgggatgacttccttcttcatcatagtaataaacatgtactaacaaacataaacttataaaaaaaatgctgaggtgataaatggatcctcaaaccaaacaagtgaccagttttggttgggccattcgccatctcttcttttgtcatgtggcattctgatgtttttttccttaatgttgatagtgttgacaaagttattcttgacggtctacctgaattggaaatatacaattcacattttacgaggaaagctggagaatgggctttaggtttctgtggggatattattggagcagacaatccctgttcctcagcggaaagcataccattggagaatattgcgtctctcgatctctcagataggtgtatccacaaactaccagtggtaatagctataactggtcttctttattgacattattcactaattcattttcttgatcaaaattattcactaatccatttggcacattttgactttaagatgttattttccaaactgtacaatcttgaaatgtggaactcttttgctgataattcccttctctgcatatacaattcaacaggtgttctctcctagaaaactttcctccctgttgagcttgaacatccgtggtaatcctttggatcaaatgtccagtgacgatctcttgaagttaattagtggatttacccagttacaagagttggaggtattaccagcctaactgcatgtctgtctcataaataagatcaccttctttataaattaataagatgattgcaatcaaggttttcatggcaaatttctttccacaggttgatattcctggctctcttggaaacagtgctatttccattcttgagtgtcttcctaatctatctttgctaaatggtatcaatgtggcaagtataatagagagtggtaagcatataattgattctgcacttaaaccacgtctgcctgaatggtcaccacaagaatcccttcctgaaagagttattggtgcaatgtggttatatcttatgacataccggcttgctgatgaagaaaagatcgatgaaacacctgtttggtatgactacttgcaagttgcaaccttttctcatccctttatggagcattgtgcgtaattttaataacttcgaggtgaagttctgctaaaagtttgaacataaataattatgattgtgtcaactagcccctagccataggtaggtttgcctagtgtagatattcacctttagacgatctagaacattgctttgttttcacttttctgcagtcataaatattgaatcgaatggcatgaaaagaaaattttgtatctgattaacactgtgtctactattctgtgggtttgtgtctggttattcatgtaggtatgtcatggatgagctgggttcagctatgcgccacagtgacgatgcaaacttcagaatagcacctttcctgttcatgcccgatggtaaactagcttctgccataaggtattgtccttcgaacttcagcaacatgttagtaatatgtagcttgctaatacccaacattttcagttacacaattttgtggcctgttcatgatgttcatactggagaagagtgcactcgtgatttcttgtttggtgttggcgaggacaaacaacgctcggctaggcttacagcctggttccacacaccagagaattattttatccaggcaagaaacttagtctgtaaacttgtggtgctgggataaacggtcttatcttttgtccatatgtttatcttcctctcccttttcaaccttttaggaattcagaaagtacaaggaacaacttcaatcaagcagtatctgtccttcaagaaaagtaacaccggtgaccaaaagtatccgtccaagtgatggccatgcacttcgagtatttaccgacataccccaagtagaggagtttctaacacgtccagaatttgttctcagtaaggaaaattccaccctaccttatcgtttatctgtttttttttttggtaagggtcaactgtctttagatagaaataaactcttaacttctgtttatgtaaaacattaactttaagcttgtaatcaacttgtcctcctttcccttggaacttcgtttatgtaggaagcattgatgtagcttgctggtgatgcacattatagaacattcatttatctgggtagtttgaacccaatcgtagatgttcatttgagattaaaagcttttgtgtttgctagcactagtttacctaaggaatcagctaggtattatgttttctctgaccagtcccaaaaaaaatattgatagtgctcttccatcgtatggtttacttatatatggtcaccaaatgttcctcatttgtatctattttgtatgcctgcagcatctgatccaaaggaagctgacatcatttgggtaagcatgcaagtggattcggaattaaagaatgcactaggacttacagaccaacaatatacaaatcaatttcctttcgaagcttgcctggtcatgaaacatcacttggcagagactatccacaaggtgagctactgagctgtttagcttagatctgtttttcagggaaaacattgcgtgtaacttatgtcaaaaaaccatacaataaacaccatattctttcaatggcatctgaaaattagcatcaacttctacaggcatggggttcacctgaatggcttcaacctacgtataacctggagacacatttatctccactcattggagattactgtgtgagaaagagagatggtatggataacttatggattatgaagccttggaatatggcaagaacaattgacactactgttactggtgatttatctgctatcattagactcatggagacaggtcccaaaatatgccaaaaatatatcgaatgccctgcacttttccaaggaaggaagtttgatctgcggtatattgttttcgtccgcagtatatgccctttagagatatttctttctgatgtgttttgggtatgacctttaattcgaatgatacttttgatcgatctcattgttcactgtgatacttactaattattttgtgactctggtgcatataacttattattcgcaggttaggttagcaaacaatcagtacactctggagaaaacaagctttttgaatatgaaacccatttcaccgtgatggtatgttcaaatttgattgtaactatacatattatttgtgggaccatgaatgttagttgctgtcaggagtgtataagtagtgtgtgttcagatgttctttcctgttctttaagtgattttatgttctggctttatgcttatgttatgtttatagtttttttttttctaagaatgaaaatgtgctttagatgcctaactatatttcccttccagaattatattggaagggatgttggcatcaaatatcatgtgaaagtctagattctagaaatatgatatatttttttctcagaattaaaatgtgattaggatgcttaactatatttcccttccagaattatattggaaggatgaaccatatgaacacaccagagtttgtcaaggagtttgagaaggagcaccaaggtcagcttgcatttttctctttatattatgcgtgtctagttactgacttctgactaaaattttagttaaatggctggagatccatggacgcatacgggatatgatacgatgtgtctttgagtcagccacagctgttcatcctgagatgcagaacccgttctctagggctatctatggggttgatgtcatgcttgataataaattcaatccgaagattttggaggtatgccttacctactttcctatcctgcaaccgctgaaatttcgttgcctccccctattgttgacatgacatgctgaaacctgcatatctacacaacaattgtagtgccgcggcacatggttaaagttatatagtactgacgtgtgaaagccattgcccatatgcttcactgaactaatgaaagcccttgcgcattctcattttatgcccagctcagaattaatttcagaagatatgccagtatgttgatttagatattcttgttgtagcctcacatacatagtatgtcaggcaagatgtggtacaaaagtcaggaagtaacactcagttaatctctgtttgccacccaagcataagcttccaattgaaatttgactattacatttggaattttatagatgttcagctattgtattatataagcattaaaaccttcttcctagtaattcctctcactgttccgaaaatttataaaatgaaatgcaggtgacatattgtccggactgcacgagggcatgcaaatatgacactcaagctctcgtgggaagccagggtgtcatcaggggcactgaatttttcaatacagtgtttggctgcctctttctggacgagcttaaagatgtatcgccgctgtaatcaccacaacaaggttgctgtaacaccgaagttcaacacaatacacgcacatgtgagttgtgatcctgtcgttttatatgccatacatatcaaatttgctcagtacaattacaaagggggtgtgatgctgcctcctgcctgtaccatgcttcggatcagattgaaatgagcttgacgaatcctcctcctgctgttcaaggttttggttggtcaaaagccagaaagcacgtacctcatgctccaaggcaagctagcccttacctttccgctactcatacccacagtaacttgaaagcatcatcacatggcaacaacattctagacatatatacacaggtagtagcagctactgatatctcgacctaatcatctagagagtagaggcatatactcctttcccgcctaaactggagccaacctgatcgagacgcagccatgcgagcagccgtcgcccatcgaatcctcctctcgctcgccctcttcgccgtcctctgcagatgcgatcccgacctcctcttcgactactgcgtcgccgacacggcggcggcgaccgcggccggggcgttccacctgaacggcctcgcctgcatcgacccggcgctggcacgcgccgaccacttcgccacgtccgcgctctcccgcgccaccaacccggccgccacgctctacggcttcaacgcgacgctgacgagcccggccgcgtcgctgcccggcgccaacgcgcagggcctcgccatggcgcgcatcgacctcgcgccgggcggcatggcgccgccgcactcccacccgcgcgcgtcggaggcggcgctcgtcctcagcgggagcgtcctggtcgggttcgccgacacgtcgtaccggctgtacacccagctgctgcgcgccggcgaggcgttcgtgttcccgagggccatggtgcacttcctgtacaacatggacacggcagcgccggccgtcgtgctgtccgggctcaacagccagagccccggcgcgcagctcgtgcccttctcggcgttccggacggagccgcggctgccggacgaggtcctcaagaaggcgttcaagatcaccggccaggacgtgcagaggatccaaaaacacctcggtggactatgatcgattcgagattctacccatcagattttaggcacaaacatatgatatgagttggatccaatattgaaaccactggaggatattctttgatgctgaatttgttaacacatgctgaaagttttgtcaacgtgattcatgattgtataatatgtgaagtgcaatatcaaaatttgtactctgcgttcgtttatgctggttgggaccctatcccttcagcacggaaaacagaacaacttattatcgcataattaattaagtattagggatttaaaaactttcaactaaagattcgaagctttcaactcaaatttaaaaatttcatttaaaaatttcatttaaaaattaaaatcattcaacttgaattacaaaaccttcaaacttagagtttaaaacttttaattaaaattttaaaaacttttgactcaaaatataggaatcctctctagtctgaacctaccatttgttgtccttggttgaattatattcttaaattatacacacatgttctttgtgattcgatatctttgaaatactgctaccattagttgtcattggttgaattatgttcttaaattatacacacatgttctttatgattcgatacctttggaatactgtgattggataaggataaagatgaatggcgagccgaccacgtcagcttgttagaagagcactgggaacctgggaacgagttgttgtgcgagcagccagataccaacaggccctacgtcgatatcatgagaagcgcattcgggcccatacacttcatcaacgattatatcgtccaacaggtccagaatcaggcaagacgcaataagcttttagaattgttgagataattttatgtataagattgatatactatttgtaagttttgctcgtatatatcaatacaaatgagttcgtacaactattatgttatctcagtgcacaatgtttatccgtcgatcccctgtttccatatcgctattgtatgaagtcatttcctatcatcttattacgttagcatgactaatcaccaggtctcagaacctcaatcagggacgcccgatcaatgctaacaagttcccataaggtctcgtttttttttccaataagagttggatgaagattaagattttcgtagcatgtttttcaaactgctaaacgatgcgtttcgtacgaaaactttctatatgaaagttgctttaaaatatcatattaatatattttttaagtttgtaataattaaaacacaatcaatcatacgttaatactatctcgttttacgtaaaaaacttaatcttcatctttatctttaggagaaaagaataccacctactccatccgtcccataaaaaaccaacctagtactgaatgtgacacatcctagtattttattgtactagaatatatcagatttagttctatagttctagatttgtttttttagacggatggaataagtatcgataattttgaagattttcaaataaacaaaacaagtccgtatatacttcctgatacaccaactcgccaagcaggggcggagctaggtaggatagggggggtgcccagaaacccggttaagaaattgttttagctatagttcatctattttcaccatatatgcaccccctcaatctaaaattaagcacttatatcagtctaaagtagagtaaaacaagtgagtggcacctatctccatttcgttgtagctccgcccctgtcgccaagcggacggaacctcggagggttggaggtaggagtacatatagatggccatctaggccgcccggcccagcatggcccaagcctagtcgtgcctgggccaaggcttgtcaggccggcacggcccgaccgatgcaccgggccgtgccgtgccgtgccagcccacgggcggcatacacggcccaatactactcgggccgtgccgggccggcccgaaggcacgatgggctattgtgctgcctcacagaaaaagtctatatttggtccctcaactatgtgggctgtgttaaaatggctggaaataagtctatttttggtccctcaactctgtgggctgtgtttaaatggctggaaaataagtctattttgtatacatattgtcttgggccatgccttatacgattatataagtctatttttcgtccctacatttttttatttgatcgggccgtgccgggccggcccaccgtgccaagggtgcagcccaggcacggcccggctgtcgggccgggccgtgcttgggtcgggccaaaattgcgggcttcgtgccgggccgtgggccgccatctataggagtacatggatttctaggaattttttttatttatacttttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcaggcaattagatttgtaaattttcgaaacaaaaaattatttttgtaaatattttaataaaaaatgtataaataaaaaaaattcgatttctagcgtgtcgcagctaaccccaagcctccctggcgtctcgcaccccctccttcctgttgcagccgccccgattcgacgccaagcgccgcctccgcctcgatcagcgcctcgtctgcccagatctgccgcatactcctcgtccatcgccatccgtcgccgccaccagcctcccccgaaccctaattgccaaatcctgtgaccttaccgatccatggggatttcctccgcttcctatcatcccccaaccttgcagcttccgtcctccgccgtcggcgcctcccgacgctgcggctctcccgactgggtcatgctggatgaaacagcgtacatctccgaccgccggaacaaatccaccgctgagtcccagacgagcgagggccagatcatccaggtgtccttctggctcgtcgatccgccgggtctttcctacttcactgtccattgcccgggactggaggaggacggcctcgactgtgagccctccgttctcgccgcggaaggatccctcgttctcttccgcgtcaaattgtccccccgtcccatgagtgagcccatgcgattacttcgtctacagggctgccccctggagtccatggctcgacctgcttcctgaccccaatgtcatgtccttcaactccaagaaatttggcctcttcccttgtcgcagcggtgtcagtgagcactataatgtggccttcctcaatattgaatgggtgccctctgatgtagcttgccagtttgagctatacatcttctcatccaagaacagaaagtgggacgttaaaccagtcttgcaggacttgtcccgttctgagaatcacaaggtagccctcgagcatgagatcgacaagctgatcaatataggacacgattcgttgtgcttggttgatctctggcatggtattattctgctcgaaaagatgttcgacgactacccagttgtgagatatatgacattccctaagccagtggtgtacaccacggatgcctatggtgaaactgtatgcggcgaaacagccccagagtgtgtacgggatgttgcctgctgcaatggtttgatcaagtttgtggacgtagaatactgctacactgacgagaccaatggtaatggttggaaagccacaacatggaataggttgccttcttggaaagattggcgcaagcgtttcacagttgacaaaactgacatcttggttgatcccagttatgccgctgttttgcctgagctgtgggacaataataccaaaaacatggaactgaagagactgatttgttctatccccactctgagtatgcttgatgatgactttctttacatgataaccaagatgaacgaagaagacaaaaatgcctggatcatctctgttgacatgaaacataacacactgcaagatgtggccccaatttctgctgcaaggttctccattctcagttcaatttgccatccctgtgcaatctctaagtacctcaagattagctggataagtgctattgctgttggtgatgcaaatgggtatatctatgaagggcagtatgtgagtattagggcctgtttgggaaacagggacttattttaagtccctgtcacatcggatgtttatacactaatttagagtattaaacatacactaattataaaacctattctataaccttggactaattcgcgagacgaatcttttgagtctaattacaccatgatttgacaatgtgatgctacagtaaacttttcataattatggattaattaggcttaaaaaattcgtctcgcagattagctttcatttatgaaattagtttttttattagtctatgtttaatactccaaattagcgtcaaacattcgatgtgatacggactaaaaagttttagccccatctaaacacccccttactttatttgcttagctgataatcaagtgatgtctaactgtttactgttgccgaaaccattattatgcactctttagtaacttctgcctttaaatgcacaagattcattaatcaagtctttcttgccctgaactcaatacatttatcatctgtatgtgtattgctgtggcattccaacctgatcttggttgttactgcataaacattattaagtgaaaataacagataattaataagatccagttaaaaatgggcgtagatgtatgtactagtactatataaaggagaactaagggcaagtactatgagcatccaagcataagccccaagataccacatagggctaaatagtgaagtggatgagagaagaaggatgagagagaaatagtcacctctcatgcaagaggcagcccctacataaatttcaataaacatgtgagagtgttagagatattggggattgtgtagtagaggtaacctattatgcatatcacctcttaatttaattatatatgtcatacataaaattggatgtgttagtcatctctactataaaacttgccttaaggttcagcctctatgagtttcaccacctgcctaaataactatgtcattaattgtggcattagttaggattgcatggaatgatctttgaggtgataacatttgtcaaaacttatttgctggagcatcaggggtaaatatctgtcaattggaaactgggcaagacaaagttgtcttgcttttgtaaactgaaaagaaaggagttgcaaatatgatactcaagcgctcgtgggaagccaggtgtcatcaagggcagtgaatttttcaactttgtgttcggctgcctctttctggacgagcttaaagatgtatcgcagctgtaatcacatcagtgacacacatcaaatttgctcagtacaaagggggcgtgatgctgcctcctacctgtaccattgctttggatcaaattgaaatgagcttgacgaatcctcctcctgctgatcaagccacgcagggcttgggttttggtttggtcaaaagccagaaagcacgtacctcatgctccaattatgatgtgaacttaataggcctatcaattgaacaaaccggggctcgcgtcgatcacgttgcggcccattaaattttcggcctttcttcatttcttgcacgttcagggcccagtaagtccgttgaacagaatacataacatttttttttagcaaaatttgttacaggacaccaaaagattgcagtctttactgtgaaacacccgaagatcgtgtatttactcgtggacactgtaaaaaagtggtaattagctgctggacactcctcccattattttattatttccggtcaaaatgaagagagaaatagttgtgtaagtaccaaaatgcccttgtacagtgttcttcctctcacttcttttcttttccccttcttgttctttgcagtggagcagagggcgacggcggccggctcgagccgggacggctgggccatggcggggtggcggcggcggcggcgcatcgccgggacggcttggccacagctgggcggcggcggcggcgcatcgccgggacggcttggccacagcggggcggggacggctcggccacggcggggcggcggcggcgctcgacgaccacagtcggaaggctctccacgacggccttccccgccacgcgcacgccggctcgtgctccgcggcgagctgcccgaacagcacgtcgtcggcgtcatcgaggaagaacgtgtcgattccaccgtcgtagtcggcgtcgcaccgccgcacgctgctccacctcgagcagcaggtcgtcacccacggcgatgccctccgcgtcggcgcggtgcgcggcggcggcggcgggctcgacttcttcgcgtcgtgctcccacgccgcccgcctcgtcgacctcgtcacctcgccgtggcccgcccgcgtcgtcgcgtccaagcacgccgccgcctcgtcgtcctcgctagcacaccttcgccgtggagctctgcccggtgtgccgcgacagagaaagagaggaagagatgaacagagagaaagaaagcaagaagaacaagagagagagagattgacgagtggacccatgggcaaatttgtctttaaccaaagttttcctctccattttgatcagaaataataaaataatgggagaaatgtccaggagctaattaccacttttttacagtgtccacgagcaaatatacaatcttcagatgtctcgtagcaaagaccgcaatctttcggtgtcctgtaacaaattttgcctttttttcagttatatacgttgcaaatacgtcatacaaacacaacagctaagccatgtcacgctggtgtacgcagtaagcgaagttgattcttccatcatcatcttcttcttcttgatcagtttctctggaaacgtcggcacacaggcgcaatcttccgcccccttttcgtacgcacggcggtgttggaaaaaccgggggtagtacgtattttgaaactggaaagtgggaaaaaacaagtactccctactaggcatttgttcaagcaagagtgatttcttgtttcaaaaaggaagggagtgatttttcctgcctcctttgctactcttcttttaggagacttcacctctagtctctagaaagtaaaaaaaaaaaagggtgaataatccatggtaaaccgacgcgagtacacgaccgagcacactttctcacctgtgttgttgacacttccattgacaaggccacgcaaatttcttcccttttttcggctgtcatttaaccacgacgacaatttcagatgtacatgtacagtgtacacatcgtataagtctactcgtgacgtgaatcggtggcagttggtactttgatagggtagaattccttcgcccatctcgatcaattacatcagaaaattagcaaagcgtctcttctttttctacacaccggatgctgctaccttttcgatttcgacttttggggagcatcgacgagtctgagtccgtcacctctcttttgatctctgttcacatgcgtatgaattcatatgatcgttccgttcttgaggctaccaatctaccatcagtctgtaattctgtatgaaccgtcaaggaaggcaatcgagactggacatctgctaatccatttgcagccatcaatgaagtctgaagagcgtggttactctaaaatggacgtttctttcagcagctttccaaacatgtgtgagctcaagaaatcgatgttccctaacatgcgtgatattctgttcctcagcccaatccgtgttaaatcagatgacccatcaaagatgatactgaaaccgggcaagatttgggccacatgagagccagttagtagcttaatcagtttggcaggcaaagtcgaagagatatggtgcttaaatgtacaacctgcatgatattttacagcagcaagaaaggtgagaaagttgaaactgttgaatgatctgatttatgaaaacgtactatatatgtcagagatcacctggcacaagttttatacaactggaatcaaaaggagataaggatagaaaccttttattcatcaacaattgcagactcaagttaaataattctgacaagacatatttcaattttccaagtcagatgaagataactagtagataaatactcagctagtagccccttgaggcatataccacacaattcaatctctaatgcaagtcagttcaaggagatgtcgttttctgttgttataggtaaggaccaattcccccaaggcctacctccctgtaactcccaaatctgtcttcatctcaagtcatatagatttgaaatgatttttcgtgggtgatgtccagaaatatgatttctcccagaactattcagtaaacgtaatgtaattggataatatgaaagtgttcaattctgcacctaatccctgaaatggacgttgcttataaactgataggtgttctgatagagatagaaatcagacaaatcagagtgatcgaataagttgctatcactgaagcgaaaattttcccacagaaatttggaaaggtcataggcaatactacaattctacgatcgattctaatcgcagtgtgctttaccctgcttcttccattgatacgcctcgtttcctttagagccgcttcaactaaaatcattatatctgggggcggcttcggaaacatacctatttttcctttatttggttgttgacaaatacacgaaatcgttacgtttctattaggttagactctacaacattcatactggaagaaatttcatcataaaaggcaggaattttaaaaggtgcagacatcattcaatttgaattatgcaatgaaaacagaagtgcgaacttggagaaaataatggatctggagctagtgatattttcctgttatattttaaatgtcgacgcattaattcacaggtcggcatacttgagttgtgctaatcaagttggtcacaattgaagtcatgtctgaagatggagtaaacctgaagcatttgctgccgttgcatcctactttgagttaactggcaaactgctcacagccactctgcatggtggccttgtccatcttgatcaagatgtccttgtctcttctgtgagttttgtaaatttcgtcttgctcgttgacataattaatgcgtgaaaaatgctccgatgcttccaaatgatcggggtatgatccatgttctagaagcctggtgctgatattcttgcgatttctgacaccgttcgttgatcattttgtctgcataatctaagctgaggattgatgacacgttgaagctgaatgcagccgcttgggtgaattaggatagttacctgaatccaacaagttacggtgttgccatcattaaaatgttgaagggtttgatcaggacgtgtccttttgtctcttgcatacatcactgttgaaatgcaatactgatataataggattatctgcctgcacctttgccctaaggtcaaacgctcaaagagacacgaaaagaaaatgtcttgggctattccatgcatggataatatggtagcctcacaaaaatgttgttttgatgcccggacactataggagtttccatgacatgatcatatatggatattaacgtaacttgattattaaaacggctgagatggtagaatataatcccatatgttttttttcgtgaacacgtaaaagaattgcacgtcaatatattagaataatagagtttttgttacacgatgcacttagctagaccggcctatgccaaggaaggaagaaaaacaaagataaaaaaaacaaggaaggaaaggaaaaaacttgatacgacggtaactctactccaaacagcgggcgggggcagagccactctacgctcccaaaaattctccaaagaaagcgacggccgctaacgaccacagccagtcctccgaaagaatggactatagaagggaccacctatatatttgtcgacaaattttctattaaaaatttgacaaatgtaattatagtacaatcgtaatgtaattacactgtaacttatatgtaattacactgtaacttgcatgcaactacagtgtaacttgtatgtaagtttcacgtaattttgaatcgttatacctattacaagatttgttctggtgaggaagaaaaaaaatcacagcacacacatatgtgaaagaatttgttctcattacctctattttactaaaataacatgttaccgagagattcttgaaagttatatacaagttacattatagttacagtgtaattacatgcaagttacagtgtaattacactatgattgtactataattacatctgacaaatttttgaaggaaaatttgtcgacaaatatatagcaaattcgtttacgtaatcccatatgtaactcgtgcagttacatatgtaggcgatgatttatacggtgatcggcggcctctaattttgtgagaaggctgttcaatgcagagtatctagttcaacctttttttttgggaaattacccccaattgattggtagctgttgttaggtgaaacaagagataaaacgatcggggggaaacgacgtgcgccgtccaaatgcatggaattgacgattgggtgagttggcatttggcagcccaaccaacatttttcacatcgcctcctacatcttacccctcccttccaaagtccccgtagcgcaagtgcgcgacggttgctttcacagttcaaaccaatccaacgtactcggcagctccagtactggaagtcaactactcaagtaatcaatggatatatgacatctgctatacatccaatctggaataacacacaccgattgatcgggctgcaaatggtgatgtgtactgtggttagctaggggttagctcgcatcgcagccgtcgtacagtatgtgcctgacctgacctgacccaacgaatattgcggcaacgcacgctgttttcctcgccatctcgccgcaccgcgcccccgcgcgcgcgcgttgcaccgcatgtcacgctggcttccggatcgacccggtcgcgggcgcggacaagtcgagggaaatgccgcgtgggttaattgatccgggcgtgcgtgcgtgcgcgtgcgatcgaagagcccaatctgtggccaccggtccaaccgcgcgcgcggagccggcagatcagatccatccagcagttgacgcgcgcggctagctcgtccggcctcccgttgttctttcgcgttgatcgagccgaccgaccgattcgcctgatccaacagtgcgtgctaggccgcggggggcgcgcgcgattgcacatatgccttggcctacgcacgtactagcaacctcgcgtacgaatcgcgtgatcgaggcgagcccaaatgtaggcacggtttacgttgtacttcaccgcggcagtgaggcaaaggcatgaacctgatgcacctgcacctgcctgcttttacataccaacataaccagtgcacaactatgactgtaaatagtatgcaattaatattggcattcttaacttatataagtcgatcgaatttacgtgtttgtgaaatgatacgttaaatagtattaattattattattttgataactttacaatcaacattagaaacgtagaagttccttgagggtcaatgagactttcccaatgcaaacacttccactaaagaaaacaaagtcacaaagagatcaatgtgctattcgcgtccatgcggcgctcatggtttcgatcgtctctctctcctacctgcaccatattgaccgtacgtcgtacaactacagctgcaggtcagctttggtcaggtatatacgtacgttcctgttaccttctagaagcaagctagccacatccatatcaagttgcacccaacaccataggattaaatccattactactactaatttttttaatttgtttctagtgctcgatcatcattaagtaccatatctcctactcgtttttatttggcggcacctaacacccggcaattaaaattaaactgtagctgtctatctgaagagttcctttccctgctactagcagccaggctcgatcgatcgtctccatcagcttgtgtccagtgacatatatgatacgtggacgcccggcctgaagaaggttctgaaatttggtgctctgtccaatccttgagctcgacaacgatcagttggcaattattctagtacctctagctagatcataaacgtttctaattaacttcttctatagctagataatgccatgttgcggaatagttaaacaagtacgacatgtcacatgtgtgtatatcttgttgaacaagattgaaaaggggcataaagctccaaaccggtggatttaattaggacaagatcattttcagaaactgaagatcatctatgtatgtgtgtgtagagacgctaatgcttccaagtgatagaagaagttgaggtaaaacaaaagggagctagcacctttatgatcttgttgggcctactgctccattttcttaatacaggaggttgcatgggactgttcaatcatgtttaaactacaatttgtagttttgtactctgttaggaaacgatagacgaacaaacgataaaaaacaatagatcaatcacaaaagacacgagatttaacgtggaaaaccctcccaaaataggagagaaaaaaccacgggcgccagccagcaaaatatcttcactatatctgaggtgagattgcatcgccgcacggcggcttacaagaggtatatatatagtggaaccctaaaagggatgatgattcgctccgctacggcagaagctggcctttattaagtgcaaatgaatttggatcacaactcaacaaactccaccttgagacaaattccttcttgtagcatgaatcaatccttcactctgaacacaacaaagacaaaaaaacactttcggcgccaaatagcctctcgggctaaaccactataccaactaagcttgagcaaagctcaaccttagcaacaggaacagactttgtcatcatatcagcaggattatcatgagtacttattaaatggaaataagtttggatcacaactcaacatactctgcacttcgaagcaattgcaaatttgtagtttggacgattcatgtcggcacgaaaacagagttcagagccacggctccggtggcttgcattgcagatggtacggacacaacctttacctgctctcaagactcaaactatatcatctttgttttttttttttttcaaaaaaaaattgcaaggagtatcagcttttccttgcagggagcattgctagcgaaacagaagcaacgttccttgcaagtttgatcaatgcagtacagcttctggaaagggagctttgataatagtacagttgtacattaagtacaaaaggatgcgccaatagtcgactggagaacggagcagaggacacgtcattccagatagagccatctctagctgctcgtgtgtgtttgtcagcacatgatgctaactagtacgatctccgggcaattaacagctttattttttttatacttatacttatcaactaaaatagttctcaaccttaaattttgaagttgattttagagtttttcatcgaaacttatttttcagccttagcttttagatcgttaagaacacgtatataaaaattttattcataaattatttttcatttgcaaatatatttttggcttattccatttgcaaatatactatttagcttattccttaaataagccaaacgatagggcagtaagttatcatatgacattgataagaggttcatcgtttgttattcagtttatccagccaaaatttaaatttaaaactcaattttaaagttaatattaatgtttttgtcttaatttatttttcggtgttggtttttaagtcactactaatacatatataaaaattttaccttttctttttctaataagcgttgcaacctatgatcagcaataggtgaaatgaagggataattaattgagagaaaattaagcaagttaattaattaccttggtaaaaacacattgaggaaaaagttttttttttgcggggaggaaaaagataatttaaccatgtgtgaaaatacacttggagataacgcgatccacttgtgcctcttgtcggtccagtttgaaacggacgcaaactatggagtactaccttttttttttttttgacacgaactatggaggaccaggaggagtactagtactagtaaagggaagctttcagcataccaaagcatttgagccatgcctttgcctgcttttccatctgatccgtccagtcctcatccgacgcacgggaggcaccctcgccgcgtacctcccgttgcaactgacggcgcggatcggagcgtccgtcgaaacccccgtttccgccggcggaatttcacgcatttccccgtgtcaaaatggtccgccaagtcaaaagcccaagctagccccctctccatccacacacccccaaaccaaaattaaccaaacccccgcgccgttaaccctctgagcttgtgatgaattaacgatcgtgaccgatcaagtgagcgattaataataacccagcggcacacaattaagcaatgcaagaagccgtcgtcgttaacaccggcggccggtgggcaccaacccgtatttatatacacttctatccggccaaagcagcgggcgcggccgggtaacccaaccacacacgcacgacacgaagaacgccatggcgaagcaggcgtggagctcgctgttcgggtgcttcacctcgcaccacgacggcggcggcaagaggaagaaaggcggcggcggcgggaagaaggcgaagaagaaggtggcggcggcggcgagccagaagcagcggaagctgcagagccggctgtcgttctccgacctgtcgttcggagggatggtgtcgccggaggacctgtcgctgtcgctggccgggtcgaacctccacgtcttcaccatcgccgagctccgcgccgtcaccagggacttctccatgaccaacttcatcggcgagggcggcttcggccctgtctacaagggctacgtcgacgacaagctcaagcccggcctccgcgcgcagcccgtcgccgtcaagctcctcgacctcgagggcacacagggacacaacgagtggctggtaagtacgacacttaatcactagtagctgcttaattacgcctcgctaaaatttaattataaactactccactgcttgctagctccatcggctcagttcattacttgcacggttgcacctgtacgtgacctcacattattactagctggcatgccttgacactccaattaggcggttattgttggtaactaaattaatacagaacaccactttgcaaaaagtacgaaactgatcataatgatcagtttgatgaatagtgtggttctttacctgctatacgcatgacggcatgagattattgctgctatctagtacctctagttgatgagacttgcttacttgttcaaagttagttgagctgttctagtaataaggtttgagttaattagctgggaatttaaaccatgataggacttcagataaaattaattaattaacctatatgtacatgttacataagttcaggaaagtatatacccagcgtaattagcattattaacttggccttgctacggtgggtacaaattaaagtatatattctgaaatgtcaggggaaagaattcagaaaatgattacatattttctataagaaaagaaaacttggttttctgttgaaatataaaataaattgcttgtatttcctcactagcttaagtttcaacatggaaatagagccaaaggtctcgaattcaaatcttgccagctggtgcgtaattaaattaaaattgcatccacttttattctatcctataggcttgatgaggcccgcatgagaggatattagaatatgtaattacttgtttttctttattagcttaattaaacttttgggttaaattgatcggtgtatgcaaccgagctgaactttattttgcagtatctattgcttttttttgtttaaaatggttaattagtattccttaaaaaaggttaattagtattgtgatactgtatttgtttatgagtacgtacctgctctattctttctactatattttttctcaatattccaaaccactagtcttttcttatattaaaatggttaattggtattgtaatactgtattagtttatgaatacgtacctgctcgattatttttactattctttttctcaatattccaaatcactagtcttttcttagaagtagaagttttcttggttgacgtgttacacatactgaactccattcgagaaagtttcagaagtttgctgctagatagtagataccatggaacaataattcaatagaacagtgctgcttgcttagctgaaatgcttccttattttatttttctcccagttaaaagcaatcaaatgagaaaaaaaaatgtctggacttgactgacaagtctgcaaatgcatacatggcccgatgattatgcagactgaagtcatctttctggggcaactgaggcatcctcacctcgtcaaactgatcggctactgctacgaggatgaacacagacttctcgtttacgagttcatgacgaggggcagcttggagaagcatctcttcaaaagtaagcttgaaaaaaaatactaatattttgttattgtttcctatattatgctagctttctgctactctgaatatacaagaaatttggtgcaagcctcagttgttttctgacaaattagcagaagtaattaagaataaaagcgtaactgagattagagagaattgaaacgatttacatatatatcaacggtataagtatatattatagcagagtgacaatcttgcaggcaacaagaaagagatattcgtaaaacattgctatcactctgctttttcctcgctgcatcattaagctaaaaaggattcgacagaatctctaggctgaacatcggttgaaatggacggcgcgattttaccaactcgctggcataaacttttctgcaaattggtggcgcggctaagctcgattgatcgagtagcttttcttgctctacacccttcaatatgtttctccagtttttcctgatggttcaaactgcctttttagacctttgttgtgacgtccatttttgcgttacatcatatctcactctctgtatggagtcattttctcttaaccactttgatataattcacacctgcaacttgcttttgttctcctctttgtctgtctcttgtacagtcctactgtcatgtcttcattgtcaatttgcctctgcatagtgaagaggaaacagcgcagatttgatgtataatcatgagtatggtaggggtaggacaccttcaccactcgttgtctactatggttttttcacattagtacttgcgtcaaagtagtagacaacccctaatatgtgatttggatcaacctcacaagtcaaaattcgtggcttgtgttatcggtaaccacatgatctagtcacctcgatctatcaattactactggtttaagagacatagtagcacaatatgcttcatgttttattaatgaagcaaggtagccctgaaaactgaaaaatcacgtgtgagggagtacagtgattaaactgttgcaaattaattaagagatagcaacgtttcagcaaagttttttttaagtaaatccgatgtcattagtttcatgtagtcagtctactgtcatggacatgcagatgcatgctgaccaaaatgtacatttctcttcttaattcaagctccatatgtgcatactattattagttcaacttaatcgtcttatctgattacatatcgtacttacacaccaaatgtgcagagtacgcagcgtcgttgccatggtcaacacggttgaagatcgccataggtgccgcgaaagggttggcctttctccatgaagccgagaagccggtcatctaccgagacttcaagacctccaacatcttgctagactcggtacgtccttgaccttaattacgttaccatcgtggcatcgtatatgtgttcttcacctacttccccaaaagattgacctgcttgtcatttgatctctaataaggttattagtagtcagaaaagttatattcttttagataatagtcagaatacatgcatcatgcatgcatggtttggttgcttgtacgttcttaattagtttccagtatgaaactgtcgtgatgccaaatgccaagtactaaacaacaaatcttgactactactcgatcgcctatgtatactgaactaagaattggtcaggtttcagactttcagtttcaactatagcagcgctcccgttttgtcatcaatgcgttaacgtgacaaaggccgcgaatttagttctaaattttttcttcaaacttccaattttttattacatcaaaagttttctacacacacaaacttttaacttttccgtcatatcgttttaatttcaaccaaaggccgtgtttagttcctgaaaaaagttgaaagtttgaggaaagttgggaattaaaaaaaaaagttgaaaatttatgtgtgtaggaaaatttttgatataatgtgatgtgatggaaagttgaaggtttagggtagttgggggtaaactaaacacggtcaaacttctaattttagcgtgaactaaacacacccaaagaaagagcagggtggtatgactatttctccgtggagaaaaaaaactgaaaaaaaaaggtaaaacatggagtgattcatcagtttaaactaaattattacgcgcgtgataaacagagttgttggagttgggtgcatggtgatatttccctctgaacaataatccctagcaggctagcactactgctagtgcatttgctttggttacgctattatttctccatcaactgaatcctgcagttgcagcagaaaggttttcttacacaagtacaattctgtagcaatcttaattttgttttcgttgctgaattgtccgtaggacttcaaagccaagctctcagatttcgggctagcgaaggacgggccagaggatgacgagacgcatgtctcgacacgtgtcatgggcacacagggatacgctgcaccagagtacatcatgacaggtttgacagcagaaaaaactgcaaccttttaccccatcctaaataaacaatataatataaaatgtgatatatcctattcagatttgtaatactaaatctgtcacatttctctttttctaaaaaaaattttgaaatatatggagtaagggtgagtttgaggagagggggatagagaagattgggaagatacgtaaaacgaggtgagctattagcgtatgattaattgattattaattattttaaattttaaaaatggattaatatgattttttaaagcaactttcctataaaaaatttttacaaaaaatacaccgtttagtagtttaggaagcgtgcgcatagaatacgatgtccctttctcacccaatccatcccctagaacgaacgcaccctaagttttactccgacaatctgatcgatggtttgtcagtagattaaaagcaatataattatggtcttgttatcaaattatttttagggcatctgacggcgaagagcgacgtgtacggcttcggcgtggtgctgctggagctgctgtcggggaggaagtcggtggacaagagccggccggcgcgggagcagaacctggtggagtgggcccggccgtacctgaccgacgcgcggcggctgggccgcgtcatggaccgcaacctcgccggccagtacccggccaaggcggcgcagaaggccgccgcgctggcgcaccgctgcgtcagcctcaaccccaagtcccgcccccacatgtccgccgtcgtcgaggcgctcgagccgctcctcgccctcgacgacgactgcctcgtcggcaccttcgtctacgtcgcgccgcccgacgacgtcgccgccaacggcgacggcagcagcaagaggcgagccggccggaggaggtctgacggcgccgcggcggcggcggcggccgatggtgtgcagcgggaatgactcggttttgcttgcgtttgtctgtactcgtcgagctacgtgctgatcaagcgatgccggtaaattaatccggatcagtgagttggctcgtgggtaaaaaatgattgtggatttgaagcatgttattatttgtcttaggcttgaatagcagaataggattagagcgtgtaaatacgagcatgtcagacgtacatgagcaaattgagcatgtaaacagtttgacaaaatatggatggtttatcacttctcatgttgggaggtttctctagtatcttcccagcgccgtgaaatatctctgttgatagacactgtatgctgtacgcgagtatgttattactgtttgctgaaagactgtaggttttctccgtgtgcactgtatttaaattttgagaagctgcaaggatttagtaatggtaatgttggtggtgtacggtgtgggaatgcaatacaactgtaacaattggacagggagaacggaatgattccggattcaggatttctgatgtcaggcagctaccatatgggccaaatatatgttgggccaagagaggagatcacagagataggcccaaaacctctttgtagcccacaaggacacactcctggctagtcgccggcaattggaccaaccgcaccacgttccgatgtgccggtgtaacatgtaccgcgtacgtaataacagatgctaagcagcaaaggcgtaatcgagcccagagatttcccctaatctaccttaggttcatcgcctgtcattccagaagcaccagccgagcgccgccgcggcggccacgtccaccagccatacgcccaacgcggcgaacgccacctggccgcgccccatcagctgtaaatacgccaccgcggcggtgtgcaggagcacgggcgcggccaccaggcaagcgagcgtgcccctgtgcatgtcctcgacgaggcacggccgcagcatcaggcgcatgtacagcgagaacggcgcgaggaagaagagcaccccgacgccggcgctggacagcgccgtcgtcgtcgccgggacgaacatcgcctgcgccgccgccgcgcagagcccaattaccacggagacgcacagcaggacggtcaccgtggtcctcagcttccgtatctgctcgctgctggtgagctcctcccagcggagccagatcgcctcgtcatcccaccatggcgacggctgatccggtgacgaccgtctcgccgccgccgccgccaccgtgaggccagcttcgacgtcgtcgtcgttgtcgtctttattgttgcttaccatcttctcgccgtttttagtttctccctgcagactcccgcgattcgacgcgacgccgtacgtcgccgcgcgcgcgcgtatatatcgcgcatccgactatccgactacggcttgcactccgtaacatatccgactgcggcttgcactccgtaacgtgtcgcaccaggatacggacacactttcaagttgtaggcttgtagttgtagcgcacgtatacatatgtcatagccgaataatcgactgcgaggttgacccaaacaacggaaaaacgatggaacaacgctgggacgagcgcccgcggcggacgttggcggagatcgtccgcggccgcgccgcggggcgcaggtcggcgatccgcttcgccatggcggtctccgcggcgtgcgcggccgtcgccggcgcgacggtggcgtgcctgcccggcgcgcccgcgggcgccgcgttcgggctcggcctcgcggggctcctcttcctgctgccgttctcgtcgctctacgtccccatgctgcggccgccggtggacatgtccaggcccttcctgagcttcacgatcggcaccgcgctcgcgctcgccgcggcctacctcgccctgctgcttctcgccgcgaccgacaagatgctcggcgccgacgccgtcaccggcttcttgtggggggccgacctcaccggcgcggcgagccttggatggtttgtcttgaccacgaaagacactactaggtcttatatcattcgtgaggaaagactggaggtggtcaaaattggctaaccgtgcaactgatctattgcatttttcactccattggacattgttactagttaagcaaaagcaaatttgcctttcatgaagatttgtttgatgaagtatgtgttattactacttctttctgattacatcgaattatcatttttttccaattacattaaaatatacagaaaacctagacaacgatatcccgttggaacgagatacccttctataagacagtacctatacctgtttatagcaccagctgcatggtacccgatacctgtaatacttgttatccggtatctgtgatatctaggacctgatacttgtgtaagagaatagttaatatgcctatcccgttgcaattggatcccgttttgtagcagccctctaaaatataatatacgtgcacacaccattacacgcgtacacatccacgagtgtacacgcagcagcaaaaatatgggccggaatgctgggcctgagccttcaaaaactgggccggaccatactgtaaacctgcttggaacacaaatgaattctgcaaactaggaatggtctatttctagcagagtatggaaaactttgtgtttccacatggagaattcatacagatatttgttttacaaatagaagttttcatctatcagtaaggtctgcaaactaagttacatagatgttatttgtatttaattaagtaaacttctcaccaaaccaatttacaatatttacaacatattgtgtgctgctagtgtatcaacaaaaagttaaaataagttatctagcagcatgattaataacgaactaacgcaattgaaacaaatttgctagttaatacattcttatccaatgattgctattaacaccttgtcgattccccatggatgttgtcaagaatggcaattacaccaaccacaaacgcctggtcataacctggctgcaccaccacatggtagaagtccttaccagccagcatccctttcactccaatctagtgaaataaaatacaacaaatgcttgtaaacattttttaccatatgatataattccattcctgatcaagttcatttcaactccattgccatgaccgaagagtttcattacctgtgctacgacatggcctgctcggctcctgacagtgcaagctctctgagaaaatgacccgatcacctcataatcccagtgcctctttcttccctttggctcaacagcgaccctgacatcgccgttcatgcagagcaccggcttaggatcttgaaagctgaaaaccagcttgctgggttcaccatagtccatgagatatcccttccaccaattgttaatgctcaacacttgaacaactcctccctgaaaaatcaaaagttgatcaagcatgcagtgttctgaacatcatggcatctactcagattgaaaacatttcaggtgaagtctaatcttgagttggtttcaccttcttgtggatgaagaggatggcagtgccatcaccgtccctgacgatcagctggccgctagcaccgatgatcccgcagccgtcgacgctgaagacgaccctctgatcacggtcggtgacgacgaacccgccgccgttcaccgtgggagggcggcggcgcaccatcagcacggcttgcgagctgctgcagaagatcttgctaacaaccggcgtcagagctgcgtacgcacccatctgatacggtagctctttcagttcttggagctacgaatactagttgtgatcaacgatgaattgtttttacaatgtagcttctgctaatgcaggaaaggaataaatagggtcatttgagtgtacgtgtgtcgcatgactcatctgtgcacggatgatgcatctgcctaaccatggtctattgtgagtttgtgagccaagcgatttggatgaagttgcagagctgaagcaacgtatggcaaacgacctggtgatttggtcatggaaaagtatggcaagtgtacaggaggagctcataaagaatctttgaattcgattgctttgggccaccgaactgctttatcatcatcggattaagtgtttacattcaattcatgaaggtttatgcctgattaagagcacaattatgctccagtcaggtcgctttaattttgatgaacgacagatggcaacgctaagtaggaaacttggcaggttttggagataatcagataaaccgacctgagcttatccttgtcacaagtggtagctaatcatgtaatcgtgagagtatccagccagcttttaatcctgatttcctttttccggctctaaacatggtcatgaatcttcagcgctaagcaaaaactcacatgtcacagtcacctaagcaaactctcatagtttcattcacatactatgaatttttatttatatatttattttttataaaaatacaaaaaatatatatttgaaatttgtttttaaaaattatataaatacactcctagttctctttgcgagggtgtcttttaaaaatcgttgttctagaggatgagaaggggcctaaatgtatttttttatttgtatagacactttctgctggttttaattactataaaaactagtaacgcttattcgacactttaaataattttaaatgaaaaggtgataaagacatgaagtttatctctattggagatcgtttgaaatgtagatatgggattttatgaaagtagattttagatttttttttaacggatgtttggattcttaaacaatcttaaatgaaaaggttgtgaactacaatcctcgagctctataatttgatttcatccaacttcatatgacatagtaaattccatgtgtaccctttaaaactcactcaagctgtgttcggaatcatatgtacctagcatgcacagcgcgcacggacaacggagcagtccattagcgcgtaattaattaagtattaactatttttttttaaagatggatcaatatgatttttttaagcaactttcgtatagaaactttttacaaaaaatgcaccgtttagcagtttgaaaaacatgcgcgcggaatacgatggagaggggttggaactcatggttccaaacacagcctcaatccctttcatatccctgaaatttactcgatcatttctatacccctgaaatttcaacttgatctcttccatgccattgccgttacattttccttcatttgaattgtttggttgcaaatgttttttatgcccttgatgatttaggtttgaatataagcttaaaaaacgattgaaaattttgtttgagtgcacaatatgtgcattttataaaactaataagactaaataattagtacagaaatatttgacataaaacaaatgtaataatttcaaatctttatttgaatttttaataggacaatgaatttttttctataaagaacattcattaaaaaaaatatcatgagcatattggtaattctatctttttatgaatgctccttattttttttaattttttttaaaataaaataaatacatattttttatttcattatcgaaaagtaaattgtcataaataatgtatcgcacaacaaactcataactataatagtctcatgtagtaaactttttcattttcaataatgtaattcataaatttctatgttcatccaaaggtaaaatggtcatttttatagaaattagacggtcaactaactgtcaattgacaggaggggcatgaaagagatcaaaatcaaattttgggggtaaaaaataggggcatagaagggatcagctaaaatttcaagtgtatacgagggattttctctatgacatatttgtaattaaaaaaatacaaagttgacaagttatacgggaaaatttgcatttaagcctcttctcatcctcctagagagcgatttttttttaaaaaaataaatatcatcttcccggtattttaaaacaaatatatatttctgtaacttatttaattaataaatatataaacaaaaaattccacctactctcatgtcacaagtagtacaaaaagcaatcaaattctcaagcccatgggctatagcttcaactccaaaggcctcaagactgacgagctactgccatatgggctgggcttttcaggtggccggctcgcattcgcggctggagaacagtcaggtcaaacgagcttggtgcaaccgtgcaacacacaacatgtattataccagattttttttatcgtttcaaagttttacaaaaatatactcctcccgtcctataggaggagtatatttctataaaaatttaaaataataatttattaaatcttataaataaataaataaaattctaccacaccacaagtccactacaccagctacaactttctcctattacaagtgctggtggacatggattggattttgatgcctgtccgagatggcaccgacagacacccgctccaatcagtcccccctctgatcactttctccctttttttttcatcaactccatgatcgatccgtccattttgcccacgtcgtgttcgtgcatgcgacggtacgaataatatatcgctctcctcctttgctggctaatgaatgatttgaggtcactgataaatcgcacatcatgtgtacagtggcttagccaaatgatccatcgcgctggctgaactgagccacaaaaattaacggcaggacgagttgagtttggattgtaattgttgttgcaggtgaatggttacagttgaagaagaagccagcgtcatggggctcttgaattgtgataggagtagcttaccaaaacgaagaatcatcgagcccttaaacacccttttttttttcgggaaagagagaaattgaacactttgaaagtctcacctcgtgaacaatatgtaacacgcagcaacgtttcttggaaggtggcaatggtgtatgggtgaatcgcatcgattcttctctcgtcataccacttacatcataaaagaacatttcctttttgacaaaaaaagggtaatctatccatcccaaaataaatttattttcactcatttcacgcatacctatacaggaaaaaaaagaatactctcactttattaaatgttaatgcaattatttctcactttatatacttcgacttaaatgattactaaaaatacgtttaatttaggacaaactgaagaagcaaaaaataaatttattacgggacaaatgaagaaaaaacactaaattagtggagtgattatagtattatgcacagagcagtgacgaacactgcacttctgacaaatataccctttttagagctcaacagcaaacaatgaaaacaaaagggaacttgccggaatataagttcaccaacccttttgctccacgctataagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattccaagtaggaaaatatgctgacatagatctcttgtagagagcctatagataaccattgtgggtgccctaattcgccctttttttctgacatttaacactaataaatgatataactaccctaagaccagatctaagaaaatacaatatcctaagacttctctgaaacttcggctgaacagaaaccatgggcaggttcaagttcaactatcatggtcagtcacaggcacgtgggttattgtacatttcgccgtacataatgccaactcataaacacttagaaatcgtctctcctaagatctatgtgaagagtttctaagaactgtagtttttcatggagaaaaatccaagggtctttcagccatttgcacaaggtggtgggctagctgatctaggtttaaagtctctcacattctacttatttgatagatcatttcttaatatttacgttattttaactgtagcttctcatataatctctagtttctcaaactgtttagattgttatctaaattctgaaaatttgtagttgtagaatatagaaaataaactagaaattgaaagctgaaattttcagtttttctaaactcttaaaaactaactaccaattagtaaattattgtaatcttctaactcccggacagggtcctagtctcgtgccgccctgcacaaagacaaacaaaaattcttgagaaacccaagtgtttcagtcatccggtcagccagcgaaaccatccaaaacttccttgtaaaaacgcccatgtcgcccatgacttccacccatagcacgagctgactgcaaaatataaaaatccggcaacactgacacagccacaagacgcgacacctcccctgaatgaatgaatgaatcctactaggccagcactgctgctgcctgctgctcccaactcgacgacgccaaccacctcgcctcgcttagctcccacctaaacagtaagagcacacagcccaaaccggcgggagatccgaagcgcagccaagaacgcatcactgtcctcttcgtcttcgtgcatggagttgaccggcctgacgcgggcggcggcggcggccaccgtgacgccgccggcgccgcgccggggatggggcgagctccggttcgcgccgctgctgcccggcgagcggcatgggaggaggaaggtggtggtggcggccatcagcgaggaggtgccgcggctggcggcgtcgccgtcgtcggggatcaagggcggcggggccggggagaggcggccggcgccggagaaggtggcgctgcgggcggcgctgacggtgcggcggaagcagaaggaggacatcaaggaggcggtggccggacacctcgacgcgctctgggacatggtcggccggaatgtcgtgctcgagctcatcagcaccaagatccacccaagtaagaagaatcaagcaaagcactccattttcttgggagtaagcttttaagctagcacctcgccgagttgacttcaaatctcacctttattcgagctgtttattttagttcttctttttttggataaagtttaagcttgttttgatcgtttttctactttactgggagctggaaatgcaaagttgctagtacctttttttggcttcagctccgtttgctcctcatggtcctgggtaggtagcagatggcagtcaggggattctgattagatgcagatgatcaccagatctttataatttataatggagttagtataatgagagcatggagatggagagcatgtgtccgttgcattaggatattcacactgcatttttttccaactaccttttcatgcttacaaaagagtatccaagcaattggagctactctatatactttttaaacactgacatctttcagaaaactagaaaaatcccaagatttgcaagttggagaaaggaaataaatggaatggttattttaacagagctttctttctacctttaaatccaaagcgcccaccggaatcttcagagtacttcaatgcagagcctccccttttcatgatcacatcagaattttttgcccctttagaaaaaaaaaagcatcagaatatttcgtgactaaatggatcataactgtgcacgcaagtaaatatctttcccttgtctccatgatccgcgaaagttcttgtccctttcttgtcaatttttacatgtctccaaatttgacttgccttgccaactttcccagctctgactgagttgttgctgctgctgatgatgatgatgaatctttcacagggaccaagaagccgatgcagagtggccgtgtgtccatcaaggactggtgccagaagaggggagccaagggcgaccacgtcgtgtacacggccgagttcacggtggacgccgacttcggcgagccgggcgccatcgccgtggccaaccggcacaacagggagttcttcctggagagcatcgtcgtcgagggcggcggcctgccgtgcgggcctgtgcacttcgcctgcaactcctgggtgcagtccaccagagagctgccaacaaagagggtgttcttcagcaacaaggtactctgaacattccgttcaattatttttctttggtccaaggaaaaaaaaaaacgtgttttgaggctgtgatattatcatggctaggtgatccttacagtagtcatgttccagttaatagtgatattagtcactaagctggttgtgcatcattgtctgtgatggtgattggggaaagaaggccattaactacaaaacgaggtggcaggccagcctaaaggcatgatttttagagttactgctagtgtgtcattgtcaaaaacccgattatttggcatgatttttattgagttatgtcatgtccaaatgttgtttaatttctcagcttttagatgggtcataggcctgtcagtagaacgtatctatggcctgtccgagaacgatcttttggcactaggttaaatgaactgagtggggcaccaatgccttatgcatcttcatgtgtataatgcggtgtggtttttccagcactttcaaacaggactgtcaattctttacattttgctccaaaggaagtcaagacaactataaaagaatttaggttaggttgtgatcccacttggctgttttttggccttcaaatggtgacttgatttctttgatgagaaagtgataacaattctaaaaaaaatattcacttgaagattacgtaattcagatttctgataatatatgaatggtctcatgcagccatatttaccttctgaaacacctcccgggcttagagaactaagggagaaggaacttaaagacctaagaggagatggcacaggtgttcggaaattatctgacagaatatatgattatgccacatacaatgatttgggaaatccagataaggggaaggaattcatcaggccgatccttggaggagagaagataccttacccacggcgttgccggactggtcgcccgccaacggataccagtaagttctgtttgcacacgatccttagcggattatagagaagggaattgggtaaaaggcagaaaggtgcgtgttattttccaactataactagcacgaagcttgtgcatgtccaattccattttgatcaaagaccaggtcactttcagatgtgatagcttgccccttcaataaacaatccttcaccacgtggtttgattccttgatggtgccaggatttgacaaaagaatatgtaacttttaacttctgaataacgcttgactttatgcaagacctagaagtcatatctatccataagcaggcaaaaatctatggcgtacactccaatggggaaaaaataccgagaattgcctaattgaaacagaaaagagcagctcaagagtatcagattaggatcatggcaatttcttctgggtgaagagtcttgtcaggtactgagtattgccaatagttaggctgaaagtatatgacatatatgcccattaacaaccgggaccaatagaactatagaccttatggatggccttttctatattgtttagtctttggaatggtgttcttggactctagccacagtaccgaatacaaactggccatgcaagtcctagtgaatattaaactaatcaatataatttgacattatccctagcaattattagactctcaggactccctgtaggattgttgctgtaatgtgtttctggattactcggaacaagtttttttttttttacgagggttctaagtggttaattattacttctatttgtgtcatcaaccatgcacttcactataaagtttaaagtggtccaacgaatgcttccagataaattttggaatttcacctaatcaaacagttaaaatgtagaattaactttatgctttacctgtgtagacatgctagcagagagcagagtagagaagccgcatccaatatatgttccccgcgatgaggcatttgaggagctgaagcagggtgccttctcatcagggaggctccgggcagtacttcacacattgatcccatcgctgattgcatccatctcagctgagacccacaatttccaaggcttccaccacatcgacaacctctataaggagggcctcaggctgaagctgggcctgcaagaacacctattccagaagataccacttgttcagaagattcaagagtcgagcgaagggatgcttcgttacgacactcctagcattctttctagtaagcaatgatcattaattcgttttttacctcaagctgatttgccagcagaaaaagtttcttcgaattcaagaacccttaagaatcaccactaacaatgtctccctcattctgcagaggacaagtttgcatggctccgtgacgatgagtttgctaggcaggctgttgcaggaataaacccagttaacattgagcggctgcaggtaataagatgaaatcatgatcctcagctcagtcacagaaatttgtttttaatgttgatcaacatctgtaatccataacctgatttttggtaaaaacttaactgagataattgcctggaaataggttttcccaccagtgagcaagctggatcctgcaatctatggaccaccagaatcatcaattactgaaacacacatagctggacatctcaacggactcacagtacaacaggtaccatcattttgatgaggtcttaaatcatgtccagtagtgtccccatggttattctttctgatcacatgtcacaattgaaggcaatggacgaagcaaagctgttcatagtggactaccatgacgcatacctgccattcttggaccggatcaatgcgatagatggacggaaagcatatgcgacccgaacaatcttcttcctgacagaagctggcacactgaaaccgatcgctatcgagcttagtcttcctccagccaagccaggggagcctcggccaagcaaggtcctgacgcctccctatgatgctacctcgaattggctctggatgcttgccaaggcccatgtcagctccaacgatgctggtgtccatcagctggtcaatcactggtaaaaaaaaaaaagaacaaacatgccataatgttgtcactgctgccttgacaagaacaccaaattgtcaggtaacttctgaacattgtgactaaccgggtcctctctttcaggcttaggacgcatgcaacaatggagccgttcatcctggcggcgcaccggcatatgagcgcaatgcaccccatcttcaagctcctgcacccgcacatgcggtacacgctcgagatcaacgcgcttgcacggcagagcctcatcaacgccgacggagtgatcgagtcctgcttcacccccggccctgtctccggcgagatcagcgctgcttactaccgtaaccactggcggttcgacctggagggcctcccttccgacctcatccgcaggcaatgccctctcctccccatcaccatccatcatctgattctgaacaaacgacgaagcttttgtactttcatggtcactgacattgcctgattcgtctgcaattctcaggggagttgctgtggaggacgcgacgcagccccatggcgtcaggcttctcatcgaggactacccatacgcgaatgatgggctcctgctctggtcggcaattcgaagctgggtggagtcctacgtgcagctctactacccggacgccgggacggtgcagtgcgatcttgagctgcaggggtggtaccacgagtcgatccatgtcgggcacggcgacctccggcacgcgccgtggtggccgccgctctccacgccggtggacctggcgtccatcctgacgacgctggtctggctcgcgtcggcgcagcacgcggcgctcaacttcgggcagtacccgctgggcgggtacgtcccgaaccggccgccgctgatacggcggctgctgccggacctggagcgcgacgcggcggagtacgccgcgttcctcgccgacccgcaccgcttcttcctgaacgcgatgcccggggtgctggaggcgaccaagttcatggcggtggtggacacgctgtcgacgcactcgcccgacgaggagtacctcggcgaggggcgggacgagggcggcgtgccgtggacggcggacgaggcggccgtggcggcgcacggcatgttcgcggccgatgtgcgacgcgccgaggagaccatcgagaggcggaacgccgaccacggccggaagaaccggtgcggcgccggggtgctgccgtacgaactgctggcgcccagctcgccgccgggggtcacctgccgcggcgtgcccaacagcatctccatctgatctggcgacattgccgatccattcattcctctttgtgttctggatcaataattttagtaaaatgaatatgaaataggagtattaatcagtatccgtacccaaacgaaaccaaaccctccgcttctccaccgctccagtgccgcagccctcgccggagttcggtgactgggggcctccgaactccgggacctgcagacgacgacatcctacgcagccttgtccctgcctctgctcaccggcgacgatcacctcgcgcccattcagggaccatgttagaaaacaacagtgttgtggtgacagacttctcagatgatgatagcaattgtgaatgttctgtaaaaaaggaagaagattgtgagagtgtaagaacgagagcaaaatgggcttttcagcatctattcagtttgcaatgttgaggtgaaggcaatgccttactgatcttgcaattatgctctgcgccactgaactttgcttgctcatagtcatacctcgtagttgctgaacatctcaaggcgtcacggcgtcgaaatcgtttgcaacacctgcaggttgtttggagatcttaccgcatttgacggctccattgtttggcttataatggtatatttgtaaacaataagtaatttgtgaataaaattttttatatatgtattcttagcgacctaaaagtaaaggttgaaaaataaacttcgattaaaaaaggtcaaaatcaccttcaaattataggttgaaagtttaaattttgactgataagcataagcgaaaagatgaggcctgaaaatgtgaaacatggcaaagacctgctgataagaatagagtgagcttgcacgggtacaagttcagaaacgacctgaagatcaatatttccttcagaaaggcctttcccttgtcaagtaggaacaggtgccaagccagaaatgccctgccttttaagactgaactctagaagcagtttccactaaatgatgtgttgagacactgcctgccttgaagacttgaactcttgataacaggttgctaattttcttcacaaagtccatcaatgtacaaagtaaagggacacaaaagtagggcttatagcatgagaaaactaaaaatttagtactacacagaagataagctacctgaacaaagattacacactggaaaagtgtcatatcagcgcattcacaacttgtaacacccaacaacagataagaacacgtgtgattccatttcatttgtataaagacaggcatggataggcaattttatgcatatcaacatctcttcttctttttttacaacaggattatgcaactaactcaagccaggcaatggcaatatccccattgcattgcttaccctaataaaaagaaaaactgagtaaagggcaatgagaccaactccaagtatcttgttaggctgcatgccaccccgtggcagcataacaagagcccagatcaatccaccaacgaggaagctcattgtgtaaatgagagagctgtcttgaggaagaacataagagtttggtgctgttgaccaagctccaagcagcatcgatattcccaatccagcaagtgtattgaacataggtcctgcgtagcatccagacatggcgatctgcacaccatctcctccattcattgccaaggcaacatttgacattaagtcacccatcgaattaccccatgctaacacagttaacccaagaattgaaggattgatccccaatatcactccaaaagcaactaaaagtgcaaccagttcattggcaatgatgtagaaccagataatgctcatcacaaaccctcccaacacccatgggaataaaaatctccgtggaggtcgttcatggtcagtgaacatgaaagcgagagaagcaagtgccatcccagaaataccagctatcacatatgctgctatgtgagccttagtggataccccatcttgactgctccaaagaaatgccagcagaacaggcgccaagccagcactagcaacagcatattctttcgaccaccggtcttcctcaactattggaattgtcaaccttcttggtatcgtcaaggggagctccaaaaacaagaacagcttggagaagctaactgtggaattatccacttcttcatcactccaaccccatagcggcctggaactgtcaggtgaaccacctctgatcccatgatttgagtaaatggccacatgagaagcccacatccactgaggcaaggatgtgtttatttgagccacgtcaccatctgattcctcctcaagaagtgaactgtacacggactcatcatcttctgttccttgtgcaaagatactccctctcacaggcagcagtggtgtgaccacatcaaacttaagcctccgtgcatgcttcctcaatacctcatttgcagccaccacaaacgcataaaccacataaatcgacacaaacataatcgctccccaaacggtcaccttcccaacaatcaaaataatcgacagtgctactagagtcatcagaaagaacccaacatccctcacaaagcatcttctatcaatctgcacattcttctccgccacgcacaatgacacagctccgacaacaacacaagtcacaaagaccgctccgcccaacacactgttcagcccaacatcaccagcgccggtccccataaacgcggcaatactcgaaacacatcaggcgcgccattgccaaaggggacaatgtcactccggcgacggtcggcgggagccgtagcagcgcggacatcttctcaaggctgcagcagaagtaatccgcggccgtgttcccaagcatgtagaacagagccgctaggcacacaccgagcaccgcatagccgagcaccctgaacctctcgcaccggcagtagaagaagcccaagtagtcgacgaacccgccggagctacactgcgggtgcgcccggaggaactcgcactgggacccgaacccctcgtgccgcgctaccccggcgcacgccacggagggatccaccggcggctgctcgccgtttagctccccgatctccgacaggttggacgcggggctgataggatcggcatcggagaggaatctacggtgccccgtatgcgaatcgaagctcaatacccgtggagaccgcaccaagctcccgccggagcggctgtagagcaggaagaggaacagcacgagggaggcggcggcgaggggccgaatccggcgaggatgcggtcccgccgacgagatcatctccggcgaggtcagtgcctagggtttccggggacgggcatgccgaatttgggggtggcagcgagtgattcgggcggaggggaggggtttcgtggggcgcgggtcgtcggggtagggtttgcctgctcggaggattggaaggtgcggtttgggaattgcgagacggagttgacgactcgaggaggaaggaggcgaacgcggctt

SEQ ID NO: 42982 - DNA, 10614 bp, Oryza sativa
cattagctcagctttggaaatgaggccttctagtgaagcctactcaatgggatgtgttgttcttacccttgattgtatgatgtaaattcgagttaagtttgattatttcaacgaaattatttttttaaagaaaacaaaaccatagtaaacaaaaagaacacaggattatgaaacaagtaaaatgtagaggctgtgagggctacctcaaatcctactaattgaagaaaagccacatgagtgactatttggataaagcacacgaaaacagacacaaactatagagagataggcagggggtttttttttcaagacgttaggtattatgttaaattttttcccaaatacctatgtatttactatttcttcgatgaaagggccttagtggaaagctttccatatgattgaatttcttcaaaatttttaaaaccctttgttccaaaggagcccgaggtgtctttattatttattaggaaaagaaaaacactgtaatgacaaaccagtctacctaacctaccccagaaggccaggagagttgcagcctgctgacagctcgccaacaggctccgctccgccatctaggaccttctggaagattctgcggttctgcccatggtgccaaggaaagatatttctttggtttcaaggtcctacttaaatttcaagtggctgtccatgttctcataaatctaatcagacaagttgcaagaggggctctatcaatgcagctcaacctgatacataaacaccaacgcaagctgctttcttctcctggcaaagaaaagaacacttgtgatcactgacaaactgccttctcctttttgcacataattaatcctctcatgtttttggaacatacctctccaaaaaaataaggttatatgccatgtcacagcacatccatatgattaatacagttattattagaaatgggagtgtgtggtttcaattatgagttatcatattcaattcttaacatgtttataatttcttcttaaaaaatgtttggagggatatctcttccttcaaatcttttttttaatacagggctgatttggtttgaggtctaaattaggcttaccaatatttgtcaatttcaatagtgtttagtgtctatttggtttgaagacaaattttggcatgcataagaaaataggccgtttcaatagtgaacttagactattttggcttcaatccaaatataactttaccttaccaaaattagtcatgccaaaatttggcattgacaaaatttggtaaggtctatttagatcacaaaccaaaccaacccacagttattatcaggtaattttgccaaagtgtccaacgcggccgacgcattagctcacgctctgatgaataatttaggtaacaaagccgtcaaaaggtgaggagatccatcatgaggagcacaacgcgaatatgccaggaacactatgcaagagcagggaagaatctgggcatgataagatcgatcgaaagctacacaaaaaaaatggtttttaatccagcgtggtccagcttcctgatggaaatggcgctataaattattatcaggtcaagaacaaaaacatgtacgggaaaggcattgtaaattcggggttggattaaaaagttcagaaaaagaaatagtgggaaatttcggccggccatatcatgaatgaactccaccaagtatacacttgtgtagtgcttgacaaagaagcgatgatgattggtactgcaacgagtcgatctcatgtcagtaattcgtgataaatcacacttgtaagttgtaactgaactaattacagtggatttgtgcaatttactttagttgaaaggtttaaactgttttcagattttcgtagacttgatgagcagcaaattgtagagctacatatatgccgactaaacagtggcttagtacatcgtattattcatatccgacagtttatcaacactcaattgcatgcatgtgcgtgtgatggtgacttctttgattatgagaccaaaccaaacccctcaaacactcactaaaatcacagaatttgattcctcgtgtcggctaagtgacgattttttaaaaacaaaattatggggggagaaatcatggagcgttgattagggatggttttgaggttcattttggagcatgtgaagatcagcatcacgactgggctgattatcgctccatccaaccccaccaaaccttggaagatttggcatctgttccagccaatcagcgaccctggaatcaacatcagacgcccttaaaaaatttcaagttgcaattaatgaacggcgtttccaatccattgcaagcttgatcctcatgtttttataataaaaagggtcattcttgagttcattttcatttcaagcaaaagttgactttgctagtttaaacctctttctgtattcaggctgaagaaatgatagaggaacatggctctggtttcccctgcaggccaacagataagaacaaatcttgcttgaaattgaatcactagtgtaggatatatttttgtattctgtaacttgcctcggttttcagcctttcaggttggttttggtattggtcttttgctttgcttcactgctcaaacacctgcaagttgaattttttgcactaatgatattctgtatggtgaaaaacttattatatatccaacctgcacctaactgtataattgggcaaaggttctactcgtgcgatgtgatgtgaaaaatgtgcaaaatacagcgtaaaagctcgtaaaaggtgagaatatatagctagtgttaagatgctccagctagagcagcttgcttctgagtcacattatgcttgaatttgacagagctccaacaattatgtctcagagtccaaccaaaaccaagaaactgtacaatgtgctcagttcttttatgcttcctatcttagccgaaatggacagaatctttgatctcccaatgctcttgtcatggcaagcataagcataacacaaagatgaaaaaaaaatgtcaaaattggattgagcagcatgaacagagaaaaatggaattcttttttccaccttagctctcaatctctcattgtcctccagaatgttgtttcccattccttcacagttacacaaagctggagaacttgcaggattttgcgtacaaattgagcacgtaattattgcgagctaaatataatcaagctaggaaaattaagcagcaattaaggtagagagattcaaattaaaagagaaagaggctaggactagctatagctagcgccatgggagagcaacagatcttcgatctgtcgtctcaggcgtcatggaactccagcaccaccacggccttggccttctccttcctgccgccctcgccggcgccgcggagcagccgccgcaccgccgcgatgagccgctccgccgcggcgggggacctgcagccgagcgcgcggcagaaggcggcgtgcctcgcgatcgccgcctccacctccaccaccaccgacccgtcgtccccggcgccgcccccggcagcggcgagctcctcccccaccgcctcgccgcacaggccgcacagccaccgcccgccgtaccgcgcccgcacgcccgccgcgtacgtcggcgtgcactcctccctcagcccgcagcacgcgcactccgcccattccacctccaccaccgccgccaccacaacgcccggattaacctcctgcccagccgccgccgccgccgccgccgacatatcccaaaaaaacttccgatcgatccctatatccagcgaaagaagctgcaacccgtagaacacaccaccagatgatcggatcggatataccgccggtgctattcgccggcggcgaggaggagaggtggctcgtccatggatgaggaggaggaggtggtggtggtggttcttgggcaagcgaggcccggttggtgcagcggctggtagtgcgaggcgcgcgcgtcttttgtatgcgacgaggaggaggaggaggaggagcaatgcgtgcgagtgtgggcaacaatggcgggagaggaggtggtggggtggggcccacgagcaaattaatcattgaggttgggattttcatctttgattaatggtttgatgtggtaagcttgacactttggcttttgctgagctggcagtgactcagtgactcgcccagtgagctgccagtgacgtcgacgttgtagtgatggcacgatcttgatcttgcgagctttgtgattgtgtttagctaagcagatcggtttgtggttttaaaacaaccgctaattccacgggtttaagtgagctactactcgtactacttgctagctggaaaagggctcaaaattgtgggctgcagctgcaaggatgttacgaacagcagtattactgttgtaagagtactggagtactatgttgtttcgaactgtttataactgttgtactatcaccaatttgcagcattatcattcgtcatatgatatcgaaattatgcgttctggattttactgcgtgtggtgccatgtcaggggatacaatcatacaagctggcaactgatgccagcaatgcgaacagggtactccagtacagagtcatgcacagcttggacagcttttgcttaaacttgctcttttggacagctcgcttactgctctcattatgcggtcccaacccaaaattttttaccctgccacatcgaacgtttgaataacttcgtgaaatattaaatatagattaaaaaataattaattacacagattacgactaatttgctagacgaatcttttaagcttaattgctctatgatttgacaatgtgatgccacagtaaacattttctaataacggattaattaggtttaataattcatcccgctgtttactgacggattctgtaattagttttttaattattgtccaaacactccatacacatcaaaacgacgctctatataataataatatgacataccaaagctttacggcatgatctgaacaccgtatcgtgctcgtgatgctttctgaagtggagtactctactagcttttggatgcctttgccacgctaaaaaactgcagattacggcgcgtccaatcgaaattcgccaggtaatgtgaaccgcgctatggtcgctttttgtgcgtgtgtgaggtgtccgaagtactaagagctgcaaagtcagtttaactgcttctgtactagcggcaaatttccaatttgccaattcgattgtgtttgtccagaattggttgctaacaatttccggtgactctaccggtcagaaacaatttactggtaattctctgaagtttctgaagtctgaaccatctcttttcggacggggacactttctgttcaggaaagctctgtctcttttttcctggcttcaggacatttacatcaacaaaaacaacttgatccacaatctcgatttttaccgagttttcgcatcccctcctgaattgaatggttctagaacaaaataatgtgatccaatgaagaatagatgcgccagcaatatcttagtgcatccacaatgattatctataagctctctacaagagatctatgtcagtatattttcttatttggaagagattaaatgaagagagagaacaaaactatctactaacctggagatagtctatagagaaaaacgaggcaatgaattagagagctatagatacccatgtagacatactattgagatggtttactattaatctagtttattgctgagatatacatgttttatagagagcaccttactttaccattgcgggtgctcttatgcctaccctttattaagacaggcatgaacagaaggccagccaatagaaatctgagttgccagttgccacacagatgttggcaagctcatacaggtggttctcagcctctgattgttgccaaacccctggttcagaattcagagttcatcagagcctcagaaatggtaaaccttcggagttcagatggacctcaacaaaacaatactaggttgttctgtcgccaaattgttctgtaaattctacacatacttgtcgtaaatttgcgtgctgattgaccatgatgctgcagcaaatctgcaaatgcaagtgtaaccaaagagcgtataggttgttctgtacttttctgataagaaatcgcatctgaaaggagaaggaaataattaaaaaaaaaaacagtttggctgtttgtttgtcctcacctagagagacgcaccgaggaccacaaaatcccatgcaaccaaagaatcattcgccacaaagtattcgctcctccacctcgcaccctcgaacagcgcgcacgatgctaacccgaacacaaaaaaaaaaaatcacaaaagtacaacacctaccatgacatgtgggtcccactacacgtggggccccacggatcagtcgcacggctcacgtacaggccggtacagcgcccccgcgcgggccccagcgcatagacaggtggggcccacggcttccctcacgggacaaacaaacacgccacaggagtcgccatttcacgtgcgggccccacatgtcagccgccgcggggttcggtttggctccagaggtagtacgctttagccggggcgaccgacggccggatgcgcgcgcaggggccgatcggacggccgggaggcgcccgtgggatcctatcgcgtccacgaataatataaggctacgagtcaacacagcgaacaagaagtgatagagagagcgagctaaaaaaaatcgccgcagaaaaggagagaagagaaaaaaaactttgggcgagaggagaggaggaggaggaggaggaagaaggcgcaggtgagatctccgatccttctagaagcttctggaatcgcgcggtccaggtagaattatacacttgagggggctgatgcgtggtggtgcgccgccggagtggtaggtggcggtcggggggagtgggagcttctagaagggcgtgtcgtacgtgtgcgagtgggttgggagtcctctggatttatcggttcgtcgatctcgcgggaggtgagggcgccgatggttctagatcgctgtagatgatttgtcgatgcattgaattgggctttggtgcgcttggtctgcgcgcatgggggtttttgtggattgattttgataagagttgctgaatttagctagtttttgcggttgatttcgttgggctccaagttgccaaatgctgcttacgcatcgctctaggtggtttttcgttggatcaaactggtattttggtggttagattcggggcgtgtgagtggtcaccatttttggactaacgaggtctccccaattcagtaatttatgttcttactgcttagtgttactgttacgttcgattgacttcttcatggaaggactgtacaagctcgatcaatatcgttcggatgtggcttgagtgtgaaaactaatgccttgtgtcttttttagcttagtagtagatgtctctggatgcatgcgttggtggataatagtttgatggggtcatctccgcgttggatagcaattaaggttactgttttttttttggctattcttctgtcagttctgttgattacaacagtttttagctattttgcttgagtcatcgtctgttgacagtgatgacagtaatgtggttctcttgcaacgatgatgaacttataatgggcactctttttctttctcaaagattgttccatgataaaggaaagtacatacttttagctatgccatgcttaaagtcaccagtatttttccatttatcggataccccatgtaacaatgctacaattagttgtcgtgatctatgtttttgggctgaaatgtaagctggaaaccccagtgtgactctttaaaacctgctttcagaaaagcagggccatctggcttatcatctaaaagaaacaatgctacaattagtagcttttgcccatagttggatctcccataagacaatgctttttgctctggtactttttgcattcaaaagtatcaaatggacagacattcagtttatttcgtcttgaatgcatcttgaccgacaagggatgatcagagatggccagcttggcgactgtagtttctgtctgtaggcaactgatttgtttttgcgtcttctcaagtgcaatcctggtgtgtcaacttatttgtgttctgatgtgaacttctaagattaatttgcaggtttccgtctccatttttagctggcagaaaaatgggaaagagtttatttctgtgtgacttggggcttacttttacatgtccaattctctttcttgcattctcttttggtatgtttgacttgcagcttataggatggatattttctttaacttgcaatagactgatagtatgattctgataatcacgtgcagtcttcatggccatatataaatgttcaatatcttgattcttccataccatatgggatttccaatttgtctgatgtattcaccatttatcaacttgaactatgtaataagaactttagagcatatattttgcaccgaatgcaatccaccattcatctagttggataattcaacaggttctatgccaaaccagacttaaaaatgttatggtcctgttttttcttcaatatcattggggataagttgagttccacataaatgtagttgttaggtttctttgaatctttgtttctagcaaaaccatcagctgtttctaggaatctaagactgccttgcacaattctatatgataggaataggaagaatatctccagcaagactttcatctgcttatcatcagtatgtccatcgaagagagaacattaagtttgataaacaagaccactgcgttaaatccaaatgcacaagaatttgtaccttcatccctcagatctatcaatgatgtttcaaatagatcagacacatccaggatttctgtatcaggatcctccaaagacactattgcagatcaacaagatcctgttataccaagtaaccctgatgaagaagcacatcggtactggcaagaacagcttccagatgatattacccctgatttcaaagttctgggacaagatgagatgcctggacctgataatatttcactcactggcttgtcaataaatgatagcattggtgcttcactattttctccaaaccagacatcgaatttgcaacaccgtgcttctccttttattagggacactctgagcacacgatcaaagatcgagtttcctagcccaacttatgtagaagaacagtcaagagctactattatgagtccaactgcaagcgctatgagtccaactgcggctccgtgggtaaaaacagtaagaaatggtgtgcaatacaatgcaaacagaagggatgccagccattacaatggagattctagcattggtatagtgttgatttcatgggtgtaattttattcactgaaggtagtagtatgaaccctaacctttagaattttcaggagctccagtgcaaaaccttactgatgcatacttcggaagcaggcgcagctttagctcaactatggatatcatgagtcagctggaggtctgtttttcttctgatattcatctcaattttaaatctaccaattttttctctctccaactgtgccttggggcttggacagttgaactacatatgaatcataactggcatgctcatcatatattacagaaaatttcataacaagcaaaatgcttcatagttcttttgttttttttttaaaaaaaaaccatcaaactactttcactatatggttttacatcaactccagacaagttgtaacctgagcaaagatgtctgacaaaacaatactttgaacatttggcaatagtccttgattgaatgaatgctagactattgagtggatcttgcttcctgtcacccaattcatacaagtatacagcattataacactttttagttccagattattaacattgtagtatgatactgatctataaataatgagaccccatttaatgatccaccgatatgttttcttcaatcaactgaagtttgcacgttcaatactgaatattccatgtcatttttggcatctgggctgtattattgtttttttactctttataatcaggaacatatgttcagtttgatttttaaactggtggcactctgtaatgacctcatgtgtttgtccgagacttaatgaatgaaatagatatttgaaatttgtgactttgaagtatatttgtttgagtcaatctgatgttaatataaggaaaagcttggtggacttctagtgactgaaaactatttgaacccactgattctcctaatctacaacctattaattatttcttctcataaaagtcactcaggcaactgatttagaacattatattgttgttggacagcttaaactgtccatgctaattatgattctactggggctgtttactttcttgccaaaattaaccctaccaaattttggcaaagcaaggtaacaattcaacattgacataaattgcctcaactaccaaagttggtaattctagaatcttcctcacaaaaacttggcaaaggtagcaaaccaaatacaacttttacacatctcaaccaatttggtaaggttgattttgagattgaagtgaacagccctgaaatggcattatgttctcaaaattatcacttgcattcaactttgaatacgactatagtct

SEQ ID NO: 42983 - DNA, 7168 bp, Oryza sativa
ctgttggttctctgttttagataccacatagaagtggttgaatcatcaacatagtgtccgagacttaatcagtctcattcattctggatcagattagtctcttagcgaaactcccctacttttttactataagttcaagaaatatttgcttggaaataccatgtcgcggccatgtctgttgacgattttcttccatttggccatgcttgatgggaatgactaagatatgattacatgcatgatgtctgcttcaagcatttatttaatattatcatatgttcattagcagaataaagttgatggacgattcaatcagaatctgaggtcactgtcgtttggacattcaagtcctccatcaccagcatcatatggtcaaaatggtcttgcaaactataacaaagaagcttttggtctggcaaacaatacatatagatcccactcagctgtactcgcagatgatatactttccccttcagctggtcgggaacatatttctctggatgctcctagggggaggtacaatacaactaatttgcctgtttctggtcttggttcaagcagaggctctcagttcatggcaagctcattcaatggcaatcatgacatagtctcaaacaacaccctgcaaaatatagctggagttcaaacaggacctgcttggcttgaagctgatactgcaggtagtgttgaattataatgcatgttttttcatggacctatcacagcatacatgcctatttaccttatggttgaacttgtctgtgatgacagcaaacatgtttttggaatcaaaggatgaagctcatgattttgcaagcctacggcatgcgcttctggaacaggtgcatatgctctacttttcgatactaaattattgttacatattttaaaaccaaattattgtgcatgtgagcatgttgttaaataaatattgacagtattattattctattttaatgggactaaggttgtaagtatcgacaatattagtaatcatcaagccctaaaaagttgtaattgagttacatggttggtaacataaaaatactagcaagaaaactacttcatatcttgtcaatgtgacaaaaaagtgctctgtatcaaatatttcacagaatgagttcttttggtgatgtggtaggcttatatgttatatgactagttttcaaatccaatttggtatgacttttttttttttttggggggggggtgatggtggcacaagattattcattggattttattgacaatacatgaatattagatatggttttggaattgttgtttatagtactcaaatattatgcctcaggaagataccttgaattatgtaaacaacttactttttcttggttcttttaatgtattcgctcacagtccgctgctatgcattcaaacttttgacaggataggcaggttcttttaactggtgccaatcctttagcaaaggaactaaacatcaaggagctttacaatttgcaaagcagactagctcaggaaaaggctagagatgtatatcgccaaaggttagacgctaatctcattgacatcatcacctattaatagaattatcgtttatataaattcttactccctccattccacaaacctaggactggatatgacatatcttagttcagattcattgtactaggatatgtcacatccagtcctaggtttgttttttgtgggatggagggagtatatgttgatataatgtgtatcatgagacatcaacacacctgctcatgaaaatgattctgattgcatttgtcaatccttttcaatgagagaatttaaaacaatgcatacacttgcattttttgccttgttgagaacttgtattactatttggactttcgaataacactaggacatgaaaattacctagataatgtcataacaggtcgtacaggtagcatgaattcaggttactactaagaggtttttaattctgattcaacaataactagccaggcctttgcactactagtgtaatatattatttccttttgaactactaaggtaggtttgcataccgagcaagttgcttgagtttgcaagcgtgcactccttgtctgaatacggtgtagtagttcctacaacatgctctatctgtttaagattctatctttctgtttcttaccatatgatgaaagttctaatccattccatggctttaccagatttcaaatgccagaatttcaaggcctggttcaggagcaaaataccccaattgacctgtgtggtcttcacgtaagcgaggcgatacacgccctgaactatgagctcaacaaccggcggaagattgctcgatccacaggccgtcgtctccaggtgatcataatatcaagcacacgtactccggcgaggctgaccgccgccgtcgagcagtacctcctggagcacggcattcagtatacgcaggcacagccgggccttttccgtgtcctgttacagtgaagtaacaggatggtaggctcatcatgtttgtgtacacctttgaaagaagaagaaaaaaaagaggaggaacaaaaaagaattgacccctgtactactgtatatggcagagatgagtagtactagcagaatagaaatttgaaatagctgttgtaatattcgtatagcaaggcttttttttttgtcagcaaaaaacgttgtaaaatttgcggaattaggcgatatgttctttcaatgtggcgtccctagctgctcgttccaatctaacacgcatgcgatgcaggatgctatttggactggaatcagctgatttgcgtgcagatttgcgaaagtaatacatgacgcgacacaccatgattgaatcttcgtttaaaatcaaaatggttgacaactttctttgcaagatttttctttttagtgcgtatagcactgttcaaccggttcgtgcatttcttttttgttgctagcaactttagcaaagatgagaaagggcaaaatggcgaatagctcaaggtcgcaacaaatgcaagcagcatacaagtaaatcgtagtaaattcaaccacaacgatagaggatgatccaacaagtaaagctgatgactgttttttggagttacatgaaatggttcactgaatgtttcttggctgaacatgaaataaaatgacactgctgaaagactagagtgcagtgtgaagcagtaacatgtccaacttcattgtagctcagtcgcgctcacttatggctgttaggtgctgatcgatctcctctgtcgtgagtgctctgaaaacacgatcatctttcctcacaacaccgacctgccaaacgatagtttatctgataagcacagcgaagcagaactaaaaaaactttcagaaaagacttgcgtataaacaacagcatacctcaatctcggtggccttgaaatcttcctgaagaactgattgcaatgcagaaattgcaatctgggatcataggacaaaattagcaaataataatccagtaagaacaaaagtaaatgactggaaaaagacctcgcaatgtttacctggacagtttcctcgtaggagaactgtgggtcatccttcattttcttctccagaaaatttattgcttcctgctccttaagaccggcgctagttgcctgagaatagaataccaggtgttaaaggaaacaaatttctaatcgtccaacaaaagacagaaggctcaacattcgttcagctgataagtgaactacagaatgaaaaaggaaatatagtttaacactctaatgaagcatacagaaactgtgtataccttatgtccaaagaagtgacctgccgggtcacatttgaatagttgagcgtttttctcttcgtcatagcccaagaccatagcaactgtggaatataccaaaagaaaatgaatatggagggcaaataagatccaagctgattggtttaacattaactatagaacagaagccaatggaacaataggtcacttgatgatacgaacctactccaaggggcctcatgtaggcatgctgcgtgtagacttgtgctttgtctgctatcctgaaacataaaccagaaaagttagctatcactttgttataagaaatgcaaagatcatatattcaaccacaaccctattttcacaaatagagaacttaaggatgagacatgataccattttgctaatacgtctacgggcatctcgtagccccatttgaaacggaattcagctgcctcattccttgcttggtagactaaggaccttgcatcagctgaaaaacagaaaaaggaaaacaaagtttatgatcaatgaagaatgaaggtattcaggaaaaacaaaataagaaaatatggtctcaatgccaaattatcactagcagaacaaattatgtggaacctaatgctacaacatatatactactagaaagcaagagccttcataaggaaactgatggcaaatatgaaagagcttaattaatatggtatgcttgcatttgatccaaattttgtggtgttttcgcagtccccaaaagaaaaagggcagtgctttctaccattgccctaagagttaaaacaaacagagctaaacatactgatataccatccagtgcctcatgtacaacccaaaacaaccaggagaaccatgccctatataaagctctagcatcatcgcaaaattaaccggcaaaatcactgtgggtggtctatttccacagcatctatctcaaaattgatatctggaataacttaatcttaaacctaagacacacacaaaaaaaaaacaactttttcttcatcatcaacacgcacaaaaacataacactagttatatacagtgaagcaaagctgcagagcaaacaaacctgtgaggccagtggcgagcagaccgatgtacttggtgatcgggaacaagtgcgtgacgctcgtatggtccagcaacttgtcctgcaaaatcagaatcacatcacaaggagcaagacaaatcagtctcctctcctggtctctaatcgccgtataaacagcataaagccgcgatctttttagatcgaagcgaagagaactcaccggcactttcttctgtgtgacgacgcagacggagtccttgccgcggacgccgatcgacgtcacccccgccgacttcaccgccttgaacgcgtactctgcacaacaccaaaacaccagatcaaaccagatcagatcagcctcccaacatcacaaaaaaagcagatctaacctcgagcggggaaaaacgagggcgggcgaggctagggttttagtaaggggggagaccacgcaccgacttggtagaggcggccctccggggagaagatggtgatgtggcggtcgtagccggcgcccgtgccgcggctcatcgtcgccggatttctcgccgccgcgggtggggtttcgcgttcgctttgctccgagagaatacggcgaggcttgtgtttgtgcttggttggggaggcaaaataaaccaaaaatagaaaatagacgcacgcgacggcggcttcttcttattgcgcaagaagaagagtggagggggtccgggtcggagtctcgctgcagtttcggtcgagccggactcgagggtccgactcgggctatgggagtgggacggggggttgtggccgcatcgcagtgctggtcgcttcatagccgtcagatcatgcgaagtcaatctcctaatagcctgtgtagtttgcgaaaacgtcggatgtttgaccggatgttggaaggtattttcgaacacgaataaaaaaaactaatttcataacttgcctggaaaccacgagacgaatcttttgagcctaattaatccatcattagcacaggtgggttacggtagcacttatggctaatcatggactaattaggctcaaaagattcgtctcgcgatttcccccttaaccgtgcaattagtttttcattttatctatactagaaaaaaaatgcccgtgcgttgcaacgggtaattaaagacgtttttatcactgtgcattatacttcttcgttggttctgggccgaaaatccatccctttcttccttttcagttttagctctggttgttgtctctttccgctcggccagcctctctttggcctagcttataagtgtagctgtaaacccagctcgcacaatcaaatgcaatcttcaacctccgaaagacggtatcatgcctatagatgccgaaggcatcctacccatcaaatacagccgagtctttgtcgacctcccaaacttggctcacacaatcaaatgtgatctttaaccttcgtaagatggcctgtactccacattctggagccatcagaattgattgagggttttaaaacagcttggaaaactcgttggccagccatcatcagtaattgttaaatggagactaaatctgacgaattaaagcctacttggaactgaaaatcatggcaaaaatgataaggcagaaggggaaaaaggcatattgacgtggtggggcagattgatgtgggactatgctagggttctgccagatgacaaaaaaaaataaaccaggtggataaaagctcggaagccttacacatgcgcaatagaaaaaccgtggcagaaaagatatccaaattgacaaaaaaaaagcaacgatggaaaaaaaggaaaaaaacggatctaagatattcggattgaaaaaaaaaagaaaaaaaacgtgtgcaacaggcgatggaaaaaacggatctaaaagtcacgaccaaaaaagatcgggcggaaaaaaaccggagaaaaaaaccacgtgtgaaaaaaaaattggacggaacgcgcgagggagaaaaatcaggcgagtgacgtacgaaattttctggacaaaaacatcttaaacttttataataggtaaagatttaatactccatgcatttgtccaaatattcgatatgatatttttgagaaaaaaaatttaggaactaagcaaggcctaatatttgacatatttttcttcgttggagtggataatctggcctttgcttcggtttttgtttgaggaggggggggggtgtaggttaattagcgtctcaagcttgtcaggcataattgttatgttgttacatttcctatgggatgttattttgttttcagtagcaggatcagacgtatatgtggggtgtagtatttttttccataaatatagtttccaggtcttgtattttttttctgctatataaataaaatatcatacta

SEQ ID NO: 42984 - DNA, 10499 bp, Oryza sativa
  unsure (1)..(10499): unsure at all n locations
ttactctgtcacagaatataaagactttttttagagttgctcctttattagttttttttttgggctcattatctgtagctcaaacagtcaaagccacacataagaacaacggtggagttagaaatctaaatatttatttactaaggggagtcagtacttgatggtactaattatgtttaaaattcaatcaagatatagttattgtcattgaaaatctaaaatcatgtgggaggccttcgctgactcgagaagttgagatgattaatcctcaaaaaatcaccaataaatctacataacgccagttcggtcaggattttgcacatcctcgggaattggcagtaatttgaaccatcccaaacaagatctagggctcctttaaggcaaaggaaaactagagaaactagccgggacccgcgcgttgccgcgggtgaaatggtgggcataagagcaaagtattgacatctcatgtagctcctcagagctctacctaattatgtcaagtattagcattaccgttacagtcaaccacaaaatcgaagagtacctcagtaatagaacagttaaatcgaagagtgtacttcagtaatagaactggcttcttttgcccaaaaagtactgcaaggtatacatgctttagctatgttattattgctgaaacatctttgcttgtcacaccaccggttactaatcagtttatatgtcacaccgctttgattgctcctttgggaaaaccagtttgccaagtgctaatttacacctaaagtttagtatctactacgtatgttctaagattaatattttacacttagattggtatctatgtgttaagtgttaacggtgtcaacactatgatatgctctagtttacaactaaagattagcgcctatgtaaattaccagaaggctatatatcaagctatatgaatctgaagcaccacataacaaagacatatgccattaattttgtcaaatgttgctggaatatatggtccagtagaaatagaacaataagttagataatggagatatgtttcactggactaacagttatccgatgcattttgagctttaaagagaatataagatggatggtattagtagtttactaacaaattgtgcttctatcatcttgtttcggcgcaaaaggaacagtacatgcagttggctacaatgagggcatgatgtgacaaacagttaatttgaggttccaaatatgaagatatcgatagttcagaaataattataagtatgtgctagaagagatcatgaacatgatatatgctattcttgccaaattcctatgcttcatctttcatagagctgcagagaccaaggcagtttgctcaaaagtaaaataaataatttaagatgcacaaggtttgtagatcaaacctttagtttttaaactgtattacaccaacagtgacaattaatccctatacacagatatgtacagttgtacactccgatatagagagatggggaagcaagttggttgaactgcacatatggttgtgttcttaacaaaacctagctataagaatgcatcatttcaactgcataaaggaggaagatgcacgtatctttttaattcaatgttgttgcccagttgacatattaacctgaaaaaaaaaactgaaataggaatcccacacccatggtaccatttgtttgacccatccaaacacatggacctgcttaccatgcataagaatgctgaggacaataaaaatgtatgcattatagaatcctaacatatatagcattagctggtagcctggtacctccaacaacctagctcttttgagtcaaataagtttccttcttcatgctaaatcagtacatctcatgacatgacattttattaaccattcgatattcaatattgagatttgtaggtagtttttttaaaaaaataacataaccgagtaatttccagatatctcaatgtaacttagcacataatataagaaatattaaataagtggagataaccatcttgtacatggattgaaatacctgattataaattatagcttgttttactaacttgctgcagccatacatcaagaaatcaaatagtagtacattgcaaactctgagaaatcaccatgtgggtgctcaccggcactgagatggtcctggctcatgccacgctttatggtagaatttggttgaagatagcaaacccaatgctgggaggtactgttggcgatgccggattcaggactaatgaattaagttaggaatgatgaccaaatcaatgaagaacaggttacttaagccccatctatcagccattgctattaattccattgaacaactgtgcaaaaaaaaaaagaggccatttttggttcacgaagatccaaataaatcaactaagtatttaggtataaaaagtatacggtacaactacaacagttacaacctatgctcaacatccaagttgttatttgcttgccatagtggtactgcaagccctgaaagccacaggatggtcaactcatgccaaaaacatgctgaaagctgaaaaatttgcagaatgacaacatagaaaagaaggatatcactatacatgagaatttgtagaacaattctatggttaagagtttttcatgtaggtccaattacagcaagtattcaaaaagacaaagtcataggcaaaatttagagcaaaccttgtggtggcataactttatattttgcatgtcccattagtatttcatcactggccaagtttactctcgcaaaatttactccaaggtttagtaatatgcagcctgttactacccaatagtaacttgcaaaagacataccaactattgggcattgagcacgaaagtaagaaagaaatataggaaccccattgcaacgaattcagatcctctgcaacaggcagtcttggatgatattgcacttctgcagaagaggaacaactaaataaaaaataatgtacagagaagattgcatgtaaatttaataataataacaatttggtgatttcctattttcatggcccacacaagaactgaatagtagctcctgaaaatattttgtagaaggaaaaaaataacctgtgcacgaaaggtcatgataggcatccatgcttaactatctgttctttatttgagaagttgtcaaccatctgtcctaaaagtgtggtggttggaaatgtatggatggcagcccatagtcaatgaacgatgtttttaatatcctgcagtggttcactgcgcaatattgtcaatataactatagaagaatcaacttggatgtccctagatgaaattgtgaacatgagatccaaatcctcctaagcaaataaaagattgaaactgatagcaagaaagaaggggaagcacctaagagaattcatcaggagcagctgacgagatcatgggacctgcatgaagacctatcaatcaaatcaggaaaattggacacgaactggaacaaagaatcattaaatctataacctctcattgagaactgacgcgacgaaaagacggcggcaacggcgctggcctgtgcttccccgagaagcggcagtgccgaccagctctgcgaggaggcggcacaagccgttggctccgcctgaaggcagcggtggccggcttcggaagaggagggcggcggccggttgtggcgcttgcccgatggctccgtgagaaagcagccagcgccggctagatctgtcgcggcgctggtccttcgctcgctcgacaagaacctggcggcaccagcgagggcggcgaagccagcgccgtgatttccctcgctccgcaagaacgcagcggcgccggctagggcggcgaaccaggggaggatttggggatgagaaaaggaatcagggaggatgattcacgaattaacttgagaacctgggtaaggggacagagaggtagatcaggatagcggtggtggcgccatgcttcgtagccaccacagtcgccgaggtccggcggcgacgggccgaaggaatcaatccgcaaaaggcggcgacggcggtgacggtcgggcgtcgcgggaggaagatggcgcggcggtgacagccgggcgccgcgggaggaagacggcgccagccgagcatcgcaggaggaagacagcgctgcggcatggtgggaggaagacagcgcggcggcggcgccgagaagacgaggatttggggatttttggcaaggaggcggcgaggatgtctaggcggtggctggtgtggtgattgagtggactgaggggatggagggatgagcgatgaccatgtggacggctggatggaatcaccagttggacatctgacggcgcatgcatggcgagggactgtagtactgtagcagcatttctctggcctgagatgaatcgcaacactgttgctagtgggtcacgaaaactaaagatttgatatgatatgatttgggaggattaaatttgtatggcaaaaaaaaaatcctatatggttctttggaacaaaggaatggttcttctcaattcctttaaaattcttatggaacgggccatttcgagctcttttgaaatccaaaagtccatagaagtgctggaggaagagtagcatgcatttctgtcccatgttttttttcttcccgtgacataaagttctagtatttttttcctgtgttatccaaacggcaatttttaaaatttcccaaggtttttaattcctgtaggaattgaataggcatggcactttattgctatgcttttcctcttactgcgtttccacaatcctgtgttccaaaagagccctagtcatcctttggaatggaacaatgctggaggatttctcaaaaattgaactagtttccgcggaaatcctgcaaaattcttccaaaaggagaccctaagctgtactgtttagtgatactcaaacaaattctgcagttctctatgtcatagttgtcttcttttttttttgaagaacatttttactaccatcaaaacaaacacttatagtagaaatggcaagagtcacaaggcagagtgatccaagcaaattgtccgagttgaaatgactcgtgtacgatctctcactctcctgaagtcctgattgttagaagtataatatgttagttagatataagagtcaaatacaaatatagagataagatatatcctagagataaaattctagagataagatagagtcctagagatagaatcctagagataaatctactcttacttgtattgtactccaagtctctatcctctatgtactcctatatatatcccatgagagggtcgatccaatatatcagaaaacatcagaatacaacatattagattttctacatggtatcagagccatatactagcgtcaaccgatcctttgatacaatccatccatccttcggcgctgccccagggagacgagatgaatctgtaagctctccctggggcaacacaagctagctagcctctcctgtatcatctacagattagattagccaaagatcattagatgtgttttccattaattatcattagattaggggaatgttaaaagtataatatgttagttagagataagagtcaaatacaaatatagagataagatatatcctagagatagagtcctagagataagatagagtactagagatagaatcctagagataaatctactcttacttgtattgtactccaaagtctctatcccctatgtactcctatatataccccatgagagagtcgatgtaatagattagaaaacaacaaaatacaacagtttagatttttccacatggtatcagagccaaagaccaacgttgcttgatccgtttctaccttccgctcgcgccgccccggggagatgagataatcgccatatcctccctggggcgccacatctacaatcctcgggagaagagaaggagcggaagccacgccagtatgaacaggagaaaaaggaagcaatgcatgaatcaatcccatctagcagatcaagaaagaacaaaaggaggaaaaggagatcggtccaagcaatcatgccgtacgatggaaaatcaatctcgccgaagcatgctctgacagattaatctgcaagacgcttcatcaacgatatcgaccgcgtcctctacgacggcaacgaccgcgacaccgacgacggcatcgatcacgtcatctacgacgacaacgactgcatcaatccagcatcaccattgtgatgaccgctacacggcgcagaaggaccaaccaaagtggtggcctcatcgccaacgacatcctctgatatatgcaagacgtccccaacggcatcatctgacatctacaagatgcaagatgctaacaattgcagtttttgtcttcacaccatggcgtaaatattttttttcgccttcggctatttgcggctacatcaactaccacgaccacggctacttcatgatcggctacatcgacgaacatctacaacaaaaatcattgatggaaactccagtcaaaagcgtccgtgtcatcgctatcatccatgacactcccgctatgactgcgggagggaatagaggagagtcaagggacgacacagaaggggacgcaggcaccaggtggaggaacgaccatcagagatgcaatcgatgatgatgactcaaagagatgaagaaatagaagatttcaaatccagtcgcaatcgttagctttgctcccgttacgactgagggggaatgttagaagtataatatgttagttagagataagagtcaaatacaaatatagagataagatatatcctagagataagatagagtcctagagatagaatcctagactccaagtctctatcccctatgtactcctatatataccccatgagagggtcgatccaatatatcagaaaacatcagaatacaacatattagattttccacactgatcgccgaaaaaagtacacaagaactcccactatcctgcttacttgcttcctgatttgagtatgaaaccgtcaatttcagaacacagcaaacacatgatatggcaacaaacacttgaaaatttatgtggctaagtttgtcacacggcaatgcttcttggaagcaccatactgcgatctatcttaatgtttcttttctcggctctcggtgcaatttccccctctagtactgactttcccttttcatctcagctgcaatcaagaattttgttcatcggtactgggtcctgcttccaatcaagctcaactgggaatgtgtacagctcaagatatataaaattgcatcctagtttgctggacatggcagtggccatgagcctatcctaagataagatatcaaccaaatctcctgagtaatttggtcacatggaatatctgttcatctctcctcaactaggccagatccctatttggaatgttaaggagtaccaagctgccattcatctttgagctctgcatttctgccataattcctgtgagatgtgacagtaatcaccttgacactgtagtagtcagagagaaattcttcattctccaatcctgcatacgcatgcttctgtaaagttgcaacaagatcagagtttacccctatatatagtgaacttggagtcttggatcatcatccatcttcttcttcccattgagtccattcatccacatttttcttctgaactcgcacacaagaggtcacgagaactgctcatgagggtacacactcgattctctggttcttctgaacttttttacatcgaatgacaaatgctaattcagcaatcgttgctgctgctggttctacttcggtttcaggctctgaactgggtgcagacaaggctccacgggacgaggaaacaagatcacactgcagtgtcatctcgacgtaagtgacgatggttttttttttctcctttcagaattcccagcgtttcagagtttcagtcacgtaattgttgctgaatctttgatctcttgcaggcgctcatacctccggtgatctccaccggaacggcgacgagctcgacgacggctgggcggcggcgatgctgtccataggcacgttagggggaccgaagggccgtcatggttctggcacgccgtggacgacggcggcggcgggcgccgacgagctcgacaggctgcaggaggagctcaggctgctggttcgagctcaggcggtggtgaccggaggcgaggacgacgacggcggcggcggcggcggcaggcaacgcaggtcactgagccgcacgtcgagctccacgaatggcagagaggtggtggccaagctgaagcagagatcgatcaggaagatcatggccgctgctctcggtggcctcctgcaccggccgagctgcagggagacgatgcctgaagcgactgtcagtgaggtagtaggagtaggactactccaatataaagagcatatttgttcattcgattttcagaaatcagaaggaaattcgtattggttcttgtgatttcatgctgatatgtttcgcagattatatggtcattgttgcacaagaacacgcatcctgaaaaaccggcgttgccacatactgtgatgaaaggtgatccaacggttccgacgccacagaaggataaacaagagggcaccaaatggatcagaacagattcagagtgtaagttcatgttcgtctgacagaaaatgagaatagtatattgtagcggttcttgcaggctaacatatatagaatctgatgttttacatccttgaattcattccccagacattgtgttggatctggagatatagacacccccggtggcagtaaagaggcaacaagaacaatttcctggatttttttttcttttcttgagagaggagactagcgtttcttttttgtacgaccgtacttcagtacatgtacatgtctgtttacaaaacgtgttgtcaacttctattacaaaaaagggtttcccttttgcttaccaaataaaatatcaaaggagattcgagtcaggtcctatatcaaactaaagggtcagttctagttgtcatacatcctgccttggtgtaagcaaacaaaaatatgatatggtctctccccaaccttcaaatgtacatatgccatatgctcactcaagtgcacagtgcgcctataatctctggaatgaacagatgttcaagcaagctgtaacaaatacatgatttgcctacctgtcgaatgttatcatgcatttcaacctatgacctgcaatttgagaaagggaaggtaaggcttataatctatggaatgctgtcatgcatttcaacctatgacctgcaactgcaaatttccttacgaaagaaattggtaaggcatactcaggtgactgtaatgaccatatttagtcatttaggttcaagatccgacctggttcaccaaggggagtgcataacgttcccattctgtcgaccatttggaagatgacccagtattcaaggcaccaaccttgagggatttcaagtcatcgcattcttccggaaaccccttaaagagcatctgcatggatttgcgattgcaacaattaaaatctagacacagcactttcaacaagtatttaaaaaaaagatatgaacataaaatatggaaataaataattaaaagtgatcatcaccataagttcatcggcaagctcagaagatgttgaaaaaagaagtccattattatttatttttacaagctcatcaatgctgcacatacgaaaaaaaaattaggacatacttttaattcaaacgacatgaaggtcaaagcccaaatgtaacaaatcaaacatacgggaaacatggattaccaggagaatgaagcagcacaaactggtaatccacaaccgaacatatcaaccacctaaaagcaaaatcgtcaagttacacgcaacagataaaaaatgcctattttttcaacagagcggatgcttatgagttataccttcataggtaggtctagccctgaagaggaagtatgcaatgatacacctagatcagccgatcctgtaattattcaaagaatcagcatttatgctacaacatggaattcttttggcaatcaactagtttaccaagcaaaagagggtagtcctctgatgcaagccacatagtccggaaggcaacacgcctcagtttcaacctctttatttgctcctcatacttcatcctatcaggtcctttgccttcaaaattgatattcatggatatcataacaatactcaaaaactggttactggagctaattagcagaatgcacaaaccagtgataatgaatagcagtcttgggtagacaaattgcttcccgttcttgatatcaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42985 - DNA, 17180 bp, Oryza sativa
aattggtcctgagtcaacagtactgccggaacgtaggtctccaatggctccagcttcttcctaagcattacaaatttaagaagcaacaaggctttcagtggaaatcaaaagctgcaacctgcggaaatgcaatgtactagtaggagtactaaatttatgaagggagagcaaggtacggataagtacttcttgacgtatttgtcaaacgggctcgcgtctgcccctgcaacatcaaaagttgggaagcagatcagaaacaaatttactcgcacacccgaaacactgagctccgatcccgacacgaacacgcgcgcgcgagagagagagacgaacagcatgctgcatgcagctggacttacggccggcagcagtggcggtgagccaggaggcgacgccggcgagggagacggcgcggcggccgattccacccgccgcggcggcgacctggcagaatcgtcggcggcgagacggaggcggtgaggggcagaggtgcccgccgccggaggtggtggggaggagcgaggtgggcattctggctgcctgctgcgacgcgacggcgggcgaggcggcctccggctacggttagttgagtgtagagggctgggccccttttgcacgacagccactcgtgtccaagttgtttttttctttcctcgcaacacggcgaaagctatgcgcgcgctcggtgcagatgcacgctacgtgggctcggggttgccaggagaaacactctacggagtacgtgggagaggatagcaaacgtagcatctcagtttcaggtgcaaccgtgcaacggtgcaagcctgcaaggcatgtgtaaagtttgtcacatgggcttgtttaggttgcgtttggttcgtggtgtccatccatccatgtgtttgagggtgcgctcttttcagcttataggattagattctcctcgctttttcgttagcacgcttttcaaactgctaaacggtatatttcgtgcgaaaacttcctataaagaagttgttaaaaaaatccaacaaatttattcataaaaaaatatatattaatatttaattaatcatatgctaatcgtatttctcgtttgcgtgcggctaaacagtccaccgccactgctaaacgatcacaccctgagtttgtcatatggtgattctgttttcttttagcaaggtggatatggtcatccaattcttatttgattggatgaatgagaagggatgggatgaaaccaataagatattaatatgttaattatcgttaatatagcataatctatactaattaacaataaatagactaattatgtctaattaacattaattctgacaagataattgctaattaacaacaaaaatatattaattattgctaatcaatcactaatgatcaacgaagttggatatcctcatctggccaatttggctggatacggtcatccagcatctttgtggaatattctctttctggttgtcctatccaccctcacctaccaaccaaacatactaacaaactggataggcatatccctcaaactaaacacacccttggttgcttgccaaatttttacagtaggattgttcgactcaattgaatgaattggctttccagagagctattagcgtgtattacaatttaaaaagatgggggtttttttttggaaagaaactatgtaaagaatttattttaaaaattgaaaatttagcattttggaaaatatgtttacagaaaacaagtaataatcaactcaagaagctgattcaaactcagacaagtttaaatttttagtgtgagggtttgagtgaagctaaagatatggcatatgatacactttcctactcttatggtccatatgttatgcactcgttagtataaaagcttgtcacaagtatgggcgtatggctcttttttggttgccaagaaactatggtgtaccacatgcaaataagtatggcaaagtgggtaagctatccaaacagccccatacttacgccacgtggggcctgtgtagtgtgttaccactatccagtttatggttcgtgagagttgtttttctcttcttcgctataaatcttcgaaacgccgtgggaatcagcaaccgtcgtcattcttggttgcactggcacagtttgcacgaggctgaaaagatgaaagaaaacaaaatacccaaataatcagtaatgttttcattgcaaataaagtagagttttcttttttctaatacctgcctatggctctaaggacaacattgattttgctcctgatggcttcagcatgtgctgacggataactggttgactcttgtaatacctgattcaggtcttccgaagctctaagagatagaaagacattgccactcacaagctgagctaaagttctttcaagaaaaaagacaaaaagatgtgcatttggaatatttttcatgtatataccgtaagcaaatattcacagctttggaggccgctttctcaatatcattagaagcataatatccagcaacctgcgtcacgaattttgtagggtcagctaagttcaggtgtggataattcggaatcaagaaatccaattatggaatgaaagtatgctagcaattgccagtttgacaaggcaaataagatcttgaagcttgtggaaacaaatacacttgcatggtttgaagaaacatataggaacacaaagcttgaaagcagattagcaaaacaagggtgtgtttagttcatgccaagattggaagtttggttgaaattgaaacgatgtgacggaaaagttggaagtttgtgtgtgtaggaaagttttgatgtgatggaaaagttggaagtttgaagaaaaagtttggatctaaactcggcccaataagacatataatcagaacagaacttacattctgaatattggaatgcagagatgatactggactggactgaacgagtgacctgtactcctcgaagtttgacctctcaaattctgagcaatcgtctgcatcgaaccatatatatagaaacctcaggtaggctatatcacacaaaatgtatatgcaaaatatagccacaagttcaagatgtttagtacagatgtttgcggaggcaaacaaatacttgggaaaaggggtgaacttaaacttaaaatgaacgcttccatcaaaaggtaagacaacacacaaatgaaaaatggggagactgcaattttccgaacatactcctcgtcacaaaataatgtcttttttttaagaatccgttactagaaaagctttcatagtattacacttgtctaactattttacaatttatgcaaaagaattaggtgatcagagttatgtcttatattggctttgacgagtccaaaacgacattattttgtgactagagggagtactatattttacttgaatgtgcatttagtactgtagagcaatttatgtattctttttgtatatggcaaggaaattagaggtagacatgtgacaaccattggtatatgttggatgcacatcaacacatatggggttgcagtgctatacaataataaaatcaaattcaaaggaaaaacggtgttttagttaaaggacttctcattaccaagttcattcaacgagtcttgagtccgtagcgcttccagaacacggtcctgaagatgatttctgaccatgcattcagtagcagcagagggagaaatcaatcggacatcatgcaaaatgaaaaactaaagctggcagcaagtatggtgtcaactgcaaatgttctatacttgtcacaacatattggattacctcttggtgtactcgcccacaggattgggaatgacaacccctacaaaaaattggatacaacataacagttacacaccatatatgggaaaagaacatcatataacttctcacttatcagcaaaacaatcttcggcttcaatccgaggtcccatctcacaagctcaggattgtaatccaagtcacaaagtgttttgggctagtatcatatagtcactgcaaggttatacaagttgtcttcgtcgaatttctttatcataccataaacagtatgtacaaacgcacaattaacatttacagcagtgagccacagggtcctgctggagatgaaggttgcacaagatgccaacggccaagccaatccatggtgataatatggttgctggggattgacagtgccaccagacctcatcaaggaaagtggaggtgtcaaaaagtggggaaaggccacaacctctagctggctactgtgacacaaggcctagacctctagctatgtggattttgatcgcacgttgttttgagcatgaggtacagcttcacgcatgtttgtaagacatcaaaatgtatggatcaatgcatgagtaacctagttgagtgcaaggaaacagccgaaaacaactaaaactactgaaatgaacagtctcaacgacaattctgccagtgcagagacattctgagacaaacccattacgcaaccaagatttaagttcctggggaacataagcttctgaaaacaaaaaatttggcggtcacctgaggtaatcttgaggtacttggagaatgcacagggacgacaatctgaacagagaacggagaacctttcagcagaaattggggccacagcttgcagagtgttctgtttcatgtcaacagagatgatccaggcatttttgtcttcttcagtcatcgtggacatcatgtaaacaaaatcgtcgtcatacatgctcagagtggggatagtacaaatcagtttcttcaattgcatcattttggtattatcgtcccatagatcgggcaaaacagtggagtaactgggatcaaccaagatgtcaaatttgtcaactgagaaacgcttgcgccaatctttccaagaaagcatcctattccatatcgtggctttccaaccattaccattgacgtcgtcactgtagcagtattctatgtccacaaacttgatcaaaccatcgcagcaggcgacatcccgagcacactctggggctatttcaccgcatacagttgcaccgtacgcatctatggtgtacaccactggcttagggaatgtcatatatctcataaccgggtagtcgtcgaacagcttttcgagcagaataataccacgccagagatcgaccaaacccaacgaatcgtgtccaatggtgatcagcttgtcggtctcatgctcgatcgctaccttgtgaatctcagacggggacaagtccagcaagactggtttgctgctccaccttccggtcttggatgagaaggtgcatagctcgaactggcaagcctcatcagaggccacccattcagaattgaggaaggccacatcatagtgctcactgacgccgctgcggcaagggaagaggccaaattgctgggagttgaagggcatggcattggggtcaggaagcaggtcgagccatggacgcccggggccagcggtgtagacgaagtagttgcacgggctcatgtaggtgccagacctcctgggacgcggggacaaattgacgcggaagagaacgagggatccttccgcggcgagaacggagggctcgtcggagaagccgtcccccccttcagtcccgggcaatggacggtgaagtaggaataacccggcggatcgacgagtcagaaggacacctggacgatctggccctcgctcgtctgggattcagccgtggacgcgttccggcggtcggagatgtacgctgttttatccagcatgacccagtcgggagagccagagcgtcgggaggcggcgccggggccagcggcgtatggattcaccagcgtgggtgtacggtacgaaacggggcaaatcgtcatgagatgatgaaggcgggttgggggatgggcggtgccggaggcaaaggcggaggcggaagaggcgcaccgggttagatgaggagcggcgcccggtcgtgcagggcagaggaggcagccgctcgggtcaggtggaggaagcaccgggatggagattggactttggaggagggcgtcgggtcgggtggcggcccagatctgaagaatgtcacggtggaccgagcaggattgccatcaacgtacgtccggcctatcgatggagtccggaagggaggggagagggggcctgcgggcctgttacggtaactgggctctgcctttctgctgcgtaagtgcgagcccgccacgatgacccgctatggagctcggcccggctgttgggtcctttcggttttgcacaaccacttacgtaggggcattgctaggctacattagcgttgctaaattacgttgaccaacctgttgtgctacattaaatcatgacacgtagctaaatatgtaatttacaagataatggatggttcaagtttaagggcatgctcggtatttcacacatcttgaaacttaggggcgcgtagatattgctctatcggtagaagggtggtccgacatgtagttcactcaacatcttgaccactacttcatccatttcacaatataagtcattctagcattttccacattcgtattgatgttgacgaatctacatagatatatgtctagattcattaacatcaatatgaatgtgaaaaatgctaaaatgacttacattatgaaacggatggagtactttgtttaagtgcttgtggaaaattagcggagaaaacgtccataatatggcaatagacacgaataaaggttcgctaaaaaaatgtaaacaagtctatattgtatggttgttacttcgtactccctccgtccaacagatataagattggacgtgacacattattgtatggttgttttcttatgaaacaaagggagtagttgttaccccatgttgtgagccgtgatgtacgtttgcgttgggacgtgtctttaaattgatgtacgagattgaggttattggggcacgggccttgacttataatggattattacgagcgcttatataagcaccgggtaagggatttatagagtatttattctctaatatcttaaaagcagaatcgtcctcctttcatcttctcctcccacttcacctagtgtgtccgtacaccgaaagtaattactacattcaatattttattctcaatcaccttcctaacttctctatttacatggacctggaactggttgattgcttcatgtaatcacctcgtttcttcaatggaaacaggagaagatcttacctctatttctaaaaaaacgctatttatatgagtttagtctgttataaagtacaagtatgctaatatgttattaatggaagaaattaagaacaaaacccaaatcgaatactgctcctctgcttttcttcctgttgttcttcccctgctcggcaagcaaaatctacccaaactcctatgttttggcgagacgccaacgatttgtcaccaatcgtgatagagaaccgcacaagccaacatacaaaatggcaacggtagcacaaagagctcagttgcgcagattacgggaaaagcttgaactggacctaaaaaatttataggcgtagcgtattactataagtcttaagttttaacaggtgatcgacagcccaaactgccagtatatcaaggtaaaccagtcagagacaatagctgcttccacatttccacatgagatcctcacttcccagcacatagaggcattgtttggataatgtgatagggaaatgatttcccacccatcaaaaggtatctttaaatcctagccatttattctctctcttccatttaatccaatcccttcgttcattttccaatcccaatcccaccctctttcccattatccaaacacacccagaggtgtggctagctctagctctagagagacgccttacacttgagcacgaagccgagcagcagcagcgtggccatgaggccgcaggatgagcccccgacgcggtgtatccagtaggggtcgaacctgaccaccctccggtccacgaagcacgtaacgttgatggccaggatcagcacgatcagcagcgccggcagcagcagcgccgacacgccgccgccctcctcgtcgtcgtcgctgtcccacgccgccggccgccgccggtcgatgtacagcggcgagagcacggcgagcaccgccaggacgacgcacaccagcctctccgtcgacgacggcctccccatggcggcagctctcctctctaccgctctctgaaagtctgaagaggctagctatgcgagaatgctgccttggctgttcagaatataacttgtttatgctgtctcaaccaatcttcagaaactaggagagaacctaacgacattttcttatcgccaaggcttttgactattgatgattgattcctatcatgcaaaaggaacatattcagactgtccatgattatccacggatctgtggcgagaattggactgcgatgtaaaggcgagattcttcctagctagtgagctcggaatcggattccgggacaggcagctcaagatttggggtatcctagaacagcgtggctgatggacgtaggatcaaaattgacggtcctgatcgttttgatgggaggaagagtaaagctgagctcttccccctgatcatactgaactttgttcgtgaagcaccagcctgatgtcattgcctgttcgatactagtacgaatgattttagaatcggtacggcacgattactctgcttacacctgttcttggaacgagaaaaatagcatgaatcctgcactttatttgcctgtgtattgtactaatatattgtgagacagagcatctttctatctgtttattattagctgttaggcaagtaagcagaagtgtgagcatcaaggttggcatcaggttgaagcggtttggtctgaaacggtaggccaaagcagatgagaaaaggcgagatgaatgtatccaaacaaggtccttcaagctagagtttcagtcttccaaagagaaaggctaagctatagcatttcgtagatgatgccattggaaggttcatgatatgaaaacaaagtgacttgaaggaatgttaggctggtggatttccccaaacaagtgtccacaactcataaatactccttgtatctgaacaatttatttccgaataaagtaaaagttctccgggaaacaagtaaattatgaataaaaaatacacacactaaactaaccttcacgatactattagtccccgccattatctagcccatgcgaatcttgcttatattctcttaaacaggtatacccactgttttgagtttttggcttaacctcaaaccaatgtgccatcatgtcctgtttagatgtagtgacaattcaatagcctatgcatccaaaaaataaacagattcgcgaatgcccatcaaccaatcatagattgatatccatccataaacagcaacacatagagccccatcgattggtcacacaagtcaaagcaaaagagaaaatttgaattttcgaacttgataaaatattttcaacataatttttttagtgttgacttttaaattaataaactgttttggtttattagagaatatgatcaactaacgaggctgttatactactcctatcaccaccctggagctttcctgaaatccatgtgtacagccatcaggatagcaaagcaccatgaacacgaacgcgacgcttcttctgtcacgtacgcccgtccctcatatggccaatcgcgtcgtcaaatggtccagagttcagacagccatgggccatggaaccatggaagggagccgaccggaccacctcaccaccgcgtgactggacgcggctgtaaaagtgggtcccaccccacccacccggacccactctccaggcccacagaaacaagcgaaacggatagcggaaaaaagagagaagaaaagagaagggaggggaaggcaaggcataggtagacctcaccggacgccgacgcggaggagctcatcactggccagctgccgccgccgccgccaccactgctccgcctccgattgctgccgtctctcctcgcggggtgggtggggggggggtgtatggcgaccggctccgtcgtggcgccgccgccgtcgctggccggcggggggcgagggctccgtcggcggggagtcctccaccggcgtctcgcggcctcgcctatgtgagcgctctggttcgatttttttgccttgttttgcgtcgggttcgtctggtgctatgcccccccggtcccgggtcctagttctttacaaagaattgcgttcatttcttgctgattgtgaagtaggggaaactggggaaatgaggaaattacttgagtggtgaaaaaagaaattaaggaggtttaggggtgttattgattagtgacttgctggatttccttttgcaagttatattgatggcaagaaaggctgatcaattagttcaatgtaggatcacgctcttgctatgtcggattggtgggtgtatttatatggttactgattgtattacagttttacaccacacaaatattttttttgtgctacaaatttagacatgaactgcaataaactcctctctttgtaagacgtagcagcgagcagtgatgactcctagtactttgtattttgtgatagttatgagttgctgtgtggaaatttggaaagtttggtccaagtagacaccttcatagatgcacaatttggagctagtactttgtattttgtgatggttatgacttgctgtgtggaaatttggaaagtttggtccaagtagacaccttcattgatgcacaatttggagcatttggtttgataggcaagaattgagatagcattgggcactcagaaaagtgcggagtaactcttacacagcatttatgcactgtcgatgcatcttgccgtcttcctcattattttcatacaaaatcagcattttttcccaggaaagatgaacctgtggcttcgacgaatggcggcaaagatgaaatggtcaccgacagcctcagtgttgctagaagagcctctcaccctgggctttcatcaagcttatctaatccaatgtcagaagtcaccacacctttccatccagctgcgccatctgatcttcgtttcaatcgtcttcgaccctcagttgaggaaagtgattgcaaatacaaaagattttttggctgctatgttgctcgggaggctataattgatgaggaatactgggtatatttcttgtcacctgtagaaaacattagattgttaactctgggaaatacactactacaattttcgctgacatagcctgtacaggtattttggagtattctgatgtttactgttatatgctaataccgttgtcgtcaacacgcctttcgttttgcatgctaatattgctcctaagatgagaccactagctaacacttatgttcctagtcttttaagctcaccttttagtttgtattatgaaattgtaatattcactttaacataaatgtgtaactttccttgtaccatcatcttgatagattgctgcatggttgagagcagagaatcgatatgaagatcagtcaagcgatcggttagtgtttgatttgcaagcaaattttatgcagcctcctctgttgtttgtactgcttttaacatatgatcagtgctatcctcatggttgacatttatttaccatcatttttactgcagctatgttgaaagcttcaaaaggaagtttgcatcgcaggtacacgggtaatcaattggttactagtttatgtctgtttgaaggcaattgggatgcctcctgctcaaatagctctgcttaaattgacaatgtgtcaaaacgttccattaatttgccgcctaatgtcattcaatacttcatgttgcggtttgtgtgtatcattgttggctatctttctgcaggaatttcatgcattaaagaggcgatgtagcaagctgcaaggagagaagtatatctgttttgttgcggtatgagacaaaagctccacgtatttggtctatcaaatttggtattaaatcttggatccagcatgttagttcataggaaatacttgcaagggatgaacacatggcaaaatgactaccacaaatcaccgtgggggcttcctccactgtttcccggtcaaaaaagtaaaaaggctaccacaaccaacaagtgaaaagttgacagtttttttgtctaatactacaatacttgctatatattctggtttatagagttgaactgacttgcagttgctttaccgacattttgcttatatttcacaattgaaaaatgtctgtctctggtgtaatatttcaggtaaaaaatgatgatctcaagcgaactgttttgaatagcgtcgttggcaccctggatgtttgtataaggcatcctctgcatggggagacatttcctgcggtatggaaaaatagcagtatagcacccatgttttttatataacttctacaatttttttatggtggaaaattacatctcaaagttcttcccaggagcctggaaagtcatcatttcattgtagaatataccagccagatcagccaaagtttgggtatctgacaaatgtttgtgttgctaaatatgcacggcgtcaagggatcgccagcaatatgttgttactggccatagatgctgcaagactcaatggtaaagcaagaagttgtttttaattaaaaaatgaaacaatgttattgtgtactagttagtacatataccagataatactgatccatctactgttatcttcaaccctgctttaggtgctgaagaagtttatattcatgtgcataaggataatctaccagctcggaggctctatgatcagataggattcagggtatatatactatcttgttttgctatagttctaaaaaaaatcatttggttatataggcctaaatataaattacacttcttctatgcgtttgtagatggttgacttcgatggtgctcgtcagtcgtcagatctatgcttactctccttcagttcctaggacttggatttttaatacgatggagttttgatcccatctccctgtgcagatgaaatgccactggtccttgtgatttggaaagcaggacggtgtcacgaatacatttacaatcttgtacatcaggatagtgtgaaatgtttgtaactttggaattgacgatgggttaacctatcttgttctgatgccctggaatgctgtggcatctgaatgcttaccaggtttcttttacagttttattgtacagtttgtgaagactgctaaaagttgttggtccgttctgtcgttctgtaaggagataaccaatgcaaaacaccaaagcttgtgttgcattgtcgtgtgaagtttaccacatacgagtaccatactcacactgccaaacacaaaaccatactcacactgccacacacaaaaaatgtgcaaatacctttcatataattgactataactattcacgaactcgttccaaacaatgtaagttcatcaccagttaaccactcagcagtttcagcttcagtactaaaagcaccattgtttggcatatttttattacatatgccgtatcagcgataaattacaatttaatccttaacaatttatgagtaaaccacgatgaaaaaaaaaaaaccaaaaccagcttcgaaattaagttttaaattttaagatttggtaaagaaactatgggatacaaaatagccatctgcaaccaataacaacgggtgaaaattgaaacacagccctatgatacagggtctccgagaattggaaaacaatcgcaaggtccgtgcttggaccctcctccgagcacgatacttgtagagtgacctttgggtccaatcaaagatgatcaaataaggttatttttcatatgaatatatctactatagcacaataaaacttaagtcttcgaagatactcataggatagtgtttgcgtgcgttcatgtaggatagggtttacgtgcgtgcgttcatatgggtgagtgtgcgttcatgtaggatagggtttacgtgcgtgcgttcatatgggtgagtgtgcgtgtgttgtgaatgtctaccgttgtactatataactttttttaaaaaaaacttataaaccacttcgtattctatctaccactagtaatatgcccgtgctaaacgctacggtactactttatttgtctttaataatttttaaaattttcatgttagcaaaaaaaaaaactattatatgaactgtgcatttgagttttaattcaatttatgtcatagatcaaatatatttcatgtaaagtataataatatgatataccaattcatgcagatatataatgcatatatctgtgtttaagtcatatgatattaaagatatatgataatgcgtatatttatgccttaagtcataataatgcataataatatgatatattaaggcataaatccgtgacacacaaaaaaattaggaatatcaagttaatcaggaatggagtatgtgcgccgtcaaaaaaatgatatcattacaaaggaacaactaaatctttgatgtggtagtagtacaggtcttagaccctgtttagatgggactaaaactttaaaagtccctattacatcgtatgtttggacactaattataaatattaaacgtagactattaataaaatccatccataatcttggactaattcgcgaggcgaatctattgagcttaattaattcatgattagcctatatgatgctagagtaaacattctctaattatggattaattaggcttaaaaattttgtctcgcaaattagttttcatttatgtaattagttttgtaagtagtctatatgtaatactctaaattagtgtctaaatacagagactaaatttaagtccctggatccaaacaccaccttactttgaatatttccaaggctcaaatgaacaaaaacttctgcaatgtattgattattttgcctcagattgggcgactaaggatagcagatctgttgacaaacaatatggttctgatttcaggagaccataccaccaatatattgcccaaaattggatatttttgcaattatacggttttcagatagcaaatagtgcatgtggcattaatcacaacctatgcatgtgctgataatttcccttttcttgagagggagagaaattctgttacatgcttggtgatttgataatataaaactgttttttgttatataaatttcagtatatacccctataggaaataaagcagcatatatcctctctatagaaaaatgcagtatatatgctcgtaatggtgaaaaaaaatggcacataggagacattgcagtatatacttttgtatataaaaaaaatcagtatatgcatttacaggaaacattcagcatatgcatctacaggaaaatttagcatacaaatctgaaagcatgcaaggactgaagtacacaatatccatctatttctataaagatattcaatctaattgtctcctaatcaaccactggcaataatttttggggcatacttttgactatggtgataaaatgattatcctcacctgcaaacgagtagaaaattttagacactgaatgatcttgcagtagaaaaatacatgtactaacctgctgctttgccacatgtacgtgaatactctgctgctctccttcagatgtgttcatcacatcagggcaaaagaaaccagatggcggccaggctgatgtggcgacgatggcggtattcaacaagtcaatatatcctgcaacgaggagaacaatggtgtcaactgtacatcattgagcagacagacaaacaaatcaacatgttgttgatgaatgaattatcaattgagcatcatccatgtcttgtttcaaaatccatctctttcttctttggttgtagtggttccactccggttatgtttcaaggttcgttttctctttctcgttgccacgacaatatgaggcttcttctaccagtaccagcaaaccaatgcccacataagcaacacctagctagtaacaaaattcatggcttgaatcttaggaactattaggcttgtttgccggcagtcagatctaaccttcatcttgcatctaaaaatatagttctattcctaataagcactaaagaattaaaagatctgccatcacaaaagagtaacccatctgaactacatggagctatttactcaaagatcaagattcacaattattagctagtcctctgtactataatgcatcagaacagagcagtatccatcacttaatctgatcgagcttgacaatgtaattagccatgtacaaatgaataagtgcgatttagattgcacagaaacatgtatcttcaatgacacggccaggccgatgacatactattcctttagcaaacaaggacatgccgatgaccatataaaaacaatatatttgtacaattaattggaaatggagaaaaaaattcataaacccctaacatcagttgttatgcatatggatatatataactaattatgggatgaaataggatggtttccttcaggacacatccccagtacttttgagtctttcaccgcttagtactatcatataatccaatatgctgttatactatactccaccgttttgtgtcgacctactaatactatatccatcctatagctagttaatgagaatcaattaagcttcagaaggaggtgtcaatttaaaagcaatcgaaataataagcacttggttaactacagtcacaggttcacagtgcacttggatgccttctcaaatgccgagatatcactaataggtaagaaattattataaataccaactgagaataacatattccagcggtacaaaatggttttttccaagtacatgtaataccgtgttaattggtaatttgattacagttcacaggaaccccattataaaaacattgaaaattggcaacacacagtaaaggaaattaagcgaattaattggatataccttcaatgcagggaaggaggttatgtgggtgggaagctactgttcgaactgatctggtaacacatgatctcatatatatgtcagtacattcatttatacgcctaccgaaatcatccgtcaaaagtatataccaataatatatacacaagaatgattgcaacgctgcccttctccaatcatcatgtcattagcaaaatagtgcggtgggttggagaaaaaaaaggaagttctgcatttgtaaactaatgatttttgagccttcatatctttcatctaaaaatattgttctattcctaagcactcaagcatgctactcttgacatcagttgatactaagcactca

SEQ ID NO: 42986 - DNA, 1998 bp, Oryza sativa
tttcaattgaattcccaccctgaagtcgcaaatccttgttgttggtggctcgcctccagggactgcagtgtggatgtggttcggctgtcctcgctgtggatcggcggtcggcagcgaccgcggaggagatagtcggcgtggagtagatcggcgatgcgggcggcggaggctgtcggcagcgcccgcagaggaggttgtcgctggcttccttggctgtcctcgatgtggatgtggatcggcggtcagcagcgcccgcggaggagaaagccggcggtcgtagatgtggatcgacgattggcgtgagggacgaggcagcgtagccggttggcgtggggtcggggcgtcggcgtgagtcgcggcggcgtccgggatcgggcgaggcgaggcgacggcggcggcgtccgggagcggcggcgtcgatctggaggcggtcggcggggaggggcgccggcggcaaaggcagggcgtcggaatcgacggcgccggtggctgcgctgcagttggcgtgagagggacggagcgaggaggttgggcgaggggaggcggagcgatctgggcgagcggcgtgattttcggctgaggtgcggtggtttctgctcgcggaggttgagggggtacgtgggatgataggagccattggattggatgattctggaccgtcggatttgatgaatgaggtttgtataggagtgtagttggtgaattatatggtagatagatgatcggacggctcacggctgggaggaggagtagcgcaaccaatctcgaaggttcgtataggtccacgagggcgggaccagctgtaaccgtgaaatacccaggctgtccacggctcggccccaaatcggcaaaatcgccaccgcacacaggagaggacacagcgacgaaagcagcgaagtcggcggcgcgtcgcgcccccaccgcatcgatcgcctcgccccggtgagccatgtcggcgcgcgacagggagacggccgtggcgctggcccgcctcgccgccgcgctggacggggcggtgctcggcctcggcacggcggcgctcgccgtcgcctcgtgggtcaagtacctcgccgcgtccgggcagctgcggcgcatcgcctccgcgccggcggccgccatacccgacctccgctcgctcctcgcggagtacggcggcggcggcggcgacggcgaccagccgatcctcgcggtggtgcggggccacgtccgcgccgccccccgaggcaagtacctcgtccccccaggctccggcgagcactgcgtcgtcgcaaagcatacccagctggtgagtcgctcgctgagaagtatcttgcgcccggcgcttagagctagggtttacgcttaggtggtacggatgcttagcaagggtgtggtttccaaatccaatcataaattctcaagggttctgtgcgtgcttaatgactgttctcgtgatgatgagattatatgggaacgctgaagattccgattaaactgtagagataagcatgtttaggcattggagtacgaagtagtcgtggagcttttgtttggtttcatgtgctgtattgcaaatctagatagaggccttaaattgtagaaatctttgagaatttcagtgcataaggctataatgtctgtttgttttcattactctctgtgtgtagcttctaggagtagtcgagtaggaaggtacgtggttggtattcccttgtgcataataattagatagtttggggaaagggtagatgcttgtggtttccttgtcaggctattcttgtgctcaattctgaggtttgacaactaattcggaaagtttggcaatattgattattaatatgcaaaatagcatttggcttctgttgcattgggaatcagatggttagtaccgtatatgagttatctggttgcaagatgcctactagctgcaaaatcaatctcctgtaaccctgttatgcttccatggatttgggtcttaggagagtgttgttgttaaagcccggaagtaatggtaaaatg

SEQ ID NO: 42987 - DNA, 15445 bp, Oryza sativa
  unsure (1)..(15445): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgaaaccttaatatttattttttcaaaggatttataaatattttttcttattttctgatttactgaataattgagtattatttgctttaatagggagctttaggtttttccatgtattaatgtttctttacaagtttgtacccccatctccaaaatcctgcatcagccactggggtttgtacaatttaacaatggcaatccctaaacagttttgccattatatacttcttacattatcctatggttttccctattttcatttttctacatttccagtatttgtttccaaacggacagaatgttggcatgagggaagtggcagaatggaagagagcttggtcagaacagtggcccaaaaataagatgaagagaaattacaaagaaatgtattccatggattatgctaaatattagtaaaaaaaaacaagccaatagtgtagcgaggaattccaacaaggatgtacctgcttcagttcttccagactaattgttccattcttgtcaacatcaatggcattgaactggtcacgaagatcagacaactcttctgcatttagtgtagaagctaacgcctacaagagatgtaaacatttaaaattgactccgaaatcatcctgagtcatggataagattcccttaagttatggtatgataacttacccgtaaagcaaattgcttaaaccgactgtattttacaaactgacgcatattatgtaatacagatatatctagaggtatatcagatgcctgtcctccttctctcacccattcatgtgctgaagaaaataatatgtaaattttcatgttagtagagcactgtgataataagattgtttatttttataccaacagtatgccatctgtgataactgataaataaccaactgaacagcaaatgttagttgctatgatgtaatgaaaacatgaattagttggtattggttatgtatcaatattagattgtaccaagccttagtaactgaaccaaccatgtctaaccatgaaaaaacaacataagatgtttctatcaaattcaaggtataagctgttattttacgcatggtaatcagaaagtgctaccatatacatagcaataacttaacaatcaaatcgataaaaggcaatggaggtctgaatttcatgagtagcaagcatagccacatggcttcaaataacaagccaaagctgaacccccagcagaagttaaacaaataagtattaagctaacagggagtatgcactgcaaacccattaatgatcgctgagtaagcctttgaggttggaccctcatacataagtttccaacctgaaggggcccttcataaatccccttagatatatcccatctaagagtcacccagtaatcaagttgtgaatttgcatgactgcactcagacttagcaacagtttgccactagaatcccattattaaataaccagatttgcaaacttgcattcaagatgtcccaaaatgatatagagtttccctaatcagattatcatacttaaatttaagacatccaaaaatgatataaagttacatacataatgcctgagcagcagttaatcttgcacggggatccttaacaagcaacttttgtacaaagtctttagcacaaggagtgatatttggccagggcttgcgacgaaaatctggcttgtttttcaacacctgcaccaaaaagaatatgccactttgttagcattgtggaaagagaagcggggaacagaggatggacacgatttgagacaaggtcagtaattccaacatgatacccaaagagaaacataaatataagcagccaccagggtagcggctacccaagatatacatatttttctttatgcacaggcacagctaatgttccatagactgcaggcttagctccatataggtttaggtaaggagagagggtgaatcatgtagattgactccacatagatcctcctatgctagcatttgtacacattacgatacttgttctaagatagttcactcggttcatccatggatgcgtgcttttctggatagcatataaacttgttgacgcttgtggtaagctatttcccaagtatataatcagtgtaaatctacacgcctgatattgtgccaatggcaaactcgtatgctatgaagtgcactgcatagcaaggtattttcatcttttcaacaagttggatcatatttttcagatttgtcatgacacagatcactagatcagatatacttgagcataaatcctgagaagataaagagttagtcttttttatctaaaaaaggggaaagtctatctttggtctgtcaactcttcatgtaggtcaatttttgtctctcaagtcaactctaagacaacttgtcactcaacaattgaaatcatgcaaataatgtccctatgattgtttctcaagtggttttaagtgaggtggctttccacatcattctgttttgccatgtcatttgccacatcatctagacccatgtgctgatccttcctcttcctttttggacaagatgaagagccacttaactgaaacataccagcctaagattctgaatttccttaaaacagaccagaagtattttaagaataacatgcgcacttccttggaagtatggactactaaaagttagaacgatatcaaagtaatacggataatacggcaacatcgaaggaaaaaaagaagaaaatatagtgattgtaaggcaagaaaatagttttaatcaatgaaacacatgtaataaaatggttgtaagacaaagatagtttaggcaaaatgacctctttaaatattccatcttcagttttgtcccagaaaggtcgtcttccacacagtagaatataggttattacgccaatactccaaacgtcagattctgggcctgacttacgcttaagcacttctggtgctacatagtaggcacttccaacaatgtcacgaaagtgtttccctgtgagtgcggcaacttaatttcaattacactgagaataatttctttattgagaaaattctttatatttgccctcaaaagttagtcgtatccttcatttgcccatgcggaactgctcaacccctcatgcccatctttctcaactttgtttctatatttgcccctcgtattacttctccattagtttgctacttgaattatgtgtgaagtacttttttaccttctaatgccttctcaactggaagcaaggacaattatctcttcttttttagtcttcctatttctaatgttgtcattaataaaaaaaaccaatatctttttaacatgtagagagtataactttagcatgttagtttttttataaatgcatagtaaaatagctgtttttctttttaattggctcgggcctaaatacctttttctatgtctgctactaaaatttgtaaatagttttgtcattttctatgcctgcagacttggttctctaaaaagaatgtatgttctaataaaagatggcgatcaagttttactactacttataattatcaacatttttttatgcacatggatcggtgaatgccctttttacattgacaaggaattagaagggattaacatagaaaatataataagccatacctctaatagaataggaattactagaagggtaaaaaggtttagtttcgggagagcaaataagggatatggctaacttacaaggccaaatagagatttttctcttttatatttcatatggaatggaagaaagttaaacaagaaaacaatagaacaagtagttacaacatacacacaaacctggtcttataaaatctgaaagaccaaaatctgtagccttgagggatgagtcctctttggttgatttgaagaggaagttctgtaaatacacatatcaaatgatcaattactcttataagaagacttagtcttgtacttttagagcatacctcaggcttcatgtcccgatgaaccaaaccatgcaaatggcactcagcagcaaccttgagcatttgccgcacaactactgcagcatctttctcgctataacggctatctttcctgtaagagcagaacaaatgtgatatcagtgaatttgctttctacatacatcaaatattcaaacgaacttaataataaataaaaatctttgaacattcagtcgaaaaaaaatctttgaacaattcctgacagttgatggctagtggatgtctcacataaacttatgtcaatccctgtaatattttggttttatggtaataggaaaacaatatatgactatatgccatacatccatattaaattccaagctctttgtggcacgaagcactaattgaaatgctctccggttcaacatccctatatttagaataagtaatcccaacacaaccaaaaaagcatgccacagttctgtggtaaagtaaaaatttttgacaaacttcaaaaattgacttacttggctagtatccggtcaagtaactccccgccttcacataatctgtcaaatacatgtaacagggtcagatcttcattagcttgcacagttccttgatacaaagagaacaaagatgagaaacatgaaagtgtttgccaactatttatcctgaacttgatatttacccggtacaatttctagatttttacgagggtattaatattatgccagtttgcatgtggtgtttcttttccatgtaattagatcctgaattgccaaagtcctgtttggaggggcacaaactaaaatactagacctcagtaagatcaattacttaaaatatgggtggtttctaaaaaaaagcataaacacacatatgaaccttccttcaacttggctaaggccatgaaaagttcacttagacattttatggttatacttagatatacttctactgatttcataaacatttgagagtttttccatgacttactccataacaatatacacataattatcatcttcaaatgcattgtaaaaatgtacaacattttcatggccttgtaaggccttcagtattttaacttctcgctttacgtcttcaacggcaacaggaagaaccatctgcaacgaaaacatcccatttgagaagttagagcagtatcatttcttttcaaaatagaggctagttctctacttctgttgatgcttcaattcagcatagcacatgctgacaaggctttacaataatgcagagtccagaaaatcagtgcgtcctattttctgaatacacatattacatttctctgctcatgaatttatgaccttcatgtacaggagaagtagggtcatatacgaatgtgttacgtttcagtacatatcagtgtctttcaggaattgccttgccgtatctgttaggaggcatttgtgcagtctttatactggttttggaactaaacaaatttgtatacgccacatgtgtccattacgtatgtgtatagtccattatccacttgttgcctccatcctgactggttcctattttgctcaagaatgaagatttaaacatcccaaaatagtttggtattttggtttgaggattgagatgtccattgaccacttgatccaaaatagtttccttggtttgaggaatggacctcatccctgaaaagtacatatactgagtgaagaaatgaggaatggagtcatcccaccagattcgatggtttagatggatcacctccatggcaatctgcaagttgcgctagtactaacatgcagcagcattaggtagtggcagtgcatttttgatttgtaccactaccactacagtatcgccccggattcacatttcacatttcctcggcaacccaaccccacgtgcaaaacgcgacgccccccgcaaaggtggtcgtcgtccaggctagcccaactggccgatcgaatcgagcaacacatgggcacatggcccccacgcgtcagccgcacaccaccacgctcgtttgggcccataccttgttcttgtcgatgcgcttgacggcgacgcgctcgctggagcggcggtcgacggcggcgaaggtgtagccgaactggccgtggcccagcagcttcccgagcgcgtaccgcgcctcgaagtccttgtcgtacccgaagtccgtccgcttcccgcacgccacgatccccttcctccccgcgttatccttgttccccgcgccgttaccgccgccgggtgtgccggcgtcccggcgggcgctggaggaggagcagagtcccatcgtcgtcggctgcggcggaggcggcggatccaactattaccatcaatgtggcggcggcgcgaggctgccggaatcgggagcagcgaagcgaagggggaggggtgttgggaattggggtcaaagcagagcagagagagagagaggagaggagtgaggagacctcaccgatgtcgtcgtcgccttcttcctttttaataatataagggtaataagaaatggtgggaccaaaggggcgtgaatcctttaccgcgcttggcggtcttatgctgatgacacgtgggggccagtggatgtgggtcctacgagacggtgggggagtgggtggggctgacggtggggtagctttggatgtgggggtgacgacgtgacgtggtggtggtgggaaatgggcaggaaaaggcacaggacgcgaactggtccggcggccacacgcggccacgcgggggtagtagttttctaactctccgtaaaaaaaaaaaaaagacaaacctaatttccgtacccaacgtttaaccattcatcttatttaaaaaaattataaaaaaaaattaaaaatataagtcacgcataaagtattaatcatattttatcatctaacaataataaaaatactaattataaaaaaatttcatataaaacggacagtcaaacgttggcacggaaacccagagtttgcctttttttttggaacggaaggagtagttgagtaatatattttgcagatataccctccaatgttgcaattttaagggaaatgagcctcctgtggtattcttattttttttcataaaaagacaattgaccatgcaattgtaatgataagctctgtaccacctgataagctttgagcttcctcgatatgctcatagctacgattaattcaatatttcggtaagttgataataactacaatttgagagaaaagttaatgacccgactacaactgtacgaggagttgttgtgttgcgccttagcgatcgccacatctctccgtggattgttgatcttgcgggtgtagatcaaccttatttatacaagcaaatcgaaaaaacaagtaaaaaataaaaataatctgatattgcaaataggaattaaatatacatgataagttgggtctcgtagcgagaaaacaatgatctaaccgatcacggctttatctagaaaagtagcaatagctagactttaattaaaaaaactcaaaaaccctgaaggggtacatagctatttaagttgatgggaggatgaccaaggagtccctagggacgtgctacactagcttgggatgcatcccacttgggatccacttagaccggggtcacaaacaaagttataagtccagagacctatgacgggtggcacaactctttatttcttcaactgcaaatgatcgaggtggactttgaagatgagctggatccgttggaaagagaactccaagagcttttcatcaagtactcatggatccagcacagagctcgtatggacatttggtggccgtttgaagtcaatactactgcaggtgaccgaatctaatttcggaacatgaacggcggtttgatctctttgacctttaatatgaacactgctagtattcatattcgtagtaattatcatcacatcatgtaaacttttggatttagcatggtatggtgagtaatatgaaatattcataacatgttcacaaatcaattgtctctttgtttagtcggaatagtaatatataatttcttttcatgtgcttaaaatccaaccttccaaggggacagtacggattcaccatgtttaattgcatgtgtgtttaactgaaagttgtgatcgacgtattttgcatatgttatttttccggtgtcactttgtttgctgttaattttcattttccatgtttggttgatcttgttattggtattgctactaggctaaggtcctgattgggggagtttatgcttctaagaagcaactatttattagttagcttttgagaatcacctagcatctcgattctagtttattttctacattttataactatagttctcagaatcagaataaaaaggtagactctttggaggagtttttgattttgaaagcagctatggcgtcgtgtgcccctaattaattacaagctatatatatggtcttacccttaccaactaaattaccttgcatttttgtaatagcactccccaaatgtatcactaaccattgtcatatgcatttttgtaatagcactcccctatcaatagccattgtcatgtgcacaccgactctatgtaaaattcattattaggtgtggtttaccatgtaaatcacggcataaaaagttatttggggaatttaaaaaataacacttatataaatatataactaagacgatactacataaaaatgacaaaacagtgaagaaggagatagaaaaaaaaaggaattgtgttttttcttcgttgtgttttaattttctaccattgtcctagaattttatatatatgattatttttaagtttctactatatattttccttaccaacttaacatttttctacatatgcaggagagatgggaaaccaagattctcttttaataaatgggcaagatcgagggggcttatttcgcgaccgatcatatgcagtggaagctagcgaacaccttatccacatcttatgccttccacccaccatagattgattcatcgagtattcctccacatctcacgcctcaaccacgcaatgtcgcctctgcccctcacgtcgtctcttctccttgatgcatcaacgagcaacagtgcgcaccatcatcctcactaacgcgccgagccctccactccccctcccctatttcttctcttccctagcaaggcagatggtgtatgcatggcaaaggccgtcagcgccggtgcagcgaatggcgaagtgggtgccttgttgcggttgcgagcgttggtgacgatggggttggaggtgggctattgccctcgggtgagctgcacggttccatgctaagttgaatgttgatgatttggagtaggattgtggaaagtttccaatttagagtgaatagttcctgagatattgagaatgcttgattttgaatatgaagttttttgagttttttaattggtttgaaatctcatgtctataaaagtttatctgtacccaaaagtttatggcttcatctctacaaaaatatgtatgtaaaagtttctataaaaaaaatcaaaagagagtttatgcaatggaagtttctagagagagttgatgcaacaaaagtttctcaggagaaaagtttatgcaataaaagtttctatacaaaaagttttgcaatgaaagtttattcttgttatggacgttctcaactctcttatggaccgggcagctcgggagggttggattcagactcttgatgttcggcaaatgtagcaaaggtgttctttttatgccgatgatgttattatgttttcaagaccaacggtgaatgatctctccattatcaagaatgttttggatatttttgtccatgcattgggcctaatgaccaacatgcaaaagagctcaataactccaattaggtgcaatgaagaagagttggaagtgatcgtgaatgtgttaccgtgtgagatcaaggattttccttgttcctatttgggtcttcctttaaatgttaagaaactgtctaagaccgacttgcatgctttggttgacaaggtagcggatgatctccccatgtggaaagcttccctcatgaatcggatcggtcgtctcatctcggtgcgggttgttctattcgccattcctatatatcttatgattgctatggatctaccaaagtgggttgcaaaagcaattgacaaaagaaggagggggtttctttggtcaggacaagaaaacaccaatggtggtaattgcttaatggcctaggatagagtgcgccgacctctagcttatggtggccttagtattcttaatttggaatatatgagttgggccctttggattggttggttatggctccaaaagatagacaatagtcgtgtttggcaaggattgctcgtccaagttccccgtgtttctcatgacctttttagttcggcggtgttgtcgcaaattgggaatgggcaatctaatttgttttgggtggacagatgggtgcatggaagaattattttggaaatggcccctaacttatgtgaattgaaaaggataatcaagcattgtacagtggctcaagcattggacaactaaaagtggatcatggacattagaggacctttgacggtgcaggtgcttgcagaatacatcaggatttgggaagcagtccatgagggtggtgctgcaagaaggaattctagaccagcactattggaagttctcaaagtcaggagtttacacttccaaatccgcatatgagaccttcttcatgggggcagtcaagtttgctccttggagaaggatttggaagagttgggcacatcttaaatgcaagtttcttcggtggctggcaatacacaactgttgttggacggctgatcatcttgccaagcgttacttgcctcatccagccgcttgcccctttgtgatcaagccaaggagacaatgcaacacattttggtttcttgtgttttcagcagacaaggtttgtcactagttctccaaaggcttggctatttctccactctaccgaaatcatgacacgcgcaagttttcgtgttggtggtcaaaggcagtaaagggttgcaaaagaacgagaaaaagggcttaactctcttattatcttagtcgcgtgggaaatctggaaacactaaaatgcttatgttttcaatggtgttactcctagcgtgacaagtgtggttctatccattagtaatgagggcacactatagtgtatggcaggagcttctaggttccaagagttgttggccaacacaatagctcttgtgccctaggaggaggggaggtgtgtttatgggtgtgtgtgtgtgtgttttccagtgggtgtgttggcgtgtttttgttttcgtaagtccgaccttttattctttgcttattgaaatgatacaatgatttcacgcgtgttcgaaaaaagtttatacatacaaagtttattatgcaataaaatttggtgataaatcgtattgtttagaattaaatcgaaatgcccctgaccacgtttcctaaaaacaaaaaaacaaacgatgcgtgacgaatcagggatttttgaaaaaaaaaacacctacgccaaaaagggaaacaggaaccgatcacgtgggcctaattccagtgaccgatcatcaggtagcattttcagagttaactagaaaaaatgcccgtacgttgcaacgggtaaactgaaattataataaatataaaaatattagacgattacggtttagtttttcatgatatgagccttcaaaaaaatatattccttagaaataaaaaagtgctaaaaaaagaaaaaaaaagaaaaggtccattggaccctatcggcctgctattgcgctccttgcccatgaagcatgcgtggcccagcagtgcggtggcccgagatggaggtcggcctgacgtgggatcgatctgtgccattcattttgatggacgggtcggatcgattctatatccatcaaaccgtcagtgctaaaaacactaaccctaatcacactttcccatcccattccaccatcgtgagaacctcctcccccttccctctctctgccgctcccgctcccccttcccttcccctcaccggcgtcgccagtccctctcctcctctccctcctgtcacgctggcgcggcgtgaagacgacgagggcacgactctattcacgagcggataaggagagagggggggcggagtgtggtggcttcccgtgggtagatccagcggaaccgacggcaccggtcgcttcctatggcttgatccggtggtggcggcgcctttctgcggtggatccgatggcgccgacggctccccgcggcggatccggcggctatccgtgtgtagatctggttcgcggaccgatccgccggcgatggtggcttcccacgtcggctacgacggcggcggcatatccggcggctacccgcgtgtagatccggtggcgtagtaccttgcccgtatgcggagctgatcctctccatcaaatctaaatcttttttgaccggttgaggggttttatccactcggtctagtctttctgttttttccaaaatcggaacggatccataaaatttgggattgggataaaaatggccagccgagcatcatcaaccaatgagattaaatccagtgaattaaaagaggaaatcgtgaaaaaaaaataataagagtggagtggggtatcgatttttacaatcaatgggaggagaaaacacaagaggaagtagcttgaagtacaagtgcgcaacagattggataagataaaaaccggatgaaaataccaacaaaaaaaacacgaaaaaaaacgaatcggaaaaaaagggaaaaacagcgggaaaaaacagagcgagaagccacgggaaaaactgaattgggcaaaaaagagacggacaaaaaaaacacgaaaatggaaaaaaaaagaaaaatagccaaaaaaatgaagcaaaaaattacgggaaaaactgaatcggaaaaaaaggacggacgaaaatttttttttacggaaaccttgtgtattttttagttaggtaaaaaccagatgaaaaaacaaaaaaaacacgaaaaaaacgaatcggaaaaaaaaaaagaaaacagcgggaaaaaacggagcgagaagccacgagaaaaaaatgaattgggcaaataaaaaagagagacggacaaaacaacacgaaaacggaaaaaaaagaaaaacagcgaaaaattacgggtaaaactgagtcagaaaaaaggacggacgaaaattttttttacagaaaccttgcatattttttaattaggtatagatatagacgtgaggagggcctaaagccacctaacatatagaaattcatgttatgccaacttatcgtgctaaccgacggatatggatttcttaactatttattttataaaattatacccataactattcaaaataacgtttatcaaaattcaaaattcaaattctccctacttttaaaagattacctaacagaaaattatttttcaagaccagacatgatataacatagaaattgctccttttggaaaacttaacatgtagcacataaatttgctctatttagaaaattatcattctcacatgtcaaacataattattcatgttgttttatagcaaagttcaactacaagattcgaaacaatacttgtttgtgtttttattggagggagcaaaacaaagatgcatagggagaaaatgtttgcttgcacagagcaattttctctttcttcaattggaacaataaaaaatgtttttagtacacacgtgcttaacaagggtgccaaatggaatcatagaaaaactaattgcagatttcactattttttaaccttttcgtattcaacaacgtgctgcaaaagaatgcaaagtactctatatgagccacattaggtgttaaccactgaaaaaaaaaactaaatataaagggatgttacatggggaatcatgaagctcgtgcttcgctacaaaaatcccattattgcttgcacttttgataaaattaagattggctatttatttgccataaaaaaaagcaagcaaagttaatcggtggcgaataaaaatgtatcaactcaatattttccgatcaaacctagatgtgcatatgattagaataaacacattattgctctctcttcatcttaatttgcagctacattaacacataatcataaaaatctttgaacaaattagtatagactgcttagagtcgctaaccacaagaattaagcagtgaagggaactattatctccgtcccaaaatataactacttttagctataaatctgaacacccacacccagttatcaaacccagttatcaagattcataactaaaaaatacttaaatataacaacttttagctataaatctaaacacctagttgtctaaattcatagctaaaaatacttatattttgagatagatggagtagcttatttggatccctactgcccatcacttgttaagaataacaaatgcatcgaccaaacaaacagacaatgcacgacctctttacaacgtacgggaaaatgatgatttggagaacacagcacatgttttattaacaacattcttttctttatttatgctagtataaaccagctttaacgtcagatatcaacgagatgaaggggccaaaggaaaacaagcacacaccaagcatcaaaatggattaagcaatgcatcatttactctgaacaattgtgaatttctcgttagaattttgcggagaaagggtataaaccaaactccccaagatttgcaacttattacctctgcgcctcttggttttgcacaaagatgaaaaaaaaagtaaaaagggggcaaatcgtataaaggctatcctgcatggtttcccgggaatttactctgctgtcaacgaacttgcggagtaaacccataaaaacgggctaaaagaaggcttgtaaattgatcctaattcccagtgtaactggaacgaaacaaacaggaaaaagaaaaattaatccaaaaaccaggtcatcctgcccttggctctgtgctcttggttttcaggtcctcctcgaaatcatgatggaaatatacaaaatgagacagcaccgttctgtgcatcattcgagaacaagggaagaatagttttgatgatctttagcttcacagtaacattgaggttggattctcgatatagcccttgaatgctttcagaaattctgccccgattgcacctagagtaagcgc

SEQ ID NO: 42988 - DNA, 1885 bp, Oryza sativa
aagcaaaaaagcagttgagttaaaaatgaatccctatgtacggactaaaacagcatgactaagtgaatgagcctgcctagcaaatagaatacattaacaaaaggcactactagcccttttacgaaaaacaactaaatactactataaacagctggtcctatgtgcatgacttctgagtttaagtactagatcagggacttggaaaatatacttttcaaaatacactaaaataatgcagataaatatataatgctacaattatttttacagagtaagctaagtggcaacgaattagtggaaacaaagtaaaagtgcaacatgacttattaccagaaccaatggccaagattgccgactgaggaggatttatgatggcacaaaattgcttaattccaaaaggacctcccaagtttgatatggtgaatgtgcctccctgaaaacaccacataaaagttctcatggaaaaatgctgttgtttcatgcaaaaattaactaccatacaatccatatacctcataatcatctggtttcaaactgttatcccttgctctttgagccaactgcttcacctcctccgcaatcataccaagtcctttcttgtctgcatcctgcaacaagcaaaagttagaaacattttcttacacagattagacaagtttagattactaaccctgattactggaacaaacagtccatgctcagtctgtacagcaacattgatgttcacgttgtggtatctgcatgcgaaatgaaattttcattatctcctttcttgccaaaactttagtcccaagatatgcctggtcagaacttactggcggataaaatcattcatccaggagctattacactgagggacctttcgaagagccagagctgcagcctgtacatcaaattaagataaattcagaattggaggtcagaagaaaatggacagtccacgaacataaataggctgaatctgcaacaatccagtggttggcacttggtagacataagaaaccacggtaacacgagaaactggtaattacctttataactagatcattaatagatatcttcttaccaccggaggactcctgcaatggattcagttcccctcgcaacctgcattagattaaaaaaaaagaactacttttaaaagaaaagctacaaaatccagagagatggactttgaaggtgatccatcacatatgtttcctacaaaatatagtgatttaataacacaattagcattcaacatacttgatgagattatcaacacgtgtgtcaactgtcaggtaataatgtggaattgtttgcttagagcttagcaggcggttcgcagtaacctggacagaattgaagttaaaacactatcagatcaataacatcgcataaaaaacgacttaacagaaagaacgtatgattgaaattacctttcttatttgtgcattgggaacatcggtgtaacttagccctggagccgcaagagcttcctttctgcaacccttagctacagaagtttgtttaagaaaaaaattatcaattgaattctcacagatagaataatagcataacacaaaataaatctggcaaatataaaggaaagcataaaaccacacatttgaacatacagagttcaagcaaattacattaataatatttcatttggatcaaccaggatggtgctactaaaacaacaaaattatttagaaattcaggcacacaggaacaagtaaactaacagagttgagtgaacaaagcaagcaaaaacagattttttttttcttctgataacttgatatatgggtgactggatgttcaaatcaagtgatcaaataccatacaccacaaaatggagtacataatacgcatcacatatgtctgaatatgattactttag

SEQ ID NO: 42989 - DNA, 58262 bp, Oryza sativa
  unsure (1)..(58262): unsure at all n locations
ttatgcaggaacctgaccagagaagggcagaaacaaggaattgcatgggaagaaagtagatttatataaggggagtgccatagtacatactagttacaaggaagttttaacatgttttcctcgcctaacatcttttccacttggccattaggattaaaattgaatggtgagagaagtatatataaagtgtgtattacagggacacagtcataaccaaaaacctaactgctcttgcgagtacaagtgcatgcatgattcaagtgttctataaaatccctagcaactgtaacacttcatatattaaacaagcaacgagcagcaaaggaaaaacatcacaataaaatttgacatcaagagttcatcaaattcagaactagcatgatatgtcaaaggagcacacattatagcttcaaagcgatcttgttaaatataaattaatataatggtcattgttgaattctaagttactcaactacaaaattctaaattcctatagagttcatcatttattttatttatttatttatttattttaattttattttattttttttgggggggggggggggaactataggagaaagtgacatacccaagtaatcttcaatgtctgccttcaaaatgcgcccatcaggaccagttccctttacactcgacagtggaacctgttttaggcagcacaatccttgtgttcattaagtatgttacaacaacagttggcaagtaacaacctagacagctaacatcagaaaacttacattgttatcttccgccaattttctagcaagagggctggagaatattcgatctcctgaccgcgaaggttcttcagtccttggggcctttagctcagatgctttggaaggctctctttcctccacctttggttctgtaggctcagactgagccttcagttcagaaggggctacaggtgcagccaaagttgaaggtttataatccttaaacttcttgatgtcaccctcttcttccacggttacagcaataatctaaaatgaatagcatggacataattcaaccaagattatgtcagcgaaacttaaagactgaggtatttgtaataactgtattagtaaacagaggataataaatgattgttcaaatatgtacctcaccaactttgatctctttggaaccatctccatgaatgatcttagcaagatagccctcttccatgcactccatttctacggtgctttatcctagtcagcagaaatgcattcaaaggatatttagattctcttgcagcttaaataaaagaaaataattgagcaccactaaaaataagtactaactaagatattgctgccttagagatcagaaaacttacagtctccacctcacaaagaacttcaccaggtgagaccttatctccttccttcttcagccaccttgcaatgttcccctacagacaatacaagtataaggtgtaatactaactagatgaataccccgccgcgttgctgcggaaaattaagttgcataatatgtacaaaactaaaacaatttgatacaattttgagcttgaaagtaattgagattgcatgtttttaagagagaagaaaaaagagacaatttggaccatagatctatcatccaaaggctagaaataattgtggtgatgtggcttaatgagagaagagagaaatagcattaactacacttagtggggatgaactatataagtatataggatacatgcaattcaaggaaaaacacaagaggacattatgatattcatgattcataataaaaaaaattggtgagatatacctcggtcattgtaggagagagtgatggcatccctatttcctgatgtggtggcaggtctggaataaagaaattatggcaaaacttaagaaataagacaattaacagagtgctatatggattatggaatcattgactggagttatgtactacctccatcccaaaataattgtaattctagtttgattagcatatattaagatttgagataaaagactatgatatccctcatcaaatggtgtatacataagagtgggaaggtaattaagggtaaaataggaataaatttgaatgagaagtgattatgggacaattagtactctattgtgacaactattttgggacaaatgtgaatcctagaaatacaattattatgggacggaggcagtagacaattttaacatagtaaccagagcaatgggaagatgtggactgaatttcaaatagacttttctttttgaagcggataaactagatgcttagatatcattaaaaaaagaaagttgttctgatttttttaaaaaaagaaataggcgtggagaaaaatatccaaaaatagtggaatacagcatcacatgcatgtaaaaataagtacgtgggaagacagggtacagtaaataaaatagatagtaaaaaagaaaaagatccgcaaccaaaataaccaaattagtaatctatcgtcaaccaaatatgtttataagaaaccctcttgcaaaaacatgacaaccaaaaggactgaacagctactttgcaatatcctggttattttatgaagttatcgcaattaaagggcataaaacacgtaagtaaagtacctgcactgcttgagaaagatcttgctgaagctatctgtccactggaaaagaaacagggaaagaaaagggaacattataaagacgccatggtaaacagaagtacagaacagctatcaggcgttaggagaacactattagaaatttagaataggacaatcagattcaaatctcattcccaggattggagtttgttcttaagtaaaggagattatcatttagacatgtactaaaaagcagggagccagataggcatgattcaggggccttgcaaaatatgccagcgattttttttatggtgtatcttagccaacaacatgagacgcagtgatcaaatatcgctggttcatattctcttgtaagggtggttctctcatacaatatgtcccgacactgccacataagctaacaatatcatagcagaaaatgacacataccatgacaatgaaccattgagaccagtaatagtatttgggataaagttgttaggtgatctcctgcaagtgtagcttccattaagtcctagtgacaactgaaagagaaaatgacaaactagaaagtcaggacaagacaataatggtctcaataaagtgggatatatttcaaggacataaccttggaggtctcaagctcttttccaggttgcttgcgctgaggaaatctggcacctccaattcttttctcagcacctgtggaaaccaaaagcactaaaacttcaatggtgaaaattgcttaatgaggacattcaatcaagaaggtgaattctcactgtacaaataaattcccaaaggaaccaaataactactatctcaagacaaaatgagtgtgcctatactatgtcaatgagaaatcacgccttaattaaaaattatagtatcagctcaggaagccaacccatgcttagccaaaggtacaaaaattagtggagaggtaatgtgtcaagaaatgaaaaaatgaacatattggattgtacttctgttgcaacatattttttttgtacagatgtttgtaatcaattgacaatctgtctatattagactacagaccaccaacacacaatcaatgaatgcctctggaggatccaggattaccaacacctgtgaaaccaaacgttttataactaaattgcctatgtaaggctctatattggtttcagttatgatggcaggaccattttggtttgacgccaaaatgtgccctaccaaattgttgacccttcgaatagtactttggctagtgtttggtttgctaccaaaatatgccaataacacacataggttgccaagaaaaaaaaggctaaaattcacctaggttttggtattgctaatattttggtatggtaggaaacaaacaaacccataatacagaaataaaaagttattggaacagaacagaactgcatgattaaaagcagcagacacttatgaaagaaataaaggtatttgctaactatcacagcaattagtcatgtggaaggacatctccagttgagttggacaaacaggttgcttgcgtaccgtggtcaattagttgacaaatacacacaatcaaaataaaatgataaaagatgggtagcacataccatttcccttggtggggaacgaaccagaagcagtggagaagtagcgcacgaggccagaacgctcacagtctagagcattgtgtaaactccgcaactgcagtaaagcagattgaaatgtcaccgggaattgattgacgatggcgtaacattactagcgcagaaacatttctttcccgctgcagtaggcaatagatctcccgatcgaccgaaatcaggtgaattactagtcaattcgcacagacgggagcacaaggaaatccaggaacgatcgaaaattcaaccacatgcggcacgcaggctccacgcagcgggaaggcagatcagaacagatccgatggcttttccgacacgttgggatgggagacggatgcgcaggcagccacagagagaggaggcagagagagaaagagagagagagggagagagacgaaccttgcgagagtggcggaggagatgcgcggcggacatggcgacgggagaaggcaatgggcgtggctagggtttgtctcgatcggagatcgttggcggcggaccgacgagggggcggatctccttggccacggtcgccgtggcggcgctggatcggtcgaggcaggcgtacgagcgtctcccggactggctgcggctcctcccggcgtggtcgaggccgcgggacagatgaggacggaggggggtcgtggtggtgtattgggaattgggatgtcgagtcgagtcgcgtccgggaatcacgcgccgggagggggcgagagaacaagatcggtagcgagtaagcttaccggggggccgggcctgggaagggagatacagtccgatggtaaaaaaaaatatagagttaatttcattttggatgatactttttctttaggtttcacttaaaatcattctttgtttaaatttttcaatttggactaggtaattttatctttgttgcacaattgatcacccccaaaccgcatcttcatcacttcaatgacttcgagtaaattgttaaagacatgccggcaaacttttatatctatatgcatgttatccctttacccaaggagacgctagacatgactagcaaatagaattaggttggttcattatgtaacaaaggtaaagttacatagttcaaagtaagaatattggttatagggtagtttaaagtaaaactttggcaataaaatatggctcgaaatgcaattcactcaaaaaatatatactagatgagtgagtgagagtggggcaggggatagttgtaaaattctttaatgttttgtgtggagcggatactatatgaaacctccagtgttgcagcggatcgttcgtgtgtaatgtagttataaaaattttaatatatatgtatgaaaaaaacattaaaaaagcctgtaaaagcatcatctaagtactcccttcatcctaaaatatagcaaacttgtactggatgtgacacattatagtacaacgaatcaagtaaaaacaacaaggatagtatctgtactaattcatcgagtccaagaataatagtttatatcatcatgatataaggtcattcccaatccaatgactaggatagtgtccatagcattaaataagctgccacctaggataaaaaatgatatgtcaagtaaataaatgaggaaagagaagaaaaccatgtcttgagacatggtttctacacaacatccaagacatcatgtgagataagtagcattaaattgaagtatggaatagtggtgtttgcattagaagagtggtgtctaacactattttcttgatgatggggagtttatggaaattatgtctagtgtcataggttgagaatggtctaagtacacttaaaaagccacatggtccacagtagaacaatgaattcagaaataccataaaatattttgtgcttattaattgcttctgattatgcacaatcatcaacggttgactttacggagtcataatttggttgaaaatgtgaccttttcatccacattgccttgcacttgagccgattagtcaatgttgtacatcaagaataactcgatggacatgccgtgaggaatgaccatagtggcacaatgtactatgggcaatgtaagcggaagttcttattctttttatctttggaaagatcaaacataagatgctcctatttcttttatggagtgtaggtacctctaggtaacacccctcgaggtaggcagaaattggtccaatggcaagcatcaccgtgaagatatgtatgttcgggcttgtgttcattctcgttgtcccaacctcgatcgggctgtgggtatcgtatggataaggcaaacgctgcagagtggtactgtatttgaatatactatgctcctgattaaaggagatatgtctatgagtgaatcctaattagtggtatgagaagtctcttaatggaacatttgaatttaatgaggaaaaggcctgaaatgaaacaaccaatttttgaaatgtaaattgattacaaattggccattttgaactattactaaggtttacagttagttctagtttctatccttgtgataccttgcattagcacatgttttgtcatgcatcttttgggttctagtcgtccaaggaggttgttgaaggtcgttatcgatcagtttcaactgtcaatattatcaaaatagaggagaattagtgatgcttgctatgcatatatatgttagaataataatattccactagtattaggtctactaaccttttgcagagaatgacaataaagtagagaagaatcgacatcaactcagacgataatcaatcggacgatgtcgagaaccagacttatgtatgaatgggccaagaactcagaattaacacgacaaactgggccaaaattcacaagtctgcggagaaaaacaacagaggaggccaccagccaaaccatgggctagttgggttggccccaggttcggccgaacctccctcatcgtcgctggatgcagggtttcttctggacggtgtggattagctcccaatgacggttggagggtatttccgaccattccaaccgtcacaaccgtcattgggaggctatataaacccctcaccttcttacttcactcatacacctcaagcaagagctctctcatttttctcaagtttagtttagtagtatctagctggtggaataggaatagagtagaaatcaggagtccggaagtcttcagaagagttcaggtatggctctagtagcttttctcttctcttttgtaagctttgtacttttattagaatactcttctatatacatttatggtatgaaaatactttccgagtatatgaatgcctactttacattatgttcatgttatactgaatatacggctagcttatctgggagatgctttggtgcgggtataatgtttgcttatgcaattactctatgtcatgacgatgatattagagtagtatctggtagtttagacgtggtgtctagattacgagatatcgttatttggggttatatgctgcggatgagatgtgggccgctgatggtgacagctcagtacgggtattcctctgcgcctgtatataatcctaagttaatttcctggggatggtactcctccgtatttagccctagttgtatagacatgacgggctgtcgtaaggaactcagcagtcaggggtggcttctcgaagtaccaggagggcatcggataaagggtattaactagtatatcggttaactagaatatatgtatactatgtatattagaagtataggaatagattgtctttctcttttctttccacttagcttagataatatattatgagaatgagtagctaatgcttatgtgtcactctacccttgattatcttaacacctgcttaaaatatgattattacaggtaatatttaaattattagtcaagttctctcaacatgatctttccacgagataaaataaataagatacccttggaatactctcgggtgaaatgttataatgatatatccgtgcgcttgtggataaactctttaactataatataccaggagtatttctacgccattgctgaaaattatatttctattaatgtcgttaagaaataccaacaaagtgtaagtgaagctttataagaagattgatcctattaatgtcgttaaaaaataccaacaaagtgtaagtgaagctttataagaagattgatccgttcaagttgtatgaagatgaaggcggtggtgccaagttgcatcttttagttgtatgtatggtcgtaggtcgggatgaaaacggcttggaaatgaatggaaatcagatctactatttttgttttcttttttaactagaatcgaaagtggaaaccccagatacgaaaattacatagaatattatcaaacataaatatggagtaaatatgaatcggagcgtatacggtaacgaatatttatcggaataaaaaataattctaactaagattctaaaatcaacgaagagatgaaggccattatttttttatcacaataaatcagcatttctatttttatcaattaaataataatacacacgtacacttcacttccctaaaaaagtgcaataagcaaaactatattcatctggcattgcctaataaaagaaaataaattaatagtcattaggcaaaagagaaatagatctaaagcaccaaactataaaaaacatctccattcaactaaccacatcaacactcggtgcaaatctgaacatccggaagagaagggtaaagctaatcagctgtatattaaaagcaatttgtttccagttccgagaaaaaaaaattctaaattcgtttctagaaagtttctcatcaatttcggtttccgacaggtagtagcattaccatgtcaatttcagtttccaagaaaatattccgaaatcatttaagtttcctatattttctgaacaaattactcactactaaaaaaggcaaatagctggctgccaggtttttttttgctagcgggcggtggtgccaccagcgacctaaggccaatgaaaataatacatattcactagtggccggtcggccactagtgaaaatcgactttcatagataaccaagctaagatggtcaccgacaaaatacgattttagctgacaactgcgtaaagagacctgccatcgaaaatatttttcaaagcaaaaaaaaaaagaattgaaaatcaggatccaaaacagccagtacagaatcacaaattctcaaaatcccccatcacatacagtccttgcactgtggtcatcgttgtagttggcgagagagagcgtaggtcgtcatctttagatccatgctcgtgaggaatagcatggccgactggtagttgccaatctggcgtcgtcttgcatgcccaccaccgccggatgtggacgtgtgctcgcagtagaggtagtcgttgccaccattgtcactgagccgcaaccctagccaccatcaccactgagggtcagcgtcaccgaggctgcgtatcgagtcgtcgctaagcttgtgggcagagccatcactgaggacggccgccaccagatctagcggtccaaagcactaccgctggctatcttcttgctcctcatcgtagtcgtttcgtccgtttgtccgcgccggttagcaagggagcccgaggtcgccagaactagtgtccatggtctcattggttgtcaatgcggtggcggtatttgtagacggtggttttctcgttggggtatgtgatggtaatgatgcgattcggcggctgccgcctccatggtggtagaggaagggcggtaaaaaggtgatgtcctgaaaaattattttagttccggtcgatattttctgtttcggaaaatacttaaggcatctacaatgtaagacactcttagagtgccctcactaactgagggtactctaggggtactcacctctacaatgtaggccacttctagttagtcaaatgagtgtcccaacccaaaaaagcccctttctctcctcttcctctctttcctattctacccctctcttccctctctctctttctccctccgcacgaccgcacgcacgttcctctctccctccgcccgtcgttccactcgctgcctgcttccctctctctcgccgccacctactgcgcttgccgacgctgcctccctcctcgccctcccttcctctctccgacggcgagcggtcgtatcgaggagacggtggcggtggcctcatcgacgatggcgctgtcgccttcttcatcgcgctgccgccgccgcctccctcctcgccctcccttcttctctccggcggcgagcggcgcctccgcctcgcccttgacgcgtgggccggtaacagaggggagaggggtggaagaggaaatcgaagctatggggtacgtcgcctcaataacctacctatgcaatgggttgcttcactccgtccccttggaaaaagcgagcgagcaacacgttccccatcaggggcgcgcgttctgtcccagggggacgacgcagacagaaagcctaacggacggcgctagggggatgggccgaagcaccgcattggtgatgcccttatcgatatcggaaacatcccgaaccgggacagttggtgcgtgtgtcaagtttggagttttaacagaatcttgtcagttcgtataacgaacttcctgagcggatacgtgttggtggaatatttggaccatctcggtgcgttcccacgtacagttagctcctctgctaattgtatggacagtttgccaataccatcgagcaacaacagaggtaacaggccgcctggttacgcatgggctcagttgacccataatttaatttgttattatttttcccttttcaaacaaaactcttgtggatatttatgtttggtgcattattttttctataagtaatctaatgaccccacataaaattattactaccttaattgtttggaacttactccgctactaccattttaataattgtaagggtgagtgtcaaaattctttccatgcaccatttgactaaaaggcgctaattaattataattataattgttcgggagtgttattaaagttttctttgaggtggcactcacttcaagtgaattggtgtaataattagctgtagctcgttaagcaaaagtcaggatgatattctattacaagcaaaagtatggatgatattctattacattatctaaaaattgactaaaaggcgatagtcttttcacccatactatatcatttcagtgataacaacaccacaacactgccacacgctcctaattagtactccttccgtcctgttttaagtgcaaccatgagttttcgtatccaattttgatcgtctgtctaatttgaaaatttttttaattagtatttttgttgttatgagatgataaaatatgaataacaatttatacgtgatttatatttttaattttttttcaaaaaatttttaaataaggtgaacgattaactagttgagtacggaaaagcatgactgtacttaaaatgggacggatggagtatatattcttactctacagactgtattactgtacgtctgtaccctttatttacagatgcatgcatctagcatggctgcatggggaccatgtccactaattagtccatgcaatgcaatgccccagttcactgcaccagtaagatatacgggcaggtactatatactatacgctacaaatggtcaccaatttgctcacgtgtgcttttttgtctgaccttaattgtcactgtgcatgtgatgaaaggcaagcatgagtccaattttatgtcacgatttgaagcagttacgttgcagccttttttcacatggaatccactaccaactgatcggtcgagttcacacactgcattgcaaggcatggatgtgatcgagttgaagtattgaactcgcgatcgatcgcgcgcgagagctatgtttttgcaggttcgttcgcatcatcatcaatggctagtttgctcggacatccagaggagctcctctaggtagtcggcgccgaggtcctccagctcgaggacgatctgcttgtgctccccgccggtcgtggcggacgtcgtcgtcgtcgtcttgttcgccgtcgccgtggcaccggccagctctgatctcttccgccgctttcgcttggagtgccgccccttcagcgccagcacgggcgagcctccggccgcgccgagcgcgagcgcgcggagcgactcgcgcacgcgttccacggggaagttgagcgccgcggccgcgccccgcgccgagagcgcggcctggtcgtaggccatcgcggcggcctcggccgtctcgaacgtgccgagccacacccgcacgccgttccgcgtggagtccctgatctccgccgcgaacctcccccacggccgcttccgcacgccgatgaagcccgccgccgccgccgccgcccccgccccgccctcctcctttctcgccgccctctcgcggcccgcaccgccgccgggcgccgacacctcggcgctccccgccgtctcgtagtcgtagccagacggctgcgattccgaggatgtcgacgacgccgcgccggcaccggcggctgcggtgacagccatgccgccgccgtagtaccagcagtggctgtgttgctccatgtgtgtgactctgtgagctgggaatgtttgacttagcggctgcgatcactgtgatgtgtgcggcgaagtgacggggcgtgtttgattattccctttccaggaaggcagcggattaaattagcgcggggtttatatagagccccgagagggttgggtggctctgtgggcgacgaattttccaggacggtgcggtggggcccgcgcgtcgacaaatgactatgacatgtagggtcatgaaaacctggaagtttgggcgttgtcgttggacttggctgacgtagggcggctgcataggacaaactagcgggcgtcagcgtacacgatccacacccttgctttgctggtggtgtccactgagcaggcctcggcgcgccttcgttaagtggcccagatcactagatcagaaatggattactgtgtttttaagctagtactccgtatctagcatcaccgatgatccaaggggtagtataagctataacacacgtgtctcaaattagggcttcttattttatttatttacatataagaagcgtcagcgatgatatggaggatggtaacgtactatttgctgcatggacaagcatataggtatataggtggtatttgaatcttctgaagatgaaggtaaagattaaatgttccacgtaaaatgaggtggtaacaacgtgtgcttaattgcgttttaattattacaaacttgaaacatggattaatctgatattttaaaacaacttttatataaaaagttttcgcacgaaacacaccgtttagcagtttgaaaagcgtgccacgaaaatccaaaacttcatctaatgtttgtagtggaaaccagtggcagatttaatttgggggcggggggtcttgagaccccactactgccactgggaccatggagaccctcctaagcccccactaaaaattatttgcatagattcataagatatgggagctgaagactctcctaatttgtttagcccccactattattttgttctagatccacccttggtggaaacgaacgtggccatagccatatactacgtgcttccccaaaaaaaaaaagaagagagagagagcatatactacgtgctgaaaccgcgcaaacaacgaaattgaagagcacctcgcaaaaaaaagaaggaaaaagaaagaaccagttaacagcggccacaacaataggctgtactctggtactagcggctggcgtggaacaatgataagtgggtataccaagaaatggtttccccatcgcaggttgggttgagtttgccttggcatgatggaaatttgggctgcgtggttatgggctgttgggtagctacttactcatttgttacgagcacattttctaaacgaataagtctactatacatccttaactctttcctggatcgaatcatatcccttaaccacaaaaccgggtataacacctttcccaacttaaaaaaccggtgcaaatcgactctttaggtggtttgcgaagcgattttgctgacgtggcataattgacttggtccaagtgcactaatgtggcaatccagtcattaaaggaattaaaactagaagtgggccccacttacaagtgacaagggtaagaataaaaaatggtgggcccacctatcagctccactactactctctcaatctcgaacaaatttttaacacaattttgttttcaaatttagatagcttgcaaaaggacagtgacactgccccttaaatttataaaagtatttcttcaggtttgcaagttcagataatgcaaactgagcaatgagcatgctatattcgtttgatcgatcaaagtcgacaaataaattgtacttcattttataattatcagacggatgcaagtagatctacagtgttgaagaacaaaatgaaacacttgagggttatagcaaggttgagtactacccatcgtacttagcaagtcataccgaatatgggtatgatgcaagggattacaaggacaacataagcgctcatttgtataaagcactagtaaacagttgcggttgaaaacaataaagctatggataatgttaagcaatactccctccgtactcgtaaagaaagtcgtttaggacaatgtttaagtcaaaccttgagaatataaatcatgaataactcttaagttgttaagtttgaaaatataaaaattatatgaatagatttgtcttgaaaaatactatcataaaagtatacatatatcacttttcaataaatatttatagaaacaagaagtcaaagttgtgttttggagactgtgtcgctgtccaaaataacttcctttacgagtacggagggagtattgatcaccgatcaatgctacaccgtgttaatagggcccagccatccacctgtagtatactcccttcgtacttgtaaaggaagtcgttttggacagcgacacggtctccaaaacacaaatttgacttcttgtttctataaaaatatttattgaaaagtggtatatgtatacttttatgaaaatatttttttggacaaatttattcatataatttttacattttcaaactcaacaaattgagagttattcatgatttatattcccaaggtttgacttaaacattatcctaaacgacttcctttacgagtacggagggagtacctattctaatattccattaagtcaatttaattaagagtgtgactaatcacggtgaatcttggtcaatcacccataacagcgggcttgactatttgaatagttttactttgactaaaggtgtacaactatactcagaagacacatcccccatgcatgtctccatacaccagcgtatcgccatggtaccctagtaagaggctgtgataggaccctttgcataaccatttacaccacgttgaggttttgcccctacccagaccaggataggtgctagtatttcttacggttatagataaatccgcaagatcacggataccgatctagcattttaccctggagtattccaagtgtgctgtatttatatttctgcaggaaaggtaatggtgtaaagatagagttcatacatccttaatcaagctataattactttactatagtctaaacatgggttaattgataaatgataatgggtaatgtgacacacaggagattttctctaataaatatacactaggcagtggagaagaactatagaaagctaaggttcatatgtacttgtatattactaatgtttagtagtttacatttaacacatacatgcttacaaagctagcacttaattctaagcacacatgtactaccgagagaccactccctattggtctgccagcgtggttatggtattttacaaactcttacgtcatacccgggcgtggcagaatacaagggacgaacatggctgtcaccacctgccacctgccatctacctcactttccgtggggcatacctacatccaacgatatttagctaacctaagaaccatccttatgttaataaataatgtcaccatttcccccaggactcccacctttcagatggataagttggaactagtgcaatccgttaagatcattggaccgttaccgtagcatagatcgactagcctaatcgatcaaatgaagcatataaataaagtacaatctactcatagagcacacatctagtaaactagtagataattcctttattacaactatagtcttacaagaagggtaaagtactcaaggcatacaggaatctccgagaagactatagaaccaaagactattgtaaccctaactccactactactagatataatacaatatggaatgagagaattgcttcttgaagtgtgtgttgaaagtgaagaatctcctctccttttatagcctcctaatgatggttgtatggcggattggcggttactgaggtcggtgcgctcctaaccgtcattagggagggctgagatgttgccacatggaagatgaagatgaggggtagccatggcggttcggccgacccctgggccccacctctctccactgcctttcaccaaaggctgccagatgggcccctatggtggttgaggatggtttggccccactttaggtcggtttggactgacttgtgagcccatcaatccatggactcgtacgtgattcactggaggtatgttttttttgcatgccggctcattcccccttcactttattgtgtaatctctgcatgcacattaattcttcaagacaagtggaactacattatttaatactagcatacatataagaaatgttagttctcttttatttattatggtagttgacggtcgaaattggtacttaacaactgtcaactaacaccccaagctaaacttttgcttgtcctcgagtaaagataaaacttaggttgtttatgatcaggagttgctaccatgttttatgtcacaacagtatcatgcccacaaaatatccttctacctagaatttgaataagttggcaacaatactttaacctctcttatcatactcccatgggttttttagcttctcctcgtcttgggtagttgagaggtagaacggatcgtagagcattaatcacttagtctttgttaaactttctttatggaggttttcaagaattttgcaataaaaccaaagttcctccaatgatactctcagatcgctcaatgtgtacaatttctcaccaaggcgtagtgttgcatctttttcatcctacctctaaaaggtttatagtggagctcaaggtgagaaaaaataatgagacaatactttgtacacatattttgcaaaatcaaagagaggatccaaggaagaaagcaaatcatacaatatgatcaagatgtgcaaagtgtgtggctatatggtggaaggtggtatgtggtactcctttgtcataggctctctttattcctaattggagatatgactatttttgttctaactatttttctcatgttgctcaggaattattgtgagcatacactccttttctcctttttctcataatatgcttgagagcattttctattttctacctcctccttttttttttctagagccatatgttttgcgaactgctaggagcaatttctttactgacatgaatggagtatttatttggtggatgaaaatgttgctaaccgcagtgaagaggacatcaataccgcccatacatcgacgtgtacacaagtacaacttcatggttctattacccgcgctcatgcgcatcaactcaactatcagatgagttcattcgtgagttcatgttcatctgatttatactctcgagacacgtgcattcttgttttaattaggaatgatggagaggatcaacaggggagaggattcatgtgggctggattcagactgcagaacatcaccaacttatgacgaccaccacgactttatgcggactccgttttgcgcgtgcgcataaaaagtttgactgttttgagctccacataacaaataaaacaaacatgcaatggtacatatgctgtgctaaattcccaacatagaacttataaaaatgtaaaaaaaattgagaaatagagtagtacaaattaagtataactaacctttggcgcaatagatctatcaaaccattcgagttcaaaacattctccccctatgtttgtgttcataagagagagaaaatcgtgcttaaatagcatggcagttaaggctcgaccttatataggagaagctattttcactagcggacaacttaagccaacaccatagaaaaaagtaggagtggcggtggcttaagtgggccgcagcgaaaatatcttcatcttcactggcgacccacgtcactagtccgtcatcaaagattttccatcttcgctggcggtcacttaggtgtgccaccagtgaaaacctcaacagcttcattggcggcccgcttaatttggccgccagctgttggcggctgttaaatgccgattttataccgccaacatctgcataaaagttcagataataaaatatccaacatagtaataggtgcttaatctcacatattccacaagtgttggtatatatttgtatgcagataataaaccctaaagttgggaggaaaatcaaactaaagtgaggagaaatgtgtatccatgcatggatgggttgtgaacttcatcaaaatgcccgagaatcaacccaaaatcttgagaaaatagatagaggaggtccagggggaagatgggccaagagccaggccagatgggcctagcccaggttcggccgaaccaaaatctcagccatccaggctggggtttggcgtggacggtcctgatcatctcctgatggcggttgcgaggcatttccgacaattcgcattgtataaccgtcatacctacccctatataaggacatcatctcactcactttaacacacacttccaagcttgaactgaattatacaaggctctattgtactatattgtatactagaataggaagagagtagagtagaagaagtcggaagaattccggagttgtcggtaatcttctcctatttcttttattttgtttattactctgaattcaatataatattcttcctgaataatttagatttatcttgtgagaattatctcttgattagttcctaaacagcatatgggattattgttcactataaccaactaaaaatataatgtttgctttgttgagttataaacactaaagtagatattaattgcttagacgtggtgtttaggtagttgttatccagtaattgctgcgtatcgcacagtacgtttgaggtaggtgtagaggtggtgacagccctcgagatcacttaagtcctccctgtccgggtacgtagtagagcgacatctgagaacagcgggttgccagtgcctgaagtattgcattaggattaaagttaagcttttcgtagacactgtttctcactagtaaatcctctctatcctttcctatcatctgcttggtgtccttggatgaaccggaggaagatctgaccacacacgttcccttggattcgatatccttggaatactctgtaggggaagtgctacatcggtatatccgtgcgcttgcggattctatctgtgatcgtaagaaatatcaataccaacgaagatcggttttcgctggcagtcctaagccccccacccctccttacgttgttgctggcggtttcgcgtatggccgccagcgaaaagttttgtgtaacgccatgaaaaattatttttctagtagtgattgcatatatcagtcatgtagggaaagattaattatgtcccaaaatgtccaaaacccaaaatgaaatatatattgattagtgaacgtattccgtatgtagcaaataaaactaagatttttggatttgataacaatattgagccttcagtgccagtgtccagtacgttattccaaactgtgtgcacctggtgtagtatttagtttttttaaaataatgttgaacgaagtttgccaacatgttttattatgtttgccggggaacggttgctgatcatttccaaaccttgttcatcctcgtatcctttttacttttttatctctagctctgcccctgctatccgagaaaagtattcttgttaaactcttcttgatcatggagcaacctctttttgagctgtccgctccttgaggcgaattctatgagccatctccttcatcggagcccatatatacaactggctatgaaattcgccccgagctaatcaatatggttaaggaaaatcctttttctaactttgatccagaaaatccctaccatcatctccgagactttgagcaagtctgctcatgccttaagattcgtggcatgagacaagaaactgtgcggcggaaattgtttccattctctcttccagaaagggcaaagcaatggtacacctctaccgttggatgtgtaaacggtagttgggaaaagttgcaagacagattctgtcttgccttcttcccagttactcgtatcactgcccttcgagtagaaattctcagttttaagcagatcaaaaacgaattaatcggtgcagcttggtccagattcactaatttagtgcagtccggaccaaccctgtccttcctcgagtatgtgctactacagcatttccatatgggtctagataaggagtctgcattttatctggacataaccgccagaggatcgttcatgcacaaaatgccgtcggaaggaagaacaattttggatcaaattctagaaaatacttccttcatgacgcaatccgatgaaccccagacagaggcatctgtgtcaaagatagaggaacctctaacgattgagccactctctgaaccatccacttttgctagcttgattgatgagaaggttcctgagcagccgtccgtcgaggatgaagaaattcagactccggatcatgccgcaattctgtttagggatggttttgacgaagattatggcaataccctgaactatttcagtaagaataaaccactcattcctttgtcgcctctcgatcctatggaacttggcttcttaagggaaactgttcgggagctaacatccataatgagcgatgaatggctaagggaggtatagctttcatccgaagtaattcgggtaaataccgctccccgaatcattcgctgccatctggaagggaacgacgtcggtattctctacagcccgatcgtcgaggtcaatctcatttctgagtcttttgcattcgcttatctaagcgataaggcaataaccccaacgaacaaattcttcaagcatccgaacgggaatatcattgaaggatttgggattgtacaagatgtgcatgtctgctttgaagatagggaggcgatcttggatttccacgtctttggaattcaagactttgacatcctaatcgggctacccattgagcagcttcttattaacacaccccgattagacagcctcaaaataactctaggaggaaatgaattttcagttccattctcacgggcaaggatcgccctaaccgaccctctcccagaaattgagtcagcagaggaggttaccgcagttccccctcacaagtctcccgaggcccttctggaagatgaagtccccgatttcatcaaggaagaagcggatcccggtgagactctcgatctgccaatcatcgaaccgctacctcgacttccgcttgagctaaaacctctacctccgggcctatgctatgctttcctacacaatgacagagaagctcctatcataattagtgacaagctctctgaagacgagactcaacgtcttctcatcgtgttggaaaatcatcgttctgttcttggctattcccttcaagatctcagggggattaatcccgcactttgcactcttcgtatccctattgaccccgagagtactccctttagggaacctcaatgacggctcaataatgcgacgcgagaggttgtaaagaaagaggtcttgaaactcctacatgccgggattatttatcccgtaccatacagtgagtgggttagcccagtccaggttgtgccaaagaagggaggaatgacggtcgttgcaaatgctcaaaatgaacttatcccgcaacgaaccgtaaccggatggaggatgtgcatcgactacaggaagcttaacaaggctacgaagaatgatcatttcccactacccttcattgatgaaatgttggaacggctggcaaatcattctttcttctgtttccttgatgggtattccgggtatcatcaaattcccatccatccagaggaccaaagtaagactacgttcacatttccatacaacacctatgcctatcataggatgtctttcgaactgtgcaacgcgcctgcatcttttcaaagatgtatgatgtctattttctcggatatgatcgaggacattatggaagtcttcatggatgacttatctgtctatggaaagaccttcggtcattgtctgcagaatttagacaaggtcttacaacgatgccaagagaaggatctggtacttaattgggaaaagtaccatttcatggtccgtgaagggatagttcttggccaccgagtgtccgaacgaggaatcgaagttgatcgtgctaaaatcgatgttatagatcagcttcctcctcctgtgaacatcaagggaatccgcagcttcttgggacacgccggcttttatagaaggttcatcaaggacttttctacaatcgcccgacctctgaccaatctgctagccaaggatgcaccctttgagttcgatgacacgtgcctgaaatcttttgaaatccttaaaaaggcacttgtctctgttccaatcattcaaccgcctgattggactctgcccttcgagatcatgtgtgatgcaagcgatttcgccattggtgcagtcttgggccaaaccaaggataaaaagcatcatgcagtctgttacactagaaaaactctaaccagagcctggttgaattatgcttctactgaaaaagagctgctcgcggttgtttttgctattgataagtttagatcttacttagtgggagctaaggtaataatttatactgatcatactgctctaaagtacctactcagtatgaaagatgctaagccacatctcttaagatggatcttgctactccaagaatttgacttggaaattatggataagaagggagtagaaaattccgtagcagatcatttgtttaggctgcagaccactgacacacaggaacaaccgataaatgacttcttgagagatgacatgctgatgacggttcgcgactccaacccgtggtatgccaacatagtaaactatatggtatccatgtacataccaccaggggaaaactagcgaaagctgaagtacgaaagtcgctgtcatatatgggatgagccatacttatatcgagtctgttttgatggcttatgcctcaccctatggtggccattatggtgctttccgcacccaggctaagacttgacaaagtggcttcttctggccaacaatgtatgaagactcaaaagaattcgttagaagatgcacaaactgccagaggcaaggaggaatcactactcaagatgcaatgcccctcacatacaatttgcaagtcgagatatttgatgtttggggtatagactttatgggacttttccctaagtctcgcaactatgagtacattctggtggcagtcgactatgtctccaaatgggttgaggctatgccgtgcagcgccgcggatgcgaagcatgccaagaagatgttcacagaaaccatcttcccaagatttggtacccctaggatggtcataagtgacggaggttctcacttcattgacaaaaccttccgagacctcctacgagagatgggagccaaacacaatgtggccactccataccatccacagactagcggtcaagcaaaaacattaaacaaacagatcaagaatattctgcaaaatacggtcaacaaaatgggaacatgatggaaggatagattgccggacacacttgtcacgccctaaaaatcgtctaatgtaaaaatacattgtttaaatcatttttagaaattaaaattaaaagcctacaagctaaaccctaattatctaggaaaattttcaacataaaaatgagctagataaaattttattaaatactttgcttgttcctctattttctagaattttctgggaattgtttgagcaagggaagtatttttaataattggaacaacatttcacaaattattttaattaaaaagttcaaaaaacccttccttaagtggttgggccgtttttggcccaactttttccccctcccgcgcagccgagccggcccagcgccgcccaagtcggctcaagccgagccgcccgcccctcctctcatgggacaccgacatgtggggcccacatgtcgggcccttctcctacctccggccggccggccttgctagcccgagccgccccttttcccctccaaatccacctcgaatccggccaccccgagtccctttttttgaggggtttttatcctctcgttctcctctatctttaacctcaaaaatcggagcaaatcgttgagtattttatccgaatcgaactcgttttcgagtttatctctaaaaccgagtttttgatttcccgagtcgatttcttgcgggaggagtccgatctcttcaatccaaggctatatataggaccccctagccctcctctttcgtttgccccatcacccgtcccctcccgtgccccgtagctcgccgccgacgccgcctagcctcgccgtcgccgccggcgatctccagccgcgccgcctccgccgtcgccgtcggtcgtcgccaccgtcgtgggcttcaccacgccgtagggaagcacggccaccctctcctttccgccgccggccgccgtagcccgctaccaccgcgcaagccgagccgccgccgccatcccctcgtcaccggccgtcgtcgttcgtcggtagacgtgttggtgagcaccgttgcgttcatctcgtcgtcctccacgtgttcttgtcctcctaatccgcagccggccgctctatctccggcgaggtcgccatcgtggttcggccgccattgatgaagtcatcatgtcatcatcggtttttttctttttcccgtttttctaatagattaaatcttcggaaaatcataactaaataaccgtcgatccgttttaggtggttcaagttgctaaatttttctaaaaccgagatctacatgttaaaaatatccacatgtactgtttatgcttgtttttatactgttttgttgatttttgtttaattgctttagtttccgacgttccggaggagagtgtttccgttgaggaaggttccgaagcgtttgcggaagcccaaggcaagtcacacagatcccaaacaaccatttgagcatgttgaacccacttaaagctattattttatttcaactatgcattgtttttgaatgtcatcgggtggtgaaccttttccaattaattaatggccgaagatgatcttattttcctatgggttataatttgattagcatgaaccttatatgttggattggttcagctaaatgctatatgtaagtttgcttagccatgcttagaaacattagctaactaaagggattaattataaactatgttatattattattaattatggttacattaaatggtagctcacgatggttaatcgtgtgatgttaattaattgataattaaaacctggttaaggtgggttgtgagcatatggttttgatggttgtgctcatgacaattaaggaccggttcgcgagctacttttgtgaaacatttatcgtgccaaccacaagccagcgtgggcaacagctttatcttttgtatagcatgattcattatagtgcgccagactgtgaagcggcgagaagtccgtgggggtcgctggggagtccattgcctctggttttgagggggagattatgatccaggaacggtgcactgcggtgagttgtgttgtgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtctcacactactcatcaatgttaataatgtgataattaatttgactcctggtttggaatggataattcctagtttggaggtttaatttgttcaactggggttggttgttcaaatgtggttgggcctatgcaacatgggtgtgttgtatggtgtttatttaatattgattaattatacaactgttttactattctcttaaatatttgttaaatgctgttatgcaaatgagctatattatgccatcctttgttatcttgtgcacttgcatatttgctgtgtggcttgttgagtatgttatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatccacctctgtaataatttattatttgtgaatattaaatagttatttatttgtactctattatcaatttgttattgtgtgcctcggttgattcctggacgagggtttaacacacatgtaagcgtttggaattttggatagaaattccgggcgtgacaacactgtgggcataccggacagcatacaagacacccattggaatgtcgccatatcaggtagtctatgggaagtcatgttgactacctgtagaactcgagcacagagcatattgggccatcaggaactggaacatggactttgagggagcaggagaatggagaaaaatgcaaattgctgaacttgaagaatggagagagaaggcttaccacaacgtaaggatatacaaagaaaggatgaagcgctggcatgacaaaaggataaagatcaagaaattcaagtcaagagacaaagtactaatgttcaactccagggttaagctttttggccactgaaaactgcgcagtaaatgggaaggaccgttcgacgtcatcgacacctcttcgcacggggcaatcacactccgcgatgactcaggttttgaataactgtgggggagatatcccagcttctgacgtgcatatactctgaaaattgttgaatctctgaacacctagaaggaactgaactcagcagaaaattgcagagggattaggcaccagagtggttcggccgaaccagtgttggccctaattgcccacaatttttacaggtaagtaggtaagcacgtctattatctgtatatctctaccatggtatagtactagaggtgaaaatttaggaaacacttggttcaagcataagtgaaagataaaatttccaactaatgaaattcttcatatgattgatcttgtataatcattattctcagccgaacttgtgcttgtgaacaaccatccatgtgtagggaaccttatgcatctaggtaattgcttcatgtgagatgatttatgatgaaaggaatttttgcaactcttgttatgactattgggaatttgttttcaaaataaaatttgttttaaaagctcattcctccaattgacttcattttatacctactaaggccatatgcaagtatatcaatgatcaaccttattacgcatattactgcttgacattatattgagctttgtcaaatttgtgtgactcgtgttagatatctttcatactctcatgatcaaggggtcaatttcactttcatttccacatacatgataaaaagctaagcttctacactggaagttggcttctcacgaaaaattccattcgaataaactcctacattagactatgctttcttgtcctagaaaagtttttggtaaaaagaaaatgagaaaagcagggaaaggcatggctatgaaataaaaagagaaggaggaaaaaaagagaacaaaacttgctctcgaaacattgagcatgatgagaagaaaatatagccatgccccttccataatcatgccaaaagaaggagaaagtgtaggaaaaagggagaatcatttctttatgccaccatttcacaaaatattttacttttccatttctcaccacacataaagacccctgatctaggagtatgactgatgatcttattaagtccgtaattttggctttgcaatatatatttgatgcaggtatgtcacaatttgtcccaccgagctccacgtatcagccttagaatagaggtatattctggcactctttgccctggtaaggatcaaaaaagaaaatccttgagagataagagagaaagtcaatataaggaaaagagctggtttgcgaaaattcataaaaatcccatgagtctgacagagaagcaagaaggactggaatcaggatcattccatctatcaattactcaagatggtaagatagccactgataaagttcacaagtataggtatggttatgaatggtgtatatgcatgatccagagttgtcggtaatcttctccaatttcttttattctgtttattactctgaattcaatataatattcttcctgagtaatttagatttatcttgtgagaattatctcttggttagttcctaaacaacatacgggattattgtttactgtaaccaactaaaatatagtgattgctttggtgagtttttttttttgcggggaacgggagatatattactcggcaacagcctccttacgagccacgtgagaaataaagttacaagagttatctggcctgaacttagttaagctattactacggcccaaattggccaacaagtggctcagatgattttgatttctatgaatcttgcacagctttacctccctgcttcccatcaagaggtcacgaacctccctgactaagaacaccatgtctgaacgcaccattgaatcggactgaacaagttgcttcgccatcagactgtctgtctctacgacaatcggaagaagagtccattgtagcgccaaggaaagcccatctctgcaagagaggagttcagcttccagcgcactgccgtagcgatccacaaatccagacgctgcaaaaattacttctccttccgcgttccgcagtactgcaccgattcctccttgcccgtcgctagcttggaaggacccatccacattcaacttcatccagatgcctgtggtatctgccattttgggctctcgtcacactgtatctgaactgacacactgggcttcgacgcgcgagcatccaccacatgtttgcccttaacaaggttggctcttgatgttgcttgatttctgccaaagagtggatatagctttcaatgaatctttttgatgctgcaatccccggaacaggcttgccatgggtaacctcattccgcgcgtgccagatacgccacagtgtcatcagagtaacagccctctcagactctgcaatccttcctaggtgatcaagaatccctggtgtactccccgcggcaatgccggacggaagcaccctacgcagatcaacccccatcgcttcccaaaacagacaagcgtgtgggcatcggtagagtgcatggccagtgtcttcagtttcaacaccgcatatgctgcacacgttcgacacctccagcttccttttcttcttgttctccagcgtcggaaggcagttagtgactgcacgccacacaaagattttaactttttgtggaacattgcacttccaaaccatattccatgccttacttaggttgctgtctgacgagcttgacccctcctcagcacgcgccagtgatactgccaaactatatgcacttcttactgatttcttttattctttttattactctgatttcaatagaattatcttcctgagtaatttagatttatcttgtaagaattatctcttggttagttcctaaatagcatatgggattattgttcactataatcaactaaaatatagcgattgttttggtgagttataaacactaaagtatatattaattgcttagacgtggtgttttggtagttgttatccagtaattgctgcgtatcccacagtacgtttgaggtaggtatagaggtggtgacagccctcgagatcacttaagtcctccctgtccgggtacgtagtagagcgacatctgagaacagcgggttgccagtgcctgaagtattgcattaggattaaagttaagctttccctagacactgtttctcactactaaatcctctgtatccttgcctatcatctgcttggtgtcctaggatgaaccggaggaagatctgaccacacacgttcccttggattcgatatccttggaatactccgtaggggaagtgctacatcggtatatccgtgcgcttgtggattctatctgtgatcgtaagaaataccaacaccagtgaagatcggttttcgctggcagtcctaagccccccacccttcctgatgttgttgctggcggtttcgcgtatggccgccagcgaaaagttgtgtgacgccatgaaaaattatttttctagtagtgattgcatatatcagtcatgcagggaaagtttaattatgtcccaaaatgtccaaaacccagaatgaaatatatattgattagtgaacgtattccgtatgtagcaaataaaactaagtttttttggatttgataacaatattgagccttcagatgccagtctccagtacgttataccaaactgtgtgcacctggtgtagtatttagttttttaaaataatgttgaacgaagtttgccaacatgttttattaagtctatcattttgcagcaataattacattttaccaaatagaactattaatttttcactctatttttatcaaatgtgataacatacgattgccaaatttttttccgaacatttatataacagaaccaacatataatctatacttcttgaaaaaaaaagttattgttggtggcagtgaatctgccatcccatctactaccattgtaaattttacaagttaatgcctgaacttcttaataacaaaaagaatcaaatcttaactaatgaaaggtaaaacttaaaatgaaacgaggataaatgaagataaatgaaatattagccgttggatttactacaaaacaaaagaggataaatgaagcttgaccgttggattagatggatggtgaaaataataatttaagaggtttctgaagatgaaactactagaaggaaagaaagaaaggaatgggaaaagctaaagaataaacatatgaaggtataatgctatacatataatttacgatttgcatctattgtaaaaactattttactaataaaccctcatcataacaaaagaatcatgggtcaagaatcaagattgagctatttcaagtatatacaaaatgtatgttcatttgattaatttttttctaacaattaattttaatatatttgagaaaaaaaatacaataagtacatgcacaattatggtcgcccaaatataagtttaatgattttcacacgaatttaaatgaaatcaaacccattccttaaaaacctacaaaatatttgtgcatagactaaaaaagcacgtgccaaaaaaagtaagagggtcctgcaatcacgaagacctacaagactataataaaatttgtaacaaatattaagctatttagtgtattatcataatattagtcaatctaacctatgttttttgtatgagcaacgagaaactcatacaaaagattaccagtggtttttttgtaattttaatatgtttttttttgtaatttaccactcccacataccacataatagaagacctagagtcgcgtgaatgtgcgatatcataggctagtctaaatggattgccatataaaaaatcagaggaagtctctatagcaaaaagatgggtaacacattaatacattttttttttcttttagctagttaccattatagcataggcaagcagtgaattagttctcccaaaaggcaaggaaaagtgatcaaagtttttttttgagggaaaaagtgaacaaagttatgcagaatctgctagcttgcacataatgcttcaaaagtctgtaaggatatgatgtatatataataccgtgttgtagatatgtactcttgtagcacaccatgcatgtccatatgtatgaatttctcgagccaattccccgctagattttccttttgttcattcagttcatcttcttgtacacactagctagtattccgtttaacaacaagctgaaagtgtttaatggtagcttaacgtatttttgagttactctcttttaccttaattactcgagggagcatagaaagttgttaagtacagtgaatttcgagagtaaaatcacggtcatactagtacatataaatgttgatagtactaatttgggcacatgccatacaaagtttaataatattattatgtgtacccatggggcaagatgcatgcatcaagctagctagcttttgggaagtaggtccttgtgtccgataaagacataaagttcagtccccgcccaaagtacacaccttgaaaatacttcagcatgttgtgcgtataatatggtggtgaccaccaaattgttgcttgctccagcatgtgttgcattgtctgcactttattggcactctagagagagccagacagcaagtagtaggatgcaataacacacatgcatgtgttcaagtagtacttgcagttgcatacttgcatgtgttcaagtagtacttccagttgcagttgcatacttgcatgcagctttttgcagtttgcacgttccattgcaactgcatgcgcgcgaaatgtaattcgcaagaggtgccttgcaaattgccaaccttttggatgatcagtcagcagggtcactaccaccattgatctccgacagccagagaagctcctccaggtactcggcgccgaggtcctcaagctccacgacgaaccgcttctgctcgtccgtcgtcgcagtagtcaattccgtgctcttgctgatcctccgcgtctgcggcgtggcattcgccgtcgcggcggtggcggcggcggcggcgagtagttcagctttcttgcgccgctttcgcttcgagtgccgccgcttcagcgccagcacgggggagcccccggccgcgccgagggagagcgcgtggagcgactcgcggacgcgctccacggggaagttgagcgccgcggcggcgccacgcgccgagagcgcggcctggtcgtaggccatcgcggcggcctcggcgctgtcgaacgtgccgatccacacccgcgcgccgttccgcgtcgagtcccggatctccgccgcgaacctgccccacggccgcctccgcaccccgatgaacgccgccgccgcctccgtctgtccccgaccttgacgatgatcaccgcccgcgctcctcctcctccccgccacggaggatggcgcaggtgtctcgtcgggccagcccgtgtcgaaccgaagcatctccgaggaggaagacgacgaagacgaggaggaggaggaggaggacgcggcggcgtctgccgtgtagccgatgtacatgccggcgtggctgaaatgctctgccattgatttgcgcgcttggattggatagagagatcgatggtggcgtggattgacttttagctgctgattggttccaggaaggcagcgaatcgggtagcgaggtttatatagagctcgctaagagcatgtacaatagcatgctataagccagctgtaaacatattttaagaagataaataaagagagagatgggcagcgggctacagatttgtaaccagctgtagcacggactccaagatgcagtgtgtgtatgacagatgggaccaagtattaatagtgtagtatgtaattattatatgaatgagctattagattggctataaataaattggagtccgtagttggctatactattaaacttactctaagtgcagttggagggattaatatagtgttcatagggcattagggcggcagggttgtggggcccataaatgggctgtcgcttttaacgggaaaggcgtctggtcgtgtagggcacatctggcatgtggctgacatagggcggctggataggacaaaagtatatgacgtaagcgatcccactgtgtgatagtggtatgtggagtactggagtgtgctgttgccttgttcgtacgtgaagaagcttttgcttactaggaacagtgttccccaatttagatcgagatatttctgaaaaagtaaaatgtataggtgctctcttgtagctcctagtacatttttattcttaaacattgataataatgattggaatttaatcatgttaaggctggtttccattggggttgggagcccttctcaagtacgtaaaatggagaggtagattagtgcatgcttgattaagtattagctaaacaaacttaaaaaattaattaatatgattttcaagtaactttcctatagaactttttttttttgcaaaaacacaccggttagtagtttcacgaaaagtatcagtggaaaacgaaggattagaaattggattttaggctagcagtggatgcgatatgccttgcatccccacctcttccttccctatgttaacctcttccttccctatgttgtgcgggaatggctagcctagatttcttacaatttaatcttttctaaaacttattttataaacaaaactctcaagaaaacttatgatattaataaatctttttttggtgcaaatgacgctgacgccgtggccattcccctgccaccatggaatcccggtcgacggggcacccgggggatgacgccaatgacattggcaccttgggtcaacccataatgctagcatcatttgtgccatccactgagaaggactaagccgcgcgggatctcccccctcccccaacctcatttcccccctgcctgagtgaagaacagggagggttcctcccttccctctctctccttcctcacctcttcttcttaaatgtgatcgatttggagatgttttttatgggatttgttggcggaaatcgaagagcgcggtatactcacattctccttggtccatccaagaacatctttcacttgcaaccttagttcatctatagtgggatgggtgggaataaaaatgtccttcaacatcatatcctcgaactcaatatgtgcaccaatataacgtttaattaaccaacctacaacgtagtaaagacgagcaagtctatccatctacaccgaaaacgtattattataatcttttgaaaatagtctatcattcttcctaaatgtcgtacaaacccaaaagtttctttatcaatgcataaattaagattgaccacaacataagcctaaaaaatgttatcaactactagcctacaacaaatatttaattgacatggaaaaaataccctaaaaatataaatcgtgtcctaaccatacattagtctatcatatatacaatgaacacatacaaaaatcaaatgcatggctcacatctatcatatcgatccgtacccaacaataaacctaacacatatgctctcaatttaactagcgagtagagttgcgcgttcgcgcgacccaagcctcctgtctattagatttggtaggaagtgttgttacatttttttatctctaataaacaatattgttgtgataataaatagttaacatgtctaacgtgtaaaaattattgtaaatataatattggaaggttctaaattatgtatattattagcatgtattatattttaaatatttgcccaaatattttttcatttaaaaaattattcagacagatatttaaaatataataactgctaataaacttgtggagaaccctgttgttttgtattataaactttagtttaagtcattctattgaaaggaagcattgcacgtgacaacacaagcgaaaagaggcggcaccactatctgttggcatgcaatggcaactcctcaacccttttatcttgttcattcatgttttatttctccatgtacaccaacgcttcttccatcccaactcaacacgttccaccatctcctctctaacctgatattttttggatgtagctgtatttatggcaccatattttacaccaaaattagtcataattgtttttacagtatgtaaattacatacacccacattgtaattgcaccgtaaattttaaaactcaaattgtaattacattgtaaaatttaatatttacattgtatacttttctaatacacaatgtataagagaattagaattaaaagtaatttattatctacttggaaaatgagactggagagataaaagcatagttacatatgggagaaagcaatcatatggagaaaaagtgactgaaattaaataaaaaatgcggtgccatatttttttgcaaacccatattttttttctaattttgtatttttttaatgatatttttgtttttgccaaagttatctatgattgtgtttttactcccacatgtattccctagatccttctaatggaagcctcctcactgttctccttctctccatatttttagcccttctttccaaatccaatggctcatattttaaagcgtacgtggctcaatcaggaaatgaataaactttcgtcattcaatatgatgatgcctaaattcatttttccatatactccatacacatagtcactaaacaattccagtggcaagtatacatttgaaaaaaaaaatcgaagagtgtcacaacctgaagtttccccccttttcttgctttaaaaattggataaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctcttttgggccgtcggcccactccctcccgcgctcggcctccttcctttgggccggcccgttcccctttcccctctcttcgggacgctgacaggtggggcccacctgtcaggtcgtccccttcctccagccgccagccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcaatttgaatccccccactctctctctctccctcccacgtcgccggccaaatcggggggtttcccgaccatgtccgcccctctcgagcccctataaagcttccccgcatctccctctcccttttccccttttcgtcgcgctctcccgtgcctcctaccggtcgcgcgccgctcgctactagctccgccgcttgccgccacctccggtcgcgcgccgcagccgctagagccgccgccgcgccaagccgccgccgccattagcattgccgccgcgtgagccaccttggccgccgctcggtttccgctaaaccccaccggagcccggttctcctcgcacaccggtgccgccgccgcccgtccgcccctcctcgtcgccaggtcgtcgccgccaccttcatcctccgctccggccgccatactcgccggtgaggatccccccctcctccctcttcccctctctctcgtttgcgccgcctctctccacgcgctggccgtcgctttcggtcgacgccgccgtcctgtaccccgtccgccgtcgcttcccgcgccgccgattgccctcgccggcgaccgtgcgcgtcgccgccggttgccatggccggccggccggttttgaagctgagccgagccgtgcctagccgccgccgtgccgtccgatcggcctcccggccgatccggaccgtcggtcccgtggaccggcggtggaccacccgtgtggtcccggtccacggtagaccggccaccttgagccactgcccgtggggcccacatgccggcgcccccttcctcacccctttgagccgctgacccgtgggccccgcctgtcggcgccgccccccccttggatgacgtcagccctgggtattattgcgcaataattaattaagtactttttctttattagtaaaaacacagtttatcttctaaaattcataagtaattcatccaagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttcttgaagacattgctgaggtctcatcagttcgagagcaaggcaagtcatgcaatacgtttgatcatattttacccaatttaccaatatcccgcatttctattaaatgttgcattcttttacaatgtaatgtgggatgggtcctattccttagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttactacaaacgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttaacttaatgaacttgtgtagttcaggtggttggttgggcctgttgcaacgtggtgtagtgttggacagtgattggttaatattgattaattactacagctgttttactgctttcaactactgctttgaaatacctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaaagagcctaccagcacattgctcacaagtaacaatacaagcctcaaatctcacattgcaaggcataaaataacaaatttgagcaaaaagtgattcctagggctatcttccaaactccaatttcaaccgattaaaatggaaaaaaataaggggaatttaggagtataccttgctcttcaatttccgcaagaaataccgcggaaaacaacactaaatcgaccggatttgaggaagagaggtgacagggagagagaggggagcaaaacgaagccgtcttcagttatgtatggtgtgcacaatgcgtaagattgtgtatgtcttatccttgagcctatgtagattagcgtgaatgcacgcctcgtgccatcaacagcatcaagaagcaccgcattacccagaggggatacctgctttatctagatgtgaccgagttcaaggaggattcgacatggcagtttatctattaattagaaagagtttgttagtttccttttaactctaggaaagtgtgtttagtatccaataaggacttcatgtttttcttttatatttagggaagtttctttcttgtccaataagaactagtatctatccatgggtataaatatgtacaatcggggtcattgtaaactatctccacgattaatacaaattcggcgcatcgccacccttttttacctttctatttttttcgacaagtttatgctaagacttgtcatggttgtttacatcggcggggatagtgctttgacactctaatcttgtcaatgtaagcacttacctattatatatcttaattaatctagtttggtagttcaatttacttgtatcggctgatattcgttttagggtttatgccggtatcgactaaattgctttaccagattatattagctaaggtatctaccatcctgaaaatcagtcaagggcttgattgtctagatattatgtttcttttcatacttagtgttgtatcagttaagtttgatctactaagtcgtgtttagaaccataatctctagcctgctttttgattgccaataacggtttcatcggagtttcagccgatgaggtatctagacgttgcatcggcttataaggattatatacaagatagattcagtcgattgcgacaaagatttcattgtttatctaattgtttggatttcatgacatcggtcctccagccgatgtatgctttaaccttcggatcattgcttattctatcatattattattagccgattggtttctactagattatattgctatttatcatcatcacctgattgtctttatattattatatatattggacatatagctgatagctcaaaatcctatcgatattggctggcatcggcatcggcattggctgaactactccattggcttgtcaatcgatcggctctttgatctgttatctatatatcttgttagttgcaggatcaaactgactggcacgtccacatctcaacaacctttggacctgcactggagctaaggagatctctcactctctcaggacgttgctgttgtcgacttagttcgcgccaacacagatatggtattatcggccaagcgtagatttttcatcaacagtgtataaatgaacttttctctttatctttgtaaaatgatgaactcttttcagcaaatgaattaatcaagaacacactaaaagtatccaatattcagtctatgatcatgtgcaggttgcagcgtttttgagagaacttttaacagaacatattctgaaatcaagaacaattaacattaagttcggaaataaacaatagaaacggacatttagtctaagatgatgaaaaacaaaagtgagaataatgaattttaaacctatctccaacttattttcagacttggtggtggaccaatatccctatggtttgggggataatgagccctgatttccaccttcccgggccaaaccgaatgcgatttttgtcagcacaaggattttttccccacgtggtgggcttccccgaaggggcagggcaaaaggccggtatcccgcccggccttttgccctctatccgatcgaacgaggcctaatcaattggtagagagatggttgagggaggctaattaattggtggaggtgctacactagctagttttcactagaaagagaggaggcagtggctagaggatgaagatggcctgatgagtaggtctaccggtgatcaaagaggatgccgacagaaaactctattgattcaaattctagaaaattttagtgtcacacatcttagctttcacaaatagcaatattattattttatcagaccggtaattttttaatggtatgaattcaattagctctctttaaaaatgtttaaaaatagaaaattgtaatatcaatgcctgtagtaatgctcgaccaggagtaatccattgtcgatcttcttaaattaaacgctctacgcaggtagtcattgcttgatgtgatggtcactattaattattttggaatgaccctgcaagacttattcagcaggttgttaccagaaaattttaattaattttgtttccttgaactattagcgcaatatgcaaccaagtcgtctaagaagatgctgatgcacttaacaattgagaattgtactgattaagtacataattgataattatatatatgcaatataatatgcttacgtgtagtaatgcatcaacttgttcgccgagcaatcataaggacaacaaaccacacaaaattcgataattagttaaatgtcacagaaaaaaaaaaacaaaatctacgtacatgaaggtggtgtttgaatcttctgaagatgaagatgaagataaagattaagtgtttcacgaaaaaagaggtggtaataacgtgtgattaattgagttttaattattacaaacttgaaaaatggattaatatgatattttagagcaactttcatatagaaagttttcacacgaaacgcaccgtttagcaatttaaaaagcgtgccataagtatccaaaatttcatccttgttggagaaacgaacgcagctttcggtgcgttaacgaaatctagtgatataggagtattccaatcaagccatatacaattcacaacctgcatgcacccccaatatagaaatagttgtcgtgcttattggacaggattaatgaaatgctcgaaaaattccacaaagaaagatataagttaaacgtacgtagacaaaaggatcttgccgaaaagaaggttccgcgatgcagagagaacagtcgatgtggacagcaggagccgcctcccgacttttctccgtggcagttgacacgccctggcaataatcaatattttagacgcatggtctcaaacaaatgcttcactagccaaaactgacctggatcaatattatctcggagattttgagggtttttctttaaagtcatgtacgtgatatatagggtaggctgcgccttactagttactactggtcatgttcaagtcaaaacatgactggattaaaaaaagttcagtgaatgagaacgacgtcgcaatcaccggtaccatttctcggtggacaaggccgtgtcgcaacaaaagaatgcaagatttgtgatgctacatgtttaaccggtcatggacttttggacttctttttggctcattatatatccataagatttggtttataatgagtcgacttttggactcattataatgacttctttttggctcattaaccggtcatgtctaagatttgtgatgccacatttttaaccggtcatataatggtcgacgcttgcagttttaggtgtggttaggggtagatatgtattgagtcgactcagctagataaaactccactcgttagacttttttttttgttagaattaatagatgggctaaggcccattcgaagattaattctttggaaaatcataaaaacccaccttatgggatgacatgcatatgaagtttagtaccaccttgcttattctaggagagggggacctccttaaaagggaggatgccctcctagccatttaaagcatgtgtggtggagagaagaggggaaacacacacgcgctcgctcgcctggccaggcacagggtcgaatggtccgcaaaattggctcctcacctttgcgcaggcggcgcgcgtgcagacgtcgaatggtccgcaaaattaaaattggctcctcacccttgcgcagatgtagcctccttttgcagttttgttttgctgcgggattggattcggatttgttttattttggaaacatttcgaaaaatctggtgcgtgaaaacggcatggagtccggataggttacgcgcgacttatctggttcggtttacgcgggcgccctgatcagacgatctatctctatataaaccgagccgccgccttcatgcaatacacgcgaaatcaatttagggtttgcctcctactctgtactgcgccgtcgctcgtagactactccatcccgctcgtcggcgtgcaccggcgatcgggagatcaggtctccggaacctctgccttcgacgtcctgcaccgggagaaggcggcaataagatttttgggaagcgcttcgcgcgactgctccctgtttgtctacgacggctcgccttcctctccgctcgcgtgcttcgcgactttgtcgacgctcgcaaccgcgagtagttcctgccgagcaaccggtctttccgccacctcggtacgtgttcgacatgttgcgcatatttgatctgttcatgttttactgcttagtttatatgtgtagatctaatgatgcgttcaatctagtttacatatgcaatgtcatgatttatttatggaataaattaaattattatgtgcttataatttcaacatgaacatgattgcaaatacacttaactgcgtcggcaccaatcatcgctgcaagagcagatcaagatggggaagtgcagaggacgcggagttttctgaaagtatatagctccatacctacctacaacctatattttgctatcataaaattgaatgcaaaccattttaatccagccatttatgtaatacattttagaagaaatataacatgtcatattccatatttctgatcccacaattatctcaaatgtaaatgatattgaagtacctatgtgtacgatgtttctcatccaaatttccaattaaacaaataaactcagcaaaatattgaagtataacaacatgaatttccagcaatccaaaataaaacgtgcgctggcagcgaacagcgaacagaaaacggcaaaaagagaaacagagcgtgcgccccagaaaaaaaaacgtttttttcggttttttttcccttccacgcgatggaaaagatctacgtttcatttttatagttttttctgttaggatgtttgttcggattggattataatttttttggaaaaggtttcagtgatgatcagtatttttttatttgtagtaaaatttatacactaaactttcaaattatagatataattctatgtaaatttacatatataaagtttctctctatatagaaagtttcctagtaaattgttcctttaaaaaaatccatcagcattttattatttctagtaaaatttacgcacttaactttctaactacagatgcattttctacatgaagtttacatatacaaagtttatatatatataatttacatatataaattctctatataaaaagttgaaagtttccacaagaactgtgttcaaaatgctataaaaaactataacgaaaaaaacgaaatatgaaaaaacggaagtgaaaaaaaaaacagaaagaatacttgcaacggattacgaaacaatcacgtaaaagaaggaaaaggaaaattgaaaacggaagaaaatagcgtgacccgatttgatttccctcttctaaactgattcgcgtgatccactgatggcgaacattcgcctacaaccctgttcgaacacaaccttgctttcatgctgcagcctagctactacaaaataataatttagatctcaacaaaggggccaaaatttgcacatccatactctttctatgtactgtcattaggatcaattagtagcggtaagactgtaatgacctgaaagttcagactggccgtgtatgtacaccaacatcaaaaattacatcatttaataaataatggagatgagcatattaagttttttcccctgaagtggagctgaagaattaatgagatgtggttgagaaggattattccgtcattgatagcaatggacccaacctattgtgcaacaaatggtggcatgagcaataagtttcataagtaacaactgaaaaaggtaccacaaagaaagttatttaataaaatgaatgcatttttacataagtaagacaatgtggcattcgagaggacaatttcagattcaccaaccatctgcacccgaaaccaacaaacctggccatgttcggtgtactggctcatccatgatatcatcaagcagaagaaagaaagcttgaaggtacccagactttctctgtacatcaagaagctcattgctgaaaaaaaaagagagaagaaatcgatgaagaagtcagatcctcctatagtagccaaactgcaaacaaatatgaatggaaaaagaacacagtgagtaaggtaggagaacatctattttttgaagtaaagacatgagtgatgtgaattatactgagaagaagttgattacagaaacaattggaggatattacatagaacagaaagcaaactgaattttcatgtcaagaaaaactcctaccagcttgtcgaaacaagattttggtaatactaaaagggggtggctatcaagctggaaaagtggatgggtttggagacaaggaattttatacaggttcaggccttcttaatcaagaagtaataccctactcctgttcgggatgattccgccgagtgtattattgatcatatgatctgagaaaaaatcgtgtcctgagaaggacccggaccactccttatatagaggaaggggtccgtattacaaaatacagtccatatccctaacggaatatgatattacagataaaatacaatcgtaaccgactaagaccccgggtacttccttgacatacaagttaagaaactaacccgagttcccataaagatattctatctatattcggtaccctgtatccaacctaactataactgccatgtagatatggggtatccataatctccacacagcttaactccgccacttttctgtcatctgagcaaacgccctagaagatccttctattccgctgaagctagatattccaccaggttgtgatctctttctctctttctttcaatctttggcctgatgatacgagcgaaagcaaagaaatcagtcagacagatattatactcgaattgcataggggacaaaaccaaacttctgttggaattaatagatgggccttagctgattcgaagattaattctttggaaaatcaaaaaagcccacctcataagatggcatacatggggagtttaataccaccttacttattctaggagagggggacctccgtaaaagggaggatgccctcctagccacttgaagcatgtgtggtggagagaagagggggaacgcacgcacgcgctcgcctagcctggcagggcaggcggcgcgccgcaaaattggctcatcacccttgcgcagatgcagcctccttttgcaattttgttttgctgcaggaaattcggatttgttttgttttggaaacattccgaaaaatccggtgcgtgaaaacagcgtggagtccggataagttacgcgtgacttatccattcagttacgcggagtggagatcgtgcgggcgctctgatcaagcgacctatctctatataagccgagccgccgtcttcacgcaacacacgcgaaatcaatctagggtttgcctcctactctgtgctgcgccgtcgctcgtagactactccatcccattcgccggcgtgcacaggcgatcgggagagcaggtctctagaacctctgccttcgacttcctgcaccgggagaaggcagcaataaggtttttgggaagcgcttcgcgcgactgctccctgttcatccgcgacggctcgccttcctctccgctcgcatgctgctgttaacaaccaaatttggtaatatcggcatcgggaaagaagattagatcgaagcaaagttagaggcggagatcgagttcgaaaacagagcaggaatcggctagagtccaaatcggctgcgataagatcggctgagtctgagtcggaataggtaagccgatgtagccgatctcaacaatacaacttgatgtatggtgtcaggttggattgaggtgcttcaaggtgattgccgcacatggatagaatcctaaggaggcaattgtatctattaattaggatgttttatgtaatttccttagagatacgtttgggaaaaagtctgtcgcaaaaacttatggtatcttagagtttgttagagatagcagttgtgtccgttatggacatatcttgtaattctcgggtataaatagacccgagccctatgtaatttttaacacacacgtccaatataatttcggcgcatcgccactctttttcctttagttttgtttcgacaagttcttgctttcgggttgagccgcattggtttcgatcttcaacaagaggtaaaacttgttatgacgacttgtgttctcgggattagggcttccatctttatgacactctgatctcgtttatgtaattcattgagttatcttatatcttacataatccctggcaatatcgttatctaatctacaatcgactaacatctgtcggtagagggcagccgattaggttagatatcgatgttgatttagattatataagatatctacaactctatgaaacttccagcggcttgattgtctagatattgttcttcttttcatacttaatgctgcatcagttgagtttgatctattaagttgtacttagaatatcaatctctagcctgttttctggttgccgattagggtagcatcggagtttcagccgatcttatttgacttaactacatttgctttatatgcttcattgacttgttaaatctgcccttttacgtcaaaatattgttgtatttaagtatattagacctttgtttgatatattatacttgttttaatatcatgatatagagtagtatcggagtattagccgatacatgttagatctatctgatcggctatgctataaacatatatagtcctgttattaatatatattttgatctaagtgatttatattgtctcggcacagcgaccgatctatcccaatcacttgatttaagtatatatcgatgtaagaattatatattggagatatctacagccgatcgaatagatttagtttttttattgtttatttacaactgccgatcgattcacacatgacatctgctcaaagataaatgatacgtcatcggcacctagccgatcggctatcatttatagatttaaccgcggtttctttgcttctatttcttgttgattacaggatcaaatcaactagcatgctagcatacccgaaggcgagctttggacctgcactggagttaagcagatctcccaggcctcgtgttttctgtcaacagctgcgcgccttcgtcgacgcccgcaaccgcgagtagttcctgccgagcaaccggtctttccacaatctcggtacgtgttcaatatgttgcgcatatttgatctgttcatgttatactgtgtagtttacatatatagatctaatgatgcgttcatgctagtttacatctgcaatgtcatgatttgtttatggaataaattaaatcattatgtgcttataatttcaacaatccaaaaaccttattataggccctgtggttttactatggctggttttgccgatgcactgaggccagataaattcaccggtgtgcactttaagagatggcagatcagggtcactctatggctgacagctatgaaatgcttctgggtgagtactggcaaacctgtgggagttcttactgctgaccaggagaaagaattcgatgaggccactactctctttgtgggatgcattcttagcgttcttggcgatcgtctggtcaaggtgtatatgcatatgaccgacgctaaggagttgtgggatgcactgaatactaaattcggtgctactaatgctagcaatgatctgtacatcatggagcagtttcatgactacaggatagctgacaatcgttctgtagttgagcaggctcatgagatacaaaccatggctaaggaactcgaactccttaagtgtgtcttacccaacaaatttgtggccggctgcattattccgaaactacctccatcttggagaggtttcggtactgcactcaaacacaagagacaggaatactccgttgaggggttgatagctctcttgatgtagaggaaaaagctcaggaaaaggacgccgcgtctaagggcgatggtgggcagtccagtgccaatgttgtgctcaaggcctagaacaagagcaaggggaaatacaaagctccacagaccaccaacttcaagaaacagaagaataacaacaaccatcttaacctggatgagaggacttgctttgtgtgtggcttgactggtcatctggccaagaagtgtccacaacgcaaggggatgaaggcacctacctgcagggcagactttcaagtctgaaaatgtgactattggcaacactggagatggaagcgggtatgctaatttacctactattttttcagttaatcagtctactaactagtgggttgatactagagccaatgtacatgtttgtgctgacatctcattgttttcttcttatcaggtcgcacggggttccaccatcctaatggggaatggggtttcaccgttcatggtgttggcacggtagatctgaagtttacttcgggaaagatcgtgcagcatgtccctactatcaataggaatcttgttagtggctcccgtctgactagggacggatttaagttggtttttgagtctaataaagtagtcgtgtctaaacatgaatattttattggtaaaggttatgagtgcggaggcctattccgcttttccctttctgatttctgcaataagtctgtgaaccatatttgtggcagtgtggatgatgaggctaatgtttggcactcacgtttatgtcatattaattttggcttgatgtctcggctatccagcatgtgtttaattcctaagttttccattgtcaaaggttctaagtgccatagttgtgtgcaatcgaagcaacctcgcaagcctcacaagactgccgaggagagaaacttggtacctctagaacccctacattcagatctttgtgaaatgaatggggtgttgacgaagggtgaaaagcaatatttcatgacgttgattgatgatgctactagattttgctatgtgtacttaggtaaaaagataaaaagacttaggtctgatcgtgttggagagtttttctcaaacgagtttgacttattctgtaaggaacatggtatcatacatgagaggatgcctccctattctcccaagtctaatgggattgctgaaaggatgaaccgcacactgactgacttagtgaatgccatgttggacaccgcagggctacctaaggcatggtgggggaggcattgtttacctcgaatcatgcgttaaacagagttcctaacagaaataaggacaaaacaccatacgagatatggattgggaaaaaaccatgactttcttacttgcgcacatgggagtgcttggcgaaagtcaatgtaccaataacgaagaagcgcaaacttggacctaagactgtggcatgtgtctttctgggatatgctcatcatagcattgctcatagattttctatagttaaatctgaggtacctgacatgcatgttggtacaattatggagtctcatgatgctaccttctttgagagctgtttcccaataaaggatacacatagtagttttagccaaccctctgaaataattcccagtttaatcacaccgccagaacaaaactgaacatacacatgaacatgtcactgaggaggatgacagtgaagctcctcgaaggagtaagagacaaaggacggctaagtcttttggtgatgatttcactgtgtacctcgtggatgacactcctaagtcaatttcggaagcatatgcatctcctgatgcaaactactggaaggaggttgtccgtggtgaaatggattccattatcgctaatgggacttaggaggtgacagagcgaccctatgggtgtaaacctgtggggtgcaagtgggtgttcaagaagaagcttaggcctgacggtactattgaaaagtacaaggctaggcttgttgctaagggctacactcagaaagaaggcaaagatttctttgacacttactcacatgttgctagattgaccacaattcgtgtgctactttccctagcagcctcacatggtcttctcgttcatcaaatggacgttaagacaacttttcttaatggagagctggatgaggagatctatatggatcaacctgatgggtttgtagttgaaggtcaagaaggcaaagtgtaaaaattgttgaagtctttgtatggtctaaaacaagctcctaagcaatggcatgagaaatttgacaaaacattgacatctgcaggctttacagtcaatgaggcagataaatgtgtgtactatcgccatggtgggggtgagggagttattctgtgattgtatgttaacgacataatgatatttgggacaaaccttgaggtgagaaatgaggttaaatcattcttgtctcaaaattttgatatgaaggatttgggagtagctgatgttatcttaaacattaatctgattagaggtgagaatgggattacactcttgcagtcccattatgtggagaagattttgaatcgctttggctacattgatagtaagccttctccaacaccttatgatcctagcttgttgcttcgcaagaacaaaagaattgttaggaatcaactggaatactccgaaatcattggctcgctgatgtacctggctagtgcaactaggcctgatatctcctttgctgtgagcaagttgagccggtttacctctaatccgggagatgatcactggcgtgcgcttgagcgagtaatgcgctatctgaaaggtactatggaattggggcttcactatactgggtatcctgcggtactggagggttatagtgattttaactggatctctgatatggatgagatcaaagccactagtggatatgttttcgcactgggtggtggtgctgtttcgtggaggtcttgcaaacagaccattttgacaaggtcaaccatggaagcagaactgacggcacttgatactgctactgttgaggcagaatggctgcatgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctattaggaaattgagaaacttcgaagttataacgttggattacatccaaacagctagaaacctggcagatcccttcacgaagagactatcacgaaatgtgatagataatgcatcgaaggagatgggtttgagacccatgtgagttatactatggtggtaacctagtctatgtgatcggagatcccgtgaattagaacctgggaagaacaaaccattagtaaactagaggagagtaccaatctataccatctccaagtgaagatacatgtactctcatgagctgcaaggcaggttggctatgccttaataagttctgttggctttaattagcgaagatgctgtcctgcagagcattcttgaaagaactcacctttgtaagcttgactgttggtcgcagtctatggagattttgggtgaatcttgtaggaagcttactaaagacctaggagtatgacttatacgctccacccgaggggtagtctacagacggtctagtatcagataagactctaagtgaaacttgcttgcacaagacttgcaattcaaggcgtagtccattgttcaagttgtgagtaagtgtagcttggagttctagatggatgttcaaccttaatcggtctccatgttcaaccttgcgtccagagaaggttgctgatttcggaagacaacattgtatgccggttgttctaaagagaccagaagaaaaggaggtagaaaattgcatggtgctttgaggggagtcgtgggtgaggctgcagcatggaaatattttgaacattggatagacccagatcaattccaaccctttccaagaagctcctagcgaacgaacatgttacactaccacagaaaacctcattggtgccgtttggaaaaccccctaggtccctggaaggcggcattgatgtagaggggaaataggtgcctgtttagaactgacacctttgaggtttcacaaataaaaaaaaagtcagctcgagcagctccccttcacccctccatcccgaccaatccaagaacacatgaagaatattcaagatcaccagaacccaagaacacaaggaacacaaaaacactaagaatggccagccgacgtcggggagggcgccgcccgctgttgccgcctcccttcctgcagccgcccaccactgccgccacccttcctgccgttgccatcacctcccctcccaccggatttggtggaggggtgggcgccgcctgccgctgtcgccaccgcctactgccaccgcacgtcgccgccgccgcttccctcccacctgttgatgagaaacacggtggactaggagatttgcttcactctagtgaaggtcctaggcttgcctcgagtgtcaagagcgtgccagctagtttgatcttgcaaccagcaagaaagacaacaatcgtaattagatgaacgatagtcaatcgggtgacagagccgatgacgtatcgtcaggacccgtcacatgtaataaaatcattttctatatgccttagaacacaattttcttttttcaattttatcaaaattatccaactgaatgttgtggtttgtcagatgcaaattatattactagtgacaattttctgaattacctgaactttgcatattaacatagtatactgattgtccccccatgcttaatcacagtaaaacaaaaccaactctatgatactacctttggtttttaatatatgatgccgttgacttttcgacaaaagtttgactatttatcttattcaaattttagtgcaaataccacctcatgggatgggatgaatggggagtttagtaccaccttacttattctaggagatggggacctccttaaaagggaggatgccctcctagccacttgaagcatgtgtgatggagagaagagggggaacacgcgcgcgctcgctcgcctcgcctcgtagggcagggcagggcaggtgcgcgtgcacgacgtacgcgtcgaatggttcggttacgtggagtggagatcgtgcgggcgcgctgatcaagcgactattgacggtccttaaatcataatatctgacagtgttggtgaaatatgtgtatgcaggtaatttgaggagaaaacacatccgtcatgcgacaaaatgcacctccacgcattcaggacacgtttacatggattggaggccccataactcaagtaaacacctccaaatggtcccatctaccatgccaatgggctgagggcctcaaaattagtgtccacgacgaaaaacgggctgaatggagtcctcccgggttcggccgaaccatttcagaggtcgttgatcccgagattcgacgtagatggccctgattacatcctgatggtggttgcggggtagttgggtcatttcccatagcaacaaccatcatttggagcctatataaggaggagttcactctaatttccaacacacaactttgagctgaattacaagaggctctattgtatcttttgtacattagaataaggttgacagtgagggaaagctctggaggagtgcccggaagtttggtgctcatccaacttctacctcgacgagtgtagcttcctaggaggaattcgggagaagtaccggagctgtcggtacaccctgctctgggttcggagaacttcttctataaagtaagcattcgtgttcctttgttttgttatttaattactttttgtctaagtaagatagatttccatctttgcgggttcattgtttagttgtcgtactaagtgccctagtactgggactccgggtagaaaaggaagttcctacgcaagtattagagtagtaattaataacttagacgtggtgtctaggttagagattacctttgtttgttgtgtatcccatagatttgtcataggtagacgacaggtggtgacagccctgaatcctgtcctagcaatcctccacattcggatacatcatagagctatagccggaaccacgcttgcagattagcaggggtcggtgcccgaagcaacagataggaatttacctttaacttagcttagataattaaaatgcatagaaagtcctctctaacctgcctagcctacttatagttgttttccttggatcgtcttagccttagatagattacacacgttccctgagttcaatatccttttagggtcacccgaaggtgactgtgctacagtggtattccgtgcgcttgcggatttatctgtggtcgtaagaaataccaacaagcatttctggcgccgttgccggggaacggttgctaatttatctgagtctaggtcatcctcgtatctttatttttatttcttcttcttttattcctttctttgatggagcaacccacaattcaaaatctctctgctcctcgggctgatctatgtgagccatcgtgttattcaaaactaatcctttcggatggctaaaaaatcggtcctggctttatagccatgattcgagagcaaaccttctctggtggtattagtgaaaacccatacctccatcttcgggactttgagctagtgtgttcatgcctatccatcgtaggcatgacacatgaaactctaaagtggaagttgtttcctttttctcttagagatgaagcgaagcaatggtacactatgtctgtcaagaaattccacggtgaatgggaggagcttaagagcaatttctaccttactttctttccattaacccatgtaatcaatcttcgattagacattctttctttccgacagaacgagaaggaatctctcggtgtagcttgggccaggttctcacagttaacttagtctggtctagacttgtctttacccgaccatgtgttgttacaacattttcggtatggattagacaaggggtctgccgcaaatctcgatatttctgccggaggatcattcgcacacaagacaactgccgaaggaagagaactcttagatttgatcttagagaatgattatcccggatgtcgagattatccatgaggaacctttgcatgtggagtcgaaacccgactcaactgtcgaatcctcattccagtcgttggagccggaggaagaagaaattcatcctccggaaattccattccaattcagggatgatctttatgaagattatgagaacaccttgaattattccagcaaaatcaaggctcatcccaagcatgagccattcgaggaggtgatgtttgtatcttcgttcatttcttctgaacctattgaccatcttcatgaaactgaacgaccctcatcaccctcgatcaagtctaagccttgtccctctggccctcataacgttgttcttgtttatcatcatgaaacaacccgattcttgcatgatgtatctcttgagaaggaaagccttcaggccacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 42990 - DNA, 725 bp, Oryza sativa
  unsure (1)..(725): unsure at all n locations
aggcgacgtcggagcggatcgagaaggcggtgagggagtccgccgtgctcaacgacctcaagaacgacccgcgcacgtccgacgcgctcaaggactgcgaggagctgctcgactacgccatcgacgacctcaagacgacgttcgacaagctcggcgggttccannnnnnnnnnnnnnnnnnnnnnnnggacgacgtcaagacgtggctcagctcggcgctgacgtaccaggagacgtgcctcgacgggttcgagaactctacgtcgacggaggcgtcggagaagatgcgcaaggcgctcaagagctcgcaggagctgacggagaacatcctcgccatcgtggaccagttcgccgacacgctggcgaacctggacatcaccggattcagccgccggctgctcggcgacgacggcgtgcccgtgtggatgtccaacgcgaagcgccggctgctggaggcgaccccgggctccaaggagttcaagccggacgtgacggtggcggcggacggcagcggcgacttcaagaccatcaatgaggcgctggccaaggtgccggtcaagagcacggggacgtacgtgatgtacgtgaaggccgggacgtacaaggagtacgtgtcggtggcgcgcaacgtgacgaacctggtgatgatcggcgacggcgccaccaagaccatcatcacggggaacaagagcttcatgctcaacatcaccaccaaggacacggcc

SEQ ID NO: 42991 - DNA, 36679 bp, Oryza sativa
  unsure (1)..(36679): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcatctttttcaaacaacgtggaacttgctggctaaaaatttcttctccggacgcaccagcttgtttaggttgtggttgtgcctcaccggtttgacaggaccatgttcacgcatgccgcagtgtgattttccttttccaattacacagaatgaagcatacgcttgcacactgtatctgcgtatatgtatcccacatacagctgaaaatatgttttctaaccaacgtgcaaagagacagaattcatagcaaatccctgaccttagtaacagagggaaaaaaataaggatggatacttactgtgaatgtactatatgagctcgttttactgtgtcattcggaaagcaacgaaaattgttaacaagagaattgatctctgactaaaatttgtcacccgcgactgcttttgcctgttttacagagccattttggcttaacgtcaattcttgctttaccaattattttgtatcattgaatagcactttgtagccattaagattgaaaccagccttagtaaaatctattgcattgaggtataatctactttatcaatattttagtggtatcaaaaatttgtctatgatttagcattactaacattttagtagagcttcaaatcaaaatggtctgcaatgtccagcacttctcaaatttataatggtgtaaattgttttctatcgtctatgccatattagtggaagcagccaaagtagggatcagctaacagagaaaaacaaggtcgcaacggttctttgaatcaaatgctatatttttcacaattattactctgcttctatccaaacaagtcgatttcgaaaacgaaagaaatcaaccatgttgttccactttaccatcagaatatcacttgttgcttttggacttttgctagcttcccttttggccttttatcccgtgagctctcttacctttacggtttgttcataccgcggatagcgagcatccgacctggattcaattagccacgtcaagccagtaatatccgttcgtttcacgggcgcaaatctttgcaggatatttgatgcgatgcctatcacgacagtaatagcggcgtctgcttgcggctcggccaaaatggattagatttcgatttctctgccctgtaaaagtgtagaatagtagtgcgacttccaccatagcctctcaaagttcagtcaacaccaaacaccttgcaaagccgccgcaagtgatgtcgatttttcagatttgatactacttagatactacaaatctaatgaagaaaaacacacagttcacttcgaacagatgcagatcctgttactagcgcagcaagtttagcacaagcactaccgaagagcagactttccattcaacgtcaagaaggaactaatcatcaatttcatgaaaaaagaaaacatgcagaaaaaaattcgagcagaggcagttcctgtaaaacctcttgtcatttacttgcgcaactacatcacatcgctgatcataagtggtcagctatctcaaccaatcgagaacattatcactgatgagtgagtgattcagtgtcagctacaaatagaaaaacataaagaaagccgagacaagacacgttgacactgtctttctttagaacgacgcagcagaagataatcccatatatgccgttagtgcgcgtcctttcccactaatcaactcacaaatctgcattttagatcgcttgctcgatgcaggctaggaacggcacgcacgcacgcacgcacggcctcgtcacatcagctcccctgttccccctcgtcaaaaagctcgcctactcacttgcctcattgcctgccaagtaataaacgaggagtctagcttaatcgagaaaaagtaattaggtacgcgatcgaggctgctggtaacatgcaagccagatttctacacacgcatcgctttcgcttgttaggtaaagctccgagatgagtatccaaagtgccccataagcatcccattagccaattaaggtcaagaactgttactagtaactctcgttgggggtgggggctactcgccatcgctgatgaatttgtgtggtgatgctaaccttggatcgtgcgggtggtgggtggccacttccgtttttccaaatttccagtggcgtcaccacgttcgcgatatcgaggaagaaaaatatatgcattatgttcgtcgtctctgcgtcgctcgcaccaacctccactttctctgaagatcgttgcgccggaggtctggatcgagcagcactgcgacagagcaagacatggacacatggttgatgattggtgtcgcggcgtttgtcaccacagaagaaatccttctttttttccattagctcggtgaaaatgttgggccagtttggtttgctgtcctaccaaaatcttggtagtatcaaagtttaggcaacttttggcactatcaaatttgggtggataaattttgtactatctaagaactggtgttggtaaaatttggcaccaatccaaacatatagaagcactattcaaaattaccaatgaattggtagggcataatttggcaccaaaccaaacaagcccgttgtcgtgcgtgcatttgcgcgcgcgtgtggttgagagagaggtcggttgctagatgggcacagtctgtttcgtgttgctgaatgctgtaattaggtcggttttgtctgcatcggttttagcctgtagcagttaaattggccgtcagttcaggctttcagttcagcattttgttgacaatatggcggttgataggtcagatggtcggttgacgtcggtgtaagcagcgaacagagtaccagacacgtgaaatctctgcacgcccggtggatgtgtgtttagccttttccttcgtagcactagtagtactagctagaggccggaagtatgtggacttacatggtggctgtattatttttggcacgttgcatagcattgccattgttaaaccatataacaatattgtgaatggataaaatctgttcacaccatatacttcctccacttataaattatttggtgcttagaacaaggattgaagaaactttttaaaactataacaattcactatatataagattaactttataaattttaataaacttatgatactatgatagtattttacaagcgaatcttacctatattgttccttttgtttttaaattaagtaactgagaaaatattgatggttaactttttaaaaagcttaaacaagtatagtcttaaacataaaatatttatggccggaaggagtagcctatttaagaggaagaaatttaacacgaaattagtttaacccaccaattatgctgttaatggattttgtcttgtcttttttaaagaaaacaaaaaaaaactgtcaggtttctctttccactctccataaattttggattgattcatttttttttctgtacgctacacatgtacactcacgaacgagtgtgctctcccattaacataagctcagaaagatgaaaaacaatgcacaatctttgatatcactaacattcttttaatatcacacttcatattttctccattttgtttttcttaagaaaattataatttttttttcataaatggatgctctaattttcagattgccatcatatttgcctagttgctttcatattattggattcaagtgagaataaaaaaaaacactaggctcttagggcacctctaattttgctgcgagacatgcgatgagttcgattcatgcaagcaaaacacaatttcggctcaatctctgcatcatagtgatcgatttgtgagattcacgcacgtaaagaaaataacggtccccctacgtctgcctcccgctgcagcacaaccggatggagaatatttatattggcttgtgttcaacttcatttttgaagttgatttttcactggcagtctggcacacatcattcgactcttacggtgtgctctgtttgatcttcttttcttttttgcaaatgcttgattggcctcacattggatctgctcttagaattaaggaatcagtcccgttaaaggctgaaaaattatccaaaatgccgtttatgtgctttcggtataattcatcaatgataaaatcagcgaactcagactatgggtgggcttcggtttcttcggttttctaaaaattcggttctcaacaaaaccaagcggaattgtttgtaacaaaaacataaactgagccaaattaacataacttactcggttcggtttgtcagtttattgagtaagctgaaaaaatgtactccctccatcctaaaatataacaacctaataccggatgggacgtatcctagtactacgagtagatagggggcatgttcaaaatttatagtattagaatacatttcatccggtattaggttgttattttgtattacggagggagtgcgtacttgttctaccatgccgtaggctgaagtcctgcaagtagcgtagcaacatattgggccacgttggtagtcagatgggctgcataggctatgggctgtaggggttagtgagagatggatggtattaatggattttttttccattggtcaaaggcctggacattgtgtttttcacgtaggggaatgggatcatagaaattgatcggtttgtacgaattttttggttgttagagaagagaaaccgatggaaaagccaaagaccgatatataggaaaaataaaaggttttcggtgattttatgtccaccccttcctcagacacccccccaaccccaccgaaggaggaaccgactaccgatatttcggttcgattcggcctttggtttttcctcgttaggctaggggcgaagctagaacgaaatgagggagggtgcctcttacttaatttactttactttaaatcaagtttaagttgatgcgggtgtctaagtttacaataagagaggtgtacacatgataaaaatatgtgaagtatagcttaaaaaaatttctggaacccctccatactctacctccgcccctgcgtcaggccgaaataggtccaatctgagcctcaactcctattcggcccttgtgtccacacagatccagacatgtcacagtgattaaaaggcccatggtgatggcccagtagccgttatcacaacaatccttcccggcttcccgtaccgtcacggatgtcattgctaacctcgatcaccccgtgtctaattcaatttcaagcgaaattacccgtcctcttttactatcaaacaaacgaatccgtatgtataaaaaccagctaatagtctaatacaacctgcagtacgtgtagacgacgaccttatacgtatcatagaattaatactaccgtacgtatcatagaattaatactaccgtatacatggccacggtgtagctagggcgcgcgtgctgctgccgctgccactattcctggtccatttgcatcagcgggggcacaggcggacgcatggcggcggggtggtgctcgccgctgtacgtggccgacctctccatgttgatggctgccatctgcacgcccagcgggctcgcgccgctcagcgccgccacggcgtcgatcttgggcgggcacgacatgctccgcgagtgcgccgtggcggtggaggcctcccgcggaagcggcaccagcacggcgcgcccgtcctcgttgcgggcgccgtggaacacgaaccggtcgtcctccacgtcgtagaagttggccgtccgcacctcctgcgccagcgcgcagctccagcagaagagccacttggcgcagtcgctcaccgccgcgcggcacgcgtgcccctgtccgccggcgccgcactcgcacccgcacccgcagccggaggccgggagcttgtaccgcttccgcatctgcgtccgccagaagccgccgtagaggaagccgcagaggcccaggagcacgcccacggagacgacggtgtcgcggatgtcgtcgtcgtggacgttgagcgccgtcacgctgaagatgaggaacggcgcgacgcagagcaggatgaaggtgaaggcgtgcacgtacatgtttccgaacccgagccgctccatgttccacccgaacacgcagaacgtgcacgtcgccgacagcgcgcacaccgtcccgtcgtcgcagcagtcgaacagcccgccgctccactccgggctgctcaccaccacgcgccggttgtatatcttgatctccacctcacggtcgttctccgccggccggtttccgccgccggcctgcgccgccgctgactcctcgtcggaatcctcgtgctgcttccgtcccagcgggccgtacgccgcgtagaggccggcgatgacggggcagccggtgccaaggccgtagccgatgttgagagcccagtccggccgttccttgcgcgcgtagctccagaagagagcgcagcagaagtactgcgccaagcaggtggcgtgaagcagcaccaccacgacgagcatgtgcgcgcggtcgtgcggccgcggcgcgccgtccttgcagtacaccttgcggatctcctcgcggtcggcgccggcgccggggcgccaccggaggagcagcacgaggtggtggaagatcttggggtgctggtacaggcacatgatggtgaagagcgcgttgaggatctggttgatcacctccgtccacttcttccgctgctcgtcgtcggggatggcggagtcgagcatgccggtcatgagcatgaacagcatcagcagcccggcggcgacgaacgccagccagatgatcatggcgaagttctcgggcttcctgcaccagctcaccgcgtagctccacagcttcccccacttgatcttcctcacgaacggcacgcggaaccgcctccgcggccgccggcgaccgccgccggagtccacctcctcgtcatcccccgacgccgcctggccctggccccggtggcggaggcggccgacgaaggttgaccggaggaaccagtccctggacgggtgggcgcggaggaagtccaagaaccgccgcttgcgcacgctccggctcagcgcgcccgtctccaccgtcgggatgtagatgggtatgaagtccatcagccgcattgtcgacgacggcgcgccgggctcgccggcgacctcgacgatctcatgcccctcgccgccgtccgggaccatatctgctcccggctcttgttccagacagcagcgcgcgcttggagacttcagaacagcatgtggtttgcgcgcgctaagaactagcgcctgcaactgcaaagagtttggatacgtggcagtttcttcgggtcagtagagaagtcagaagagtgcaaaaaatgtcaacacagtgcagcacaaccagaatgaccaaatctgtgctcgtctattctgactgaccattgctttgacggacttttgaaacaggattaattaatactcccttcgtctctaaaattttacgtcgttaacttttttttaaaatatatttaactgttcgtcttatttaaaaaatttaagtaatttttatttttttctatcatttgattcattgttaaagtatttatatatacatatagttttacatatttcacaaaagtttttaataagacgaacaacaaacatattttaaaaaattaatagtgttaaatatttagaggtggagggagtactactcgtacttacgtctgccacaaggtcaaacatggttgacctacttgtttaatggctaggtgtaataaatttgattatctaaaaggagtagtaattctatgaccagaaaggcacaaattctctcttttttacttagggcttctttgattgattggaaaaatggaggggaaaaaagtaagaacaggaatcctataggaactagtacagttcaaccattaaaaactcataggaaagacatagaaatatttcttgtgaccatgatttaaatagaattctaagaaaattaacatccaccttaaacttattttttttactatgcgtacgatagaaacgaagcacgattggaagatatgttttactttttcttgaccctagattgtatggattaaaaccatctggtggtcctttggaacgaagggttttcacatgatttttgtgggattaatgatcctttggatctgccactgttcacgtagaaggaattgctcaaacgaattatggagggatattatagcattaccatgaaaacgcatgaattcaccgcaacctctagctagcataggatagaagctaaatcatatgttcaagacaaccctctgttccaaacaaccagccctataaaattcctttgtttccatgttgatcctatcatagtcctacatttcctctattgatgtgtgtgtttttatcctgtatttcgaattagccctcaaaattttatttactgttgatttaatacttaacattcccatgttttttctatacaccatcaaataatcattcatatagtttcctgcgtttctttaataatatgttttgcatacgcgtgtctattcatatatctttattttaacatgttttctattcaggcatttctccagtaaggtgtttcaaatattagtttatagtgtctaggtatttcatccagagctattgataactcttatgttattctttccgagtattatgcacaaatatatttgttaaatgtaacatctaggcttgtattggtcttgcaaaatattttgctctaaaatatggggttcattaaaataaattataatagagtgaattgtaaaatttggagttctgtatcttggatgctaaacaaaccgagttttgttttttaagttcactctaagacaaatatcgagaggaaccaaaagttgatcgcacaaaactatgtggtgagatagttaagccataggtgcatgacttcacttaatagggtttaaattctggtgtttctgaatattaccacacgttggtgtattttcaaataaaatttatcgttggtccatgttttttttaacgtaatgggcgcatacgcggttttgtgcgtgtaatccatgtaattggaagagaagaagttgaccccactgattgctccaatgtattgaagagggttgtgcggtttgtctgtgatcgtgagataaccagatgtttcatctgcaacacctttgtggaatgtggatgcaaggaccatgactagaaatcattgtgggtcaatctagaaacggatatgatgcaaaacgattctcgattgctgagatggtagtggtactgtgttgggtgcacctcagtaaattggattttatttctgcataggaccacggcgaaacatactacgtggaaaccgggcagatcacagtgcgtagtggcagtaatgttctgaacaatacgctactgctacaggaaacataggagcctctagtttactcgactcatcaagaattcaagattcaagaggcatccaaggcatgttcttttggttatgattccaaaaaagagaaaaaaaaaactctgaagagtctgaaccatctagaagaaagcacaaagactactactaccaactagtaaaagctaaacacaacttggtttgggttgtcagccatgttacttgtagcaaatgtcaccatatgcaaggatttttccctcctgtggtgggcggctgaatttacaagtactggtactttgtttaacaaacattgggcgtcactatcaacatggtgctgagccaacgatgtgtaggactccaaacaaaatgtagcgagaaaagaacgtcaaaggaaaagaggaaagctgaacccaacagcggaagcactcagcacggctccacggaatgccaagaaaaatctaacactgctaagtgctaacggggtcgctgttccaaacaggtttcgtttggaaacagttacgatcagatttcagttaccaaatcaaaatgacggttttatctactaaaagatagtagcagtagtacagtggttgcaaaatcaaaccaccgccgtgcctaggcctcgcgtactactgaaagcgctgcttctgttcaggcgatgatcggtttgatgatcaatcgcaagaacaaatggggacgattaacattgccgttagaaaaaaaagagtagaaatggagaaaaggctagcatgcagaaaatcgtaacaagaacagagtaaccaatccatgagatacaaaggttgagagcgaattcgagaactaaaggagatatgaataagatagaacaaattgcagagcgcatagtatagcagtatagcacgtacctgagctccacgccgacccatctcctccaaagctgcatctccatgaccagcctgaagaattccactggtatgcaagttcttccttcttttccctccaagaatccaactgtccaaggcctccacacctctactgcctcttgatctttgcctagctacctcacaagagcaggcaagcggttgaagaggttgtggatgctggaagggaacagatgggtgtgggcacggttaaattccctggttttccgaggttatttcgatttattgaccaaaaggagtcttctttttttcgtgttcagaggggaagctgggactgggaggagaagaggacgctgctcgtcaggaagtcagagaaggcgggtggggtagattttagacaagagcaatcaggtttggggctttgaggctttgagcatcggtcgcggaacggccttgatttttccagggtcatcgatcgaacggtccgaggacgattggatcaggtcgtcaagcgcgagatggcgatacctgataagaatggactgtagtccctacctgatagacgccatgagatgatgagaaactccaaagtttgctgcgagagggtgaaaccgaggtgcgatatagtgatgcacgggcgacgggaaactattctattctaaaccccgagggtagggatgaaaacgatacggaaacgaaacggacagaaaccatctttattattttcgttttcatatttattttttcagaatcgaaaaccccggacacgaaaacagaatcaaatattatcgaaattaaaaacggagcgaaaatgaaccggtgcgaatacagtaacgaaaatttatcggaataaataaaaccccttaaactaagctttacactgtaaagtcaaatccttaagtgtcaacagtgaataatttatcataaaacacagttatatcatgcccagttattaaaacttaatagtacatcacaaaacaaaatctataaaataaatgatccgtgtttaagagataaatacttttgataaataaatacagccaaacaccatggaggcaaaaacggcgagaggtggtggggatggcacgagatggcagcccggcggagacacggcaacgtgagatctggatgcgccgctccgccacccaactcgcagagtcgtggtctctctcgtcctctaagtgtacatatatctctcttctctctaagtctctagggttagggtagtctggtaggtaccacgaattcggttgggctggagaagaaatatggactattgtattctattggcctttgtaattttggaaattccaacaaactattcggaaagtttctgatcgtttccgagctccaacggaaactgctattatcatattcaattccgttttcgagaaaatattttcgaattcgattccgttttcgagaaattccgactagctgattctgtttccgaaaacaggctcggaatccggaattgtttccgtaccctttttatccctactatgatagatatcacttattgtttgcatgtcactcaaatagttttgaatatttttttttaaaaaaaaacttgagaagtgcataatgtgatatactccaaaaacatgtaacttaaaattcaacttctacatgttacaagaatcataccttaactatcgttaagacatgtataaattgaattctaagttacatgtttgtggagtgatatatcacatgttaatatatctttttaatcttttaaaaaatttataactatttagatgtaataaaataacgagggaacagcaaagcaaatcagcgggtctcaccgcggctgccattatcaagcagagcggtgggccgccgaaagttgaaatgccgatcaggcaatttgatggccatatatatgcccactgccttgagctcgtagttgctgaggcagtggcttgcaccagcatggaagcacgtagtacagcgtgagctccgggggtatcgcgtggccagcgaaaacgacgcgcgggcgcgcgccggttgcagcacacggcacgcgggctcgcttcgttacaaccacgtcacaatccgatccgaccattttttttcatatatcgatcgtggctgtccggttcaccgttcacacctcctcgcttcatcagagttcagataaccggcccatttgtcgatgtcacacgatgtaaattaaaattaaccagctgttgttttgttgttgttgttgttgcgtgttctacatcaacggtacggacaggcagaaatgactccaaacattgacgcgtagatcatcttgtttttctcgttctaatgatatataggaaacatattatatgacatcacagaaccgaacaaggggagattgggagaatgatactgttgatacctttactgtatctcgtacactgaaagagtgcacgaaacatgccctggtcttcctttcgaccaaaggccaacccaacagagcctcaagtcatggcacggaaaaaggaccaaagaagttggaattttttaaatttttaatatttacataaatattatatcggtgaaaaaatttataaaaattgaccctggcgccccagtggaaccagatgtatcatgtttaaattctactactatttctttacatgacataattctccttgtttctgtgtatataatgtttctatgaccaagactacgatagaccaatatcaatttcgtacactaatacgacgaaaaagttacaacataaactcttacttaaaatatgaaattgcaaaacaaccaacttcaatacaatttttaaaatattattaacaagttttaccaataaataattttttaagtgttatcaacagagcttcaatacaattttgctagtattttttttatctcggccccttgccgcccacagatgaaaaaaaaactagccaaatactttttttggcactgaataattgcatttcactccttgcaacaccagtagtctaccacgttagcttgccgcccaagtgaagggcggaagggtctatttttgtaaatatttttgttgatataatatttctgtaaatattttttaaaaaattaaaaatgaaaaaaaaagaagaccacaaagcaatagcactactagtctactactggtgttgtgaaatcaaacagtagctttgccttctatgggggacggaccgggtctttttctcttccttctttcaactgttttttttttctttgtcgtcacactcagttgatcaatgatcgttcactatagtgatgaaaatagttgaaaaaggtctcaaccattttaataatcgtattttataaaaaaacaaaatcaaatatggtaaagtcagaagcgaaaacgatattagaaatatcggaaaactggaaacataccatacagacggaaacatatcggtattgatcggaagccaataataaatatcaaaaatattgaactgtaaaatcgtatatttaacttttcactatataatatgatgaaataaattcaaagttacgttaagttataatttgtctcttttaaccttacccaaagttagagatttagctgagaagttgatagatctctaaactatggatcaaataaagaaatagactataaatattaattaccataatataaaaaacaattattgccataagaatgtggtaaaagtcgagaacagtcggtatgaaaagaaaattccaatttcatattttttaccatttcccttctcgtttctatcggcaaccattttcacgttgctcggttggtaaaaatggaaacgaagcgtcggtcaatcgaaacttttcgtgacaatattcagttattcacccctactcactagcacgtgaatataacatggctgtgcaacaactcgaaagatggatgggcgggtggctattgctactccatcaatttcacaatgtaagtcattctaacatttctcatatttatattgatgttaatgaatccagatagatatatatgtctagattcatgaacatcaatatgaatgtgggaaatgctaaaatgacttacaatctgaaacgaaggaagtacttgctaagggtactgatcgccgctgctctcaaacccgtcgaactgagctgcccggcccgcggctagtgcacagtccacccatggtttggttccattatttggacgacacaatggggagtgacctttagtcctttacaccattatgcttcggaaaaagtccacttagactcccttaattatttaccggatctaattcgtgacccttaactagaaaaccgggtaagacgactccccgaattagtgaaaccagtgcaatttgacttctccggcggtattggagggtggttttgctgacgtggcgctgatgtggtggtgctaacccggtcttcatgccacgtggcgcttacgtggcattagagttaaaaaatatatatatgggactcatatgtcattcaacacaaaattattgtgggacccactgacacgtggggcccacatgtcatccttcatcatttcttcctcctccctctctctcccttctctttttttctccccattctctctttcccttccagatcagcggtggaggcggccaggggccagagtggcgacggcggcgcgcggacgagggctagagcggtgacggcggcgtgcaggcgacgaccgtgccaccgcctgccccgtctccaagccggcccgccgccgctcccactccaccccctctaatgcggcgcccggtccgacccgtgcagccgacgacgtgggcggggcgttcgggatgggcgcagttaggggctccctcttccactttctcaagggcacctacaactcccccaacagcgagtgcttcgttggcggcgcgcaggccgtgcggatgaacgcggcgggtgggtgacagctttgcggtgtggggcgacctcttctccgccttcaactgcaccatggttttcatgcactagaaggaggatctgtggaactctatcatcgccggcgccgccactagcggcttcctctccatgcaccatcgagggcgccgggcttatgcttaaccgcgtcctcgcctctccccgtcgatgaccccaacctcgccgccgccatggccccccggccgtgtcacgccctgaagttcccctccttgctttaaaatttgttaaataaatcgtccgaagaaattgtttaaattaacctagagatgaatccctaaattaataaatgcaactaataatcagaatcggcatgtggaatttttcttggattctacatgtcaaaatatgctaacaggatttagtggaatttttcagagctcaataaataattttaaccaattaaaaacattaaaccacaataaataatccctggaaaatccttttttttttcttttctcttctttttcttcctttttcctctctttttcctcttgttgggccgtcggcccacttcctcccgcgcccttcctccttcctgggccggcccaatccctccctcctctctccgggtcaccgacaggtggggcccacctgtcggccccttcttccacctccagccggcggtggcaaccgccgccgaaaccgccacgccaccgccgctttccccgctcctcccgcgcccactccgcgccccacgcccctccccacgtcgccacccacgtcccgccgtttcccgccctcgcgcgcacccgagaaggggcaggattcgattcgaatcctctccccactctctctccccacctccctcacgtcggcgagaaatccggccgcctcccggcctcgtccgcccctcccgagcccatataaaccatccccgcattctcctcctccttttttctttttccatcggccgctcccgagctctccaccgcgcccgcaccgtgcgcccactcgccaccgccgtctccaccgtttcggccgcctctagcagccgctagggccgccgccgcaccacgccgccgccgtcgtcgggctcgcgcggccgaggtccgccttgtccacccctcgtccgtcgcaatccgtcgccagagatcgctgtccacctcacgccggtgagcaccactaccgccaccttcggccatggtttccgcccgccgtgtaccacctctctccctctaatccctcccatcttgttccctaggaggtctcggagctcgtccgcccatcgtcgccgttccccggtcgctcgccgtcgccgttcgccgtcgtcttcccccacgccggccaactcgcggtgaggcactcctcccctcttttccccttcctctccctcctagcgccgagccgggccgagccgccgcttcggccgtgcaccgtcgccttcggccgccgccgccgcctcctgcgccgccggttgccatcgccggcgaccgcatgctgccgccactagccatggctagccggccggctttggagccgagccgcgcccggcggccgcttctcccgccaccgcccgatcggctcggggccgatctgggccgtcggtcccgtggaccggcggtggaccacccgcgtggtgccggtccacgatggaccggccccttgagccgctaccgagtggggcccgcatgtcgacgcacccctgatgacgtcagccctgggatgctttattgcgcaataaaatccattaaggccttttcttttatagtaaaaacacatttaatcttctaaaattcatatctaattcatccgagctccgattaagtccattcaagtctcagtaaattcataaaaatgcgtagaatccattaaaaatggttttgtttcctgtttcagtagacttatagtgtgttttgcttgtgttctttgtttgtcgcgtagatttcggccgtttcgtcgatccgcggttcctcgaagacgttgctatggtctcatcagtgcgagagcaaggcaagttatgcattacgattgatcatattgtacccaatttacaaatgtctcgcatttctattaaatattgcattgttttacaatatcatgtgggatgggtcctactactcagccatatcttgtttaccttatgccattgataacttgggtattaaaatgcttagatgttggtttagggaatgcttagccatgcttagttcaactagtacacaatgggggaatcacattaatgtatagactttgattattggcaatagctttggattagtgccaccgcaagggtgttagttaattaaaatacactacatggtgggctgtgggtgcatggttttactagtcgtgcccatggcgattaaggaccggtttgcgggatgccctgaaagaatttatcgtacttaccacaagccagcgtgggcaacggctgggcttgtagtgtagctttcttctagccgatgtacccaggcgagggtgggcgtgatggagttgggtcggccggggtgtccggttgatcggcttccggattcaccgtggcacgaaaggggggctgcccgttgcctgctggggacgggggcgaaccctaaggtgtggtgcgattggttaaaggggttatgcgaagggtcctgtcacggcctctttccggtatgtcgtggtggcatgtcagcgcacggtaacgtgtcgtggggctgtatcttgtgggtacagttgcacacctctgatcagagtaaaactattcgaatagccgtgcccacggttatggacggtcgaccagattcactgtgattagtctcaccctagttagctaatgaactggtgtagttcaggtggttggttgggcctgttgcaacgtgttgtagcgttggacagtgattggttaatattgattaattactaccctgttttactgctttcaactactgttgttaaatgctagctttatgcaaatgagcctttagcctcccttggatatatcctgcatcatacctcctcttccggtatgatttgctgagtacagtgggtagtactcagtcttgctctcttttccctcacaccagagttgaagttcttttcagttgaagatgtctcgaagaagtttgtttcgtcactgccatcaaggatgcctgtggagtgaaatcgccccgctgcaggaatcaagtcttcaggcttaactcgcttttatctttttctgctgcatttgtaatcttttatatttttgtaagacgtggatctgtatgtcaacaattgtcgtttgtgtatcctggctggtcctggacaagggtttaatgcacattcagcttagaaattttggttcgtgaatttctgggcatgacaggccgccgccgccgccgatttggaagggagagagagaatggggagaaaaaagagagaagggagagagagggaggagaaagaaaggatggagaaatgatgaaatgtgggccagtgggtcccacaataattttgggttgaatgacagatgagtcccatagatatttgttttaactctaatgccacgtaagcgccacgtggcatgaaaaccgggttagcaccgccacatcagcgccacgtcagcaaaaccactctccaataccgccggaggagtcaaatttgactggtttcactaattcgaggagtcgtcttacccggttttctagttaagggtcacgaattagattcggtgaacaattaagagagtctaagtggacttttgctcggtccgcgaagcccatatgagggaggaacacaccgcactacgagcgcaccatgcgtccacccgtcttgactaaacaaaacaagcaggcaccagcaccacctgcccggctagaaacgtctgccgattttgtccaagcggagaggagccgagctagacttgcaatctcacgcgtcgttccacacttccgcttttgttctgcccgcacagattgaccgcttaccacccccatcgatccatagctgtagctgtctccccggccatcccgggcaattaacgaatccgacgactaattagcacggcatgatgccatgctggctgagagcaagctcaagagtatagttaactgacagcttcaaattatctatagttagcttaatagtcaattaatacaatagttacctataaatatatattacacaattaatatgtggttctacctatcatacatacttagagtctgtattgcagctggctataaatctgtatcccactgctattctcttttcttttttatcttattcaaatgtagcctctgctattatactgctctgatacatactttctgcttgtggttcagcgaatcgtaggcgagccggcgaaacgagcggcgactcgaccgacccgctgccttggccttgagttttcgctgtcccttttaccattttccctcggtggcaggctgcctgagaccatgccgtgcctgctgctccgacgactgggacgcgagagttggcacggatcaatgcattgacgtccagaaatgattccagtctagacgcagtacataggtgtggcgtgtagaacgagccgttggcgagtagtattagctgcagagaggtattagcgagtagtatgtacgattcgcttccaaatgaaacgaatcttacgaaaatacacggggtgtgtcctcagcgtttggtattggaataagttcattttagctctctggtttgcattgtcctggtttcagaagttgggagattagttgtatcttgtttttttttttacaagggtaggtgtgagtccttgtcggctttctggctggataattattgtaattttatctcacatctcgccggtgttgacactatggctgagtaatatacctccctttccccggaaaaaaaagaatgaaaatcagactaagtgaccaatgaagccacctaaagttgaaccgattttgctaaacatcacacgggtgattttttcgttgatatttgacagatttttgcccctacaattatgcgccgagatcagtacacgattctgcgtcgatgttgtcgtgaggtggagatgagacctcgtaggtcccacgtttgccgctgatcacgattcacaagaaatttacatcctagctacgtgtaaatatcctatatagctaaaataaaatataaaattacagtcctatttaactaaaattgtatatgtaaattcagttgatattaattacaatcctatttaactaaattcacatttgtaaattcagttgatttaacatgtaagtgcactgtaattttgataaaaatattgtgtaagtaaatatgtacttattattttctttaaaatataaaattacagtcctatataactaaaattacatttgtaaatttagttgatttgacatgtaagtgcactttaattttgataaaaataatgtgtaagtaaatatgtacttattattttctttaaaatataaaattacattcttatataactaaaattacatatgtaaatttagttgatatgacatgtaagtgcactgtattttttattaaaatattgtgtaagtaaatttgcattagttattttatttcaaatataaaattacagtcctatataactaaaattacatatgtaaatttagttgatatgacatgtaagtacactgtaattttgataaaaatgtcgtgtaagtaaatttgtattagttattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaagcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacctcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgtttgggcgtgattgtttacagggcatcgaagcccgaccgcctccgtccggcgaggagggcggcggccgtcaacgtccgatgcgtcagcagccctccggccaccgaaacttgtaccgtcctctccctttccctctccctctccctcctagcaactcatttatggttgctcccaaactgctcactgccgcttagtaggtttttgctatagtagttatcgttggaggtgtgcaatcgaatgcaatgagctcgatattgcctccgctgatgctatcacacgcagtttaggaacaaccagaaagttactgatactatcactagcactgtggtagtaagtttactgaaagattcagctttcgttttgaagctttcaagacgaaagtaccacgaaatgccaatatggccaagctgcaagctggctatctgtttcctgaggtttgttttgttccaaccatttcctctctcttctttccctccctgtcttcgttgatgctgttttattgaaattgcatgttgatattggttctttgccaactgtggagcagattgccaggagaagggcagctcacctgctgaagtttcctgatgcgaagattataagccttgggatcggtgacactacagagcccattccagacgtcataactaatgccatggcaaaggtacatcgttgctcttaatataataaacaccggttgtgtagcttcagatgatttatgttgcagtttgtcaagatcgtagttaaatttcttattgaaaaaagaagttcggcattgcatggcacacagttcttatggttcaatgtaaatgattttgtcagacaggctgtgcatcttcctaggagtaaactaagaaatcatcatcttcttttcttttttcttttttttttgcattttttgtattatagttattttttttcaaataaacattgatctttgatgggtctatttgtaaatgcagagagcacatgctttatccacagttgatggttatagtggttatggagctgaacagggtgaaaaggtatgcttatcactttactagcattttctgccaatacatcagcattcagttgacaagattgtacataactattttgcttcatatatgattttaaagtttgtgtagaatattctagaataattggagcaggatagatctttgtgctaatccatgaggttcagtaacaccttatggcatctgctggtgtggttcatcgaattagttttttgaactattaacttcttgcactaatagctgtcacaaagatcaaacatctgccacattttcttgatgagtggattcttacttttcttttactgccccattcaaatatattagtcttgacattgcatacatttcatatagcttcactatcataagccgtttatgttcatcattctgaaattatacattaattttctgcacagaaactaagggcagctattgctgcaacctactatgcggatcttggtattgaagaaacagatatattcgtctctgatggtgcaaaatgtgacatttctcgtctgcaggttctgaaataatcctatcctccctttcagtttatcattcatgctataatgtcccttacatttcttccaattttcaggtcctttttggatctaatgtgaagattgcagttcaagatccatcatatcctgtatgaaaattcttcacttgatgttaacccttcctagtgcatgattccattcttaaactgatgtttatggtcatgtgctccttttttttcatttctatcatactgcttcttattactaactattactttcacacttgtctgatgtgtattccaacatgtgttccatttttataggcctatgttgattcaagtgttatcatggggcaaactggtttatatcaggaggatgttcagaagtatggaaatattgagtacatgaaatgcagtcctgaaaatgggtttttccctgatctgtcaagtgttccacgaacagatataatcttcttttgttcacccaacaatcctactggtgctgctgcatctcgggaccaattaaccaaattagtcaaatttgcaaaggacaatggatccattatagtttatgattctgcttatgccatgtacatatcagatgacagcccaaaatctatctttgaaattcctggagcaaaggaggtaggctttgggatttaagcccttcctaccacatatggaaatttatggattttctgcaaatacttaaatccacacctgtcatgtgttttcttgtgtgtaggttgccattgaaacagcatctttctccaaatatgctggattcactggtgtgcgtttgggttggactgtggttcctaaggagctccttttctcagatgggcatcctgttgctaaagatttcaaccgcatagtctgcacttgcttcaatggtgcatcaaacatttctcaagccggtggtttaggttgtctatctccagagggtctaaaggtagcgtttcagagtttctgaaaatcttcatgtggctcttttggcaatgcttcatttcatctctttgttcctatgcaggccatgagtgacgttgtcggcttctacaaggaaaatactaaaattattgttgacacatttacatcacttggattcaacgtctacggtgccaagaatgctccatatgtgtgggtgcacttccctggccgtaattcttgggatgtcttcgccgaaattcttgagaaggcacatgtggttactactcctggtagcggatttgggcccggtggtgaaggcttcgtaagggtcagtgcatttgggcacagagagaacattattgaagctgcgagaagactgaagcagctgtacaaatgagcagtgatccggcctttatattctcaacctcttggggagccatatcaaataaaaccaagcagagttcgaagacaaaatttactctgtcgggctatcagtagatgttagaattgaaacctaatactttataggcagttgttctgttccgctcggtatttatccattcagagccattttacattctgaacttctcttgttgtttagccctgatgcacctgagtgaatcgcaagcttatttatctccttttgctaagttcgtttctactactctgcttaatttgctgctgccgtataaggctcagtgatatctccctggatgcattgaaacgttaggcacacttgagtcactggttgcaacaaaattaagagtagagaacattgctcagaccaattcagttttctactctcgtacaggaagaaggtacagtaatactctattttaccagactaccagagtaccagtgtagaaagtactatcaaatatgaattgtactcagctacctagatgcgagagaactcattggagaatgaactctattaaccgaaatctatgagcatggagagaagcaaatcgttgacttcttcaggtcaagaacttacacgatcttaatttactgaccatgtgatatgattcccccgaaatatcacatttcccagatctacagctgcaatagtgttcatacggcacgcgccaaaatctaccgagtttcacagtatcagtatcaggatgcagaaattcacagtatcactatcagcatgcagaaattctgccgaagaaatcccacagtgcacttaagtacttaacaaagctccacaacgacatatcatttactcttcgtatgtactttgatagagaaatactcttcgtatctatcaaactgtaaaactcactagaaaatagctaaatcttcagggggacgcttctgtgcaaactgcaaagacaagtacttatatgacatcagaaaaggttgcttacaacaagaattagaggcaggttaacatgacacaattgtgaatattgtcaacaacagtcatttttcgtaatggtgggatgctgacttgaataacagttacaagaatacatcacaaacaagtttacatcaatccacgaataaagatgacagctgacgaattgatgtattgcatcaggccctcttcaatgatttaaacaaacaatggataacgatgaacgctaggacgaaacaggaatatagaaactgaaaagtaggttacagccaagcacactttggagagctccgagcctctcatatgtgacaaactggatatcttgctacctaactaccactaatagcgagcagagaggccgacaaccatatccttctgaaggtaccaataagcacatgaaaaattcttttgagtaagacataaccaaaacacttgtgacaaaagaaaaatctaaaccattcattgaatatcaccggaagaatactattcatcgaataagaaatatgaaattctatagaaatatatagtggtgatcaattaacagagttcccttcactaactcaatttctagaagtgtaagacataaattatgccagcaataaacataccattgttctcctaaaatttcacattacaacatagatatccatcctttgatgtttgatcccaacccaaactcccttgtcaacccaagtctacaaaaagaacacctttttaagattttagacccaaaaggatctacaatgaacgaaataacgcgtggcattgtactctaattatcacttatcacgtagaagtagtcttcatggccttgaatgctgggtggagcaaccctagttcatccttgacatcaagtgggttgctagtctcattcctgatcctcttcaccttcctgctgccaagcgacttgtgtgtaaacccatacatttgcaagatctgattatccccaaaattgaaagcacgctccatctgcttgaggcacctctccacagggtaatccccaaacttcccacacggcttgcatccgacaaagtgagtgaccagtggccaccggtgatcaccaagtcctggatggtaattctcaagcatttcctcatacctatcaaccaagataccccaatatccatggaggtaatacccattctcaaggtacaccttgtcaccccatttctcacgccctgtagcaaggatgtataccatggccgactgatcatcagcctcaaacaccggccgatccttcaagtacttggtcaaaaccttcccggcctcaatacggacagggccctttggtcccattggtgcccatgtatcaaggaaatcaagcgaccattggcagttgcgcagcaagaagctgcctgtgttgaggccaatccagttcttgtcgtcgtagaccatctcatcccagccgtgcatgatgaggttgtaggggccgtaccgctcccatggcagctcgaatgccatgtcggagaacatggcgtcggagtccatccaccagaggaactcgatctccgggtgcgcgaggagcagcgcgcggaggagcgggagcttggcccagaatccggccatctcggcgtcgagcagcgccatgttgtagaagatctcgaggccgtggacgcggcagtagtccatcttgttcttgatggacttgaggaggtagtggtcgccgacggggttctcgcacggcttgggcgaggagcccgtgacgagcagcacccgcggcttgacgtcgttgacgaagggcggcgtctccgggtggcggcggtgccacgcggcccgctgctcgtcccagtcggagatcttggggcccagcgtgtagggcgggtcccggagcgtcctcggcggcgggtccggctcgtcgtcccgctgggccgcgcgcccggaggaggacgacgagccgccgcccctcgacagcgcgtcgtggtgctccgccagcgcgcggtgcgggtgcgagatgaagcggtggcggagctcgatgaggtcctgctgcggcgtgccgaacttgcccgccccgacggtgccgcggagcacgacgacggtgagcagcaggcacactacggtgagcttcgcgttcctcgcgaaccgctggatctcccgcatccgccgctcccccaccacccgctccgccacccacattttgcccccctccctctcctgccccttcctccgatccccccacaccgatcaaacaaacaaataaacaaacaaaccctcctcccccaacccaaaagcagcaaatcaaaaatgcaggcaaggaatcaccggtataccgcgtctacggcgacggcggcggcgtcggcggcgcggagtggtggtggtggtggtggtggtggaggaagaagccgaggaggttttgaaccgcggagttggaggcgaattaataagagaaagggcgaggcggagtggtgccgcgacccgcgagcgagcgaagcgcgcacgttggcctcggagagcggattgcggtggctgtctgagcgatcgggaggcggaatggaaggggaaatctggggagacgcgaaatcggaatcgaaatcgaatcaaccccctgacccggccgctgcaaggaggaggaaggaggaggagaaggagaaggccgaaggggaaggtggtggtggtaaaaggggaggggaatagccagccaacgcgttgcgagatgcgatgcttctactcctttccccgctgtcgcccggtaatttgacttgatcctctcgcgtgggcgtatgaccggtggggccacccgcgtggggccctacgggttttgtatggtaattttctctggcttttttttttgctcggttataaacggggggttaattaaccagtggcggccagttgtaaccagcccaggggcaagcgacgtcgcgaggcgattgcacatgacgcggtgacttttctccaacgtttaaacacgcgtccccatcaacggccgtgccaccacctcgctcaaacgaagcgggctgttcctccgcgtcgctgacgggtgggccattgcgtcgacactgacccacctgtcagtggcgtggtactagtttcggcgatgtagctgccggaggtggagttgtcggttgaggagctaatcactggtgtgtgatggcgatggccataacgatgttttttttaaagattaaagtggacatcagggtatgtaagccaaattactcctctagaagcccagttattatgccttttccttttgtttagtttgggttggtaagtagcgccaaacagtagtagttttatttttcaaccatgtaacatcacattggaccaggtttctctcaaatataatgtactacgcatgtttacggttccgagatggccttccgtttcgggctatgacggaataacgtttttcgtgaaatccgatgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacgggaaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggccaggacgactagtactgtatcatggctataatactgcatcatggctaaagcgtatatataaaactacggaacatgttaaccatttttcaacggataaaaaattggagtatatatagtctactgtggatgtatgtgtatcagtgtatacagtacccataccgaaatgaaaaagccatgaagaaaaatgaaaaaaagaaagtatgtttttccccatcggaccatacaagcaaaacgccaaattggactagtgactacagatctttgctgaaaacaaataaagattcttaacgaacactaaagatatactaaaccaagcacggtggtgaccacaaggaacacatatatttgttatcaaatgcgctaaatgggccctagtggtctagcagatcaaagccaatgtagcgagcacaaagcatttgggaccacggccctacgctgctcaacattgcacgaccaactgacctggaatcatcgaaaccacaccccactaaaaaatccccagtagaggaaaacaaatctatctcgtcttgatcagttgagctcccgacttcacgtcaaaaatgagtgcagatgatctcagccagctccctatcaacacaagagaatatgctgttaaatcactaggagttatcattagcatagtgcagactagcacagccacaaggtacacgccagctaaaacgaacctatccagcataataccaggcagagggaccaaccaactgggctatcagcttaaggaaaatgtcacatgagaaaatattcatggatttatttttggacgaattgttattgaaagcaacaaggccattcaatgcagatgtatatgacagagaagccgtgaattcagtgatcaccgcaaaatacacaagtctgaacccatactgctaatcagcaatagcgtccacacatgacaaatggaccaaaatgtaacaaaaatatacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttgttgtagggtataactgaacccatgcaaattcctccttgtagctgacattttgatcgcatgatcctttacatgtgtacacaacaattgttgcccaatcaagagagtctggctcatttttcacaccaaagtaataaagcagctgtggcattatctgcagtacaaattagtgtgatatgtaagcatgtctgtgtgaaaaagggggtgggtgcctgtttgccccttactgtcgtacaccttagggatggtaggtcttcactgactaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcaaattcctgtaacataatattttgagaaaaaaatatgcaagggcactaaaaaaggctaattagaacattaactacacaatgctactattctgaccaggcaaaggctgatcagtataccaccaaatataaaaaagaatccaagcaactgatgcaatctcacctcaatacttgctttggtgctcttgagacccgctcttgaaaagacgcccagcatttgttgtcagcatcagcctacaaaaataatagtggttaacaaaaacaaagatgaacagataagaaaaaaaaaagaaaagagagagagagaggatgtagggttaaaacctcaaattgatccatccatgactgcatcatatcatctggtttaccaggtctttgcatcaccaaggactttgagttactctcatcacaactgtcagaattgaaagcaccctcatagtcgattgcaatctcatattctggccaagatttgctagcaggaactgcaaagagatgaaactataaaaaagagatatgattcaatgtttacaagcttatcaagcactcaaatacaatcaccttttcctacagcaggaaaaatagagcttgaagcttcagaagaactgattaactgtaggcaatcactcttatggccagagcgccagtgcagtgtctgacaaatagaaaaaaaatagttcaacaaagcatgctttagggcatatatagattaacgattagcgggaaaatgacttataaatacctgatgcttctcagagcagtagcgtgctttcttgcagctactacagagtttatcacctttccatgtaccgcaccaatggcagacaggagctgacagcatagttgaataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcagaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgcctccggccttgctagggaacaggtggcggaggaggaggcccgggtgcttcggcttctccagaaaaccaagcgtcacctccgcctcttcctcctcctcctcatcgtcgtcctcgtagcccgcgccgccgcctccgccgccgccgctggcgggtggggatcggtggggcagttcgggctcgtcgtcttcctcatccagcgaggtgatggtgagaccacgaagcttctcggcgttggactccatcctcggcggcggcgtgggggcaaaaatgcgtgcgtgttcggcgactcgcacttgagagtcgagacggggaaatggtttgggcgaaaaaccctagctagcctcctctcgggaatctcagccgtccgatgcggggctacaaaacgaaaccgaccgacagacaccgaccgagcaaaacctttcgccgcgcagccacctaaacccctctcctcccccttcctctcccgccgccgccgcgcgcgcgagccggcggccatggcgcccgcggccgccaccatccgcgacctgctcacctccttcagccccgccgcggacttcctcgccctctcctctggcgacggccgcatcaaggcatggagctcgaagctttccgcccgcccatcctccaaaccgccgggagctgcacggttactgatgatgccatgggctaactcgatcctttccacctccattgcaggtatgggacgccgtgcgcggccaccttcagaccgagttcgctgatatcccgccggtggaggtgggcggcggcgcgcgcgcccccggggcgaagcgcggtcacctcgcactggactacacctgcatgaagtgggtacagctatcgagcaaggtgagcattgcccccgaattttcgagcttctacggttggtgttgtggtaccgtgtgcctatcgtgtgctcgtgtttttgccttgcagaagaagcggaaggcagggagttcgctgctggtgcttggcactggcagtggagatgtccttgcacttgatgtcgccgcagggcagtggaagtggagggtcactgattgccaccctgggtacgtttggtgcttccatgggaactcgtggcttcatttgttaaactatactccaagctcattgaacccttgattgtcgctttgaacatgtttggaatttctatgttaatctccgcaagctttagctagatgtgttctcttacattggagtgcttgtttttatgtgttcaggggtgtcacagctgtagcctactcgaagcatgggcgaagtttgtacaccggaggcactgatggcatggtctgtaggatcaatgcctcagatggctctgttgtagagaaatttaaatcttcatcaaaagcaatttctgcattagctgtgtcaccaggtatgcccatgaaattacgccgctggttttatgtctggtttcacccccactgaactccccatttgctaactatgcatacactactttacttcctatgttgtgtgcccgttggtcatct

SEQ ID NO: 42992 - DNA, 68035 bp, Oryza sativa
attcctgcagccctatctttctgctcgtattattttgtcctaaaatgctaaccttctgctattggctaccctaaaattaacatttttaggtagctgtgaggagcatggtttttagtggtgatagccaatatgttctgtcatctggagttggggaacgctatgttgccatttggaagttgggtagtggtaaaactcagagttcaagctgtatactctctatggagcatccagcgatctttgtggactgtaaatgttcagacattaatgatacagaaggagaaatacatgtgttggctatttctgagattggtgtctgctacttttggtctgggactaatatggatgacctgcgtaataagaagcccactaaaattgcattgtctgattcctctctttcaagatctaagcaaggttttgcaatatttgccgcaaaactgcaaggaatagatggccctaattctgcacatgttctgctggcttatggatctgtggtgaaaccgtcttttgacaaactgttggttcgttatggcatggatattagtttgggtgtatctgatgatggagttctcttacccatgattcaacccacaaagcctcagaaaggccaatctgctaaaaagcaaggtatactgctggtatctatagatatacacataatcctgcacttctgtttggtcccttgcctccattgcagaacgctcaactattgtcaatggttactcttgggctaaatctcaattgttttcttgtaggaattataacggctctagaccgtgctaatgcagaagatgcaatccttcctctcccacagctccatacgcaggaaaagaaaaggaaacataatgcaacagaatccagtggtgacatccagtctgcacctcatagtgaccttagttctacaaaattgattgagaaaagaggtaaatcatctgtttgtagcatcttcagtagtcataattcttttgttctcatggcagtgtagatacgaactggtacataactggcacagttagctagtggaagtgtggaaccacataagtttgtatagtacatatatgtgtgcttccgcatgtttgggcaaacttcaaataaatatactataacatcttataagttacaaatgaaaattattattataatccattctaataattatatacatgagtgcatgagatcaatctacctagcctacgaatacgcatgcaaaataacctggtcttttacaaaagatccttcaaacaacaaacatgttttcgggagtggggaaatgggtgtagagcacacccatttgcctccaactccatctcaaaggaagataagtgacgttatgtgtccatatgatctttctctagagacttttaactctgtgggagcaatttattgcaggggcctatacccttgtggttttcatggcaagaatgtaacaactgctatgagcaataattctagtctctcagttgttataggttttactatagttttaacattaaacacaaattttgttatatttaacatgtatttctgttaaattgatcttcactatttgctcaaaaacccttttgcttgtctagctcctatgcaaagaattgaagatgacagtgtatgcatcgaagacatgatgcggaagtgtggagttattgattctagagttgatcagggcatggaaggtcatcctagcatacccactagtattttatctgatctatttggcagcagcagtaaaatcgatgctaatttacccaacaagaaggtttgtgagaactgaatttcagtcaaatgttctgtacttccaccatataactgtttgcatgtttacacattacagtatatatacaactgatgaaacctgatgcattgatatggttcaacagattcgagcacatctaagatccttgaagcctggagatgcttgcgaacttttagaaaaattagtatcttcatggaaaacaaggtgtccatgactcttttcccatgtttgttcccccacaacgcattttcattcgtttttatccttgtatgcttaccaattgctgatttattctctacagatctggtagtgcagaggttgttttgcggtggatatactgcttattaattatccatggtcgttttatcccctttgagaaatctaaaaaaataattagcgaccttgagaaggtattatatgtgttaccagtactatctcttgtgtgctatgcagattatttgaaacatgttactgttgtggttgtcatcatgctgtgttgtagtggagttggggggttaagctattagcaactattgccttaaatgactgcagaatgtggataacatattctgattctaatttaaagaccaccaatgcaggcagggtatttcagaatatagtttcgtgacctatttttctgataaaagtacaagtaacaatgatggcaagaactcacctttgatgagaacttgccaagtcacaatctgagccatttgatccactctagtggatgctaatgtagttgttttcccatgagagttctcaagtcgtcattgaacaatggattcccattttagatatctcctgacaactcaaacaatgttgtattgacacttcataacatcaattaaaaagtcatgtgcagtattgagcaaagcacatagaaagttaaagaaataagcatgctgtgtatctagattgggaagatgtcatgctatgcagtgctagtaaattatagatatctttattttatgtaccatgactgatttgatcaagttgcccccaccaatgctggccaatttctgttatgtcaaatctggggttgtcaatttggctgcccaaacttataataaatttactaaagtatattgcatgcccagtatttacaaatgaaacacttcccaatttcaacaacatggtcagattttgatcaatattacttggaaaaaaactgagactataactgtgtgtttactacgtcaagaaaaagaactgaaaattcaaaggtcgaactgaaccaccgcaactatgagcttaccatgtcttaccatgtcgaacatacaaaacaaaaaattgaaatgaaccattacagctatgtgtttttcttcttttttcttcttcggggaattgcaactatgagtttaccatgcgaaacaaacaaaaccaaagttgaagagattgaaagaaaccatttttcgtttgcagatgtgtggggaaagatacaaagcagctgaagatttactgaagctttctggtcgtcttcgattgctcatggctcaggttttaaccattaataatactgcgtaatgagtcaatattcttagtgtataagttaatgatgatttaatgatcatgtgcgtacttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacccaataactttagtccaagatttagattggtgatcactgcatcactttgatcacaccaacccaacaagtagtccatgatccaacagatggtgatcacaacatcacgttgactacaacgaccgtgtagccaacccggcgaaactttcttcgccttcaactaaacattgacaaaaacgacatgctaactggggcctcctgacgtgtccttccaacccccccggcctagtaaagagataaacgaaccgtcggcgccatccaatttgaaccgtcgccggccggtgctcaccagacaccagagtaccagacccattcaggccagggctcaccaaccccccacctttggcgtacctatttaaaccgctagctgccactctctccggcatccactcaagcagagcagagcagcggcaaagcaagtgatctctttagctcggatcatctctgcatttgcatttgcagctgctcgtcacggcaatggcatccaccaacagctggacccacgagatcgagtcgccggtggccgcgccgcgcctgttccgcgccgccgtcatggactggcacacccttgcccccaagatcgcctcccacatcgtcgccagcgcccaccccgtcgacggcgacggcagcgtcggcagcgtcaggcagttcaacttcacctcaggtatatatatatatatataccgccgtccactaagctcaatattccatcatccccgagatgcacttgatagtgcggtggcaaggggtgtgtggtttcaactatgacgtccgtcccgtgttcaatccccaacacgttcataattacattcacctgctgttctttctgcagccatgccattcagccacatgaaggagaggctggagttcctggacgtggacaagtgcgagtgcaagtcgacgctggtggagggcggcggcatcggcaaggcgatcgagacggcgacgtcgcacatcaaggtggagccggcggcgaacggcgggagcgtcgtgaaggtggagtccacgtacaagctcctccccggagtggaggtgaaggacgagatcaccaaggctaaggagtccctcaccggcatcttcaagaccgccgaggcctacctcatcgccaacccggacgcttacaactaaatcgtcatcatgcctatgcccccaaaatatgtttgataatatttgatctttgcgagtgtgtatgatcgaaataaagctgcttccaagcagtgattgagaagtgagcagcgagaagcttggtgtgtggtttggttgctgtcggagaatggttttgtttgacatgatgctgtcaacaccggctatgttatgtatctatctagcatctacctgttggttttgcgtgggaataaaaacatactataaaagataatgagctcggaagctactatctgtgaactgtgaagtactctgctttggaagatatcagctcactgtcttctgcttcctcatagaaagtttcactgaacatgattacatttcactccttttcaatgaggattagatagcatatcagtaatcagtctggtgaggccgtcgaaaattgatttttgtatcaataactattggttgccaccatttctacctatcatgtagtactacactagggaggtggatttttttcccccggagaaaggatgtccctctcattttaatgttttaataagatagataaatatgtgagatatcagtacataaatatgtaagtatagatcatttcccaaaccttaatgaaattggatgaccttccttcagctgtcccggaaaaaaaaatcaaagtagaaaaattaataaatttggctatgtagcgtaagttgaatttaaacttacccctttatatagtgatatatcatatatttttctttcttgttattttttttaaaaaatatgatttagatggcatgcaaatacagacgagaagaaataaaccttccttactagttactactctatcttttaaaattctaatagtatactgctgtactagttactagttagaaggaaaaatcgtttttcatactgatacaagatacaaatgatgtttccttgtcgtctaatccatttattgcattcaaattaactttcaaaattattttgcagcacattctaaattattttgcatgtctaaattaaccagagcaaattttataaaaattatgattgttttgtgtgtgttgttggatttagggtagtatgcttgtttgtttggcctgcggcctgagtccgggacatttaactatttgcaattcataatccctcatgtatctataatatgtgagtatagtaacaaatttttaattacccattcaaaagtgacaaatagttaattattcccatgagtccctgttgagagttgtgtgcggtgttaccgtgttcgaaagctggagtccccaacgctttgtatcgaaccaaaccttacgctttcagtaaaaagctgggctctctgggcctttctctaaaaaaaactatgattgtatttgttaattaccggttagcacaatttaaacaagtcatttaaaaatttataacaatagctgatgattttagaaaactacaacttaattcattttgtagaactaaatttaccatagttagttaacgtatattcacaatcaactttgttttttcattgtgatatgtaaaagttggattttatgttacatgtttgtagagaaatatatcacatgttaatatatcatctcaatgtttaaactattttaaatggcatgcaaacaacggtaacgttcccttcagagttaaaatccactccccttggcagctagtacaacttgcagtttgcaagttcatctcctgcattaaaactagcaaaagtttgagtacgtttcagaaacagaagaagtaaaactctgtcaaaccttatctattagtttcaccatttgtcgatcagtaaaaacaataatcgattcgtaacaacccgtacaacacgtaaatataattaagtagtactagtatatgcaatgtactacgcgtacgcaaattctatggagaaaagaatgcatttctatggattagagtacagcagagaacgctatagagatcacaggagttgacgacgacagcaacatgatgcaaacaattacccgctagcatatatataggccgacgagacgacgcacgatggatcagtgtatcctccctgactgctcctgcggcaacaggccggggatgaacggcacgccgaactttgggagccacgtctgtccctggatgaacctctcgacggtgtacttctgctgcgcctgctggtacgtgaccgtcttgacccctctccacttggcgcgcttgctcatgtcggcgccgtcgccgcggttctccacctcggcgtagtagcaggtgttgaggccgaagtcgccgagccacggcagccacccctgcgggtcgatgaacccgccgatgtcggactggatgtagagcgtccgcgagtactccttccacgggcggccgaggaacgtcttgaacttggcggcgtcggccttgaagtcctcgtgcggctcgatggtgcagttgtggatcaccgtgccgcccgcggagtgcttctccttgcgcccctgcgccgtcacgatgttctgctggttgtccatgcaccggcgcacctggatccggcagttctggagcaccacctgcgcgttgccgaagatgaagtcgatggtgccggtgatggtgcagtcgcggtagtactgcctgctggtgtgggtgtagagcgtgtcctggtgcccgtcgaactggcactcgtagaacgccgactggtcgctctgcacgcggagcgccaccgcctggtggttcttggacccggccgtgttctccacgccgatgccgcgcatgaagaacccgttgccgatcgcctccatggtggccgtgtccttggtggtgatgttgagcatgaagctcttgttccccgtgatgatggtcttggtggcgccgtcgccgatcatcaccaggttcgtcacgttgcgcgccaccgacacgtactccttgtacgtcccggccttcacgtacatcacgtacgtccccgtgctcttgaccggcaccttggccagcgcctcattgatggtcttgaagtcgccgctgccgtccgccgccaccgtcacgtccggcttgaactccttggagcccggggtcgcctccagcagccggcgcttcgcgttggacatccacacgggcacgccgtcgtcgccgagcagccggcggctgaatccggtgatgtccaggttcgccagcgtgtcggcgaactggtccacgatggcgaggatgttctccgtcagctcctgcgagctcttgagcgccttgcgcatcttctccgacgcctccgtcgacgtagagttctcgaacccgtcgaggcacgtctcctggtacgtcagcgccgagctgagccacgtcttgacgtcgtccacggcgcgcttgaagttgctggtgtggaacccgccgagcttgtcgaacgtcgtcttgaggtcgtcgatggcgtagtcgagcagctcctcgcagtccttgagcgcgtcggacgtgcgcgggtcgttcttgaggtcgttgagcacggcggactccctcaccgccttctcgatccgctccgacgtcgccttgaagatggccttggcgaggtccgtcgggttcgtcgcgttgcccgccgtctgctccagcgtggtctcgcacgtctcccggtagtccaccggctggcagaacgacttgatcgacttcaccgacgtcgacagctcgccgtcctccttggcattgctcgacccgttcttgaacgacaccacgcacaccgccgccaccaccgccaccaccagcacggtcgacgcgccgatgatcgcgcctttgctcattgcaacacaatgcaaccaccagtcgacgattcacgcgagatatgtatcaaatgatcgattttgcgcgcgcgcgcaaaggcgtcgggatcgatcgatgcgtcgtcccctaccagcggaaggggtccggtttattcggtctaaaaattggagcaacgaggaggaggaggaggaagaggaggaggaggcggcggcggcggcggcggcggtggcatctcttatacgagcccgcgctaactttggacatggcgaaaaacgacggtggttgcgcatgggcgtcggaggtcgccacaggccgaggtgaatggagagccacacgacggatgccgccagtttgtttttgctttgctcgtggggattttctagttgcatgcaggcaaccatctgaaattttgttgtgctatcggctctgaaattttgttgtgccgtactgccgtcggccactaccaagggtgaagctcctggagctgctattggtggagctgcatgtaggcgccatgttgaatgaaggccacgccaatgtgtccgataatgcttatgcacgggtgcccgatgagagagaaaaatatccggcgctcgcacgtctcattccacgtcacttggctccccacacctcgctcggctcgcctcctctcccccgttcggcgccgcctcctctcccacgagctctctcgcttgcgccgccgtctctccccagccgacctcacccgcacagtctcctctcccgtcaatctcgccagcgtcgttttctccgttggatctgccgccgctttttgtcttcctggacgttgacggcggcttcgtccccgtggtggcggccgacgcggaggacgacacacgtgcggtgaggtgatggcggcggcggtggtggtgtaggctcgccggctccctctctcccccaggagcactctctcctcatctccgccgccctcccccttctcctcctacagatccgatgatgggagtggtggagaagacctacgcgagcaagcctgtgttcatcggagagaaggaagatgcagtccatactaggttctgtgtgtttttttttctgtgtttcaagctagtatactcgtgatgttcttttgtgtttggatcaaatgtcagtggatatttcgatagtgttctatatttctattttcgacacacaggttttgttgatgtttcaatggttcaaaaacaatgtttcagttagtgtacttgtgatgtttctttgtgtgtgtgtatcaaatgtttgaagtggattttagatagtgtttaatattttcaaatacacggggtttgttttgatgtatacaaggtttaagtgtttcaatgacttaaatcgtttattgtatatattgaattaaattgtttcatctaactatctcactatgtttcacttttttttaagaactgtaacatttttttttctaagtgctgaaacatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagcctatataatccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagaatctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgtaaaatttaaaattatgttgtcattttaatatatttgaataatataatgagaaaacatatatgctattatatgagagaaaatataatgatgctagccgcgcaatctgcgcgggccactatgcttgttatttttataaagggtgaaacaatgtccaattttaaatcgggcgtccgaatttgtagacggctaggcgcctcccagtacgttgcgtaggatgaaaccatcgttcaggccggttaggaggcaaaacgaatcggtttggtagttgagggatacatatcagactcgtcttattccatatttttactagtatggggtgggagtggaagaactcgaaaggcccataactcagggactagctagtagaacaaggaggaaaggaggccacctttttactcagccttactgttgaagtgtcgatgaaaaactgaaaacatagataagtccagcaagcaagtggttagcctcttaaaacgtgtcgacgatgatgtatcacgtcacgtacgttctcgtgcagatcaaaaggggaggctagcatacacggcctcggcctgtacaagttgtactctacggagacagcgacctcagccctccgagacgcaaaatgggacgggtcaattcacccaaaagttggaatacttggggaaatgtcaagggctgtgctctcttaaaaaaaaaccatcaataagcttaaagccaacggatcgattatacgtcaagcatcacgtaagtttgatggtacttcctccgtttcacaatatcattctaacattatatatatatatatatatatatattgatgttaataaattttagatataacatcaatataaatgtgaaaaatattagaattacttatattgtgatacggacagagtagtaacaaaggtgaacgtctgattacggcttccctgccgcattaccaaaatggaagagagtggcgccaaaacacgacaccagcttgcttaattatactactaactcccaaaagattaaagaaatagagggaaaaaaatcgaccggtagattgccggattgttatctgacaaatctcccaacgggagatattttactcccgtgtacggatacttcgagtagcaccaccgctgtgtgcacctctcaataaacaatacccatgacatgcagggagggagccgaaagaatgtcccagtactcgtacaagaaacatctcgactcactctgtcctttttttccccttttccaaaacgaaatcgagagggggaaacacatccacccgcaagatttttttcgatggaccaccagatggcctcttttccaaactgctacagtactaaactacgtctacaaacaatctgccatgcacgagatgccccggctcgcatgatcgcccccccgaccggccattccggattcccatctctccggagccagcaaaaatcgccgaaaaaatcctctggtccaggcgacccggcaggcccagcagcaaccgcaactttgctcgccggaaaaggcgcccggcccaccagccacgagcggggcaatcccacgacaccaccacacaagcgcgatcgtgcgatcgtccaatccaacggcgtcttgttagcgagcgttgaaggcggcagcggcgtatcgttttcggtcgtacggctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagagacacatcaatagtagcaccagtagtgtaacaaattgggaatacactgtgggagtaggacagggacaatgacacaggaaggcagaagaggacgcatgatgaacacatcaacaagagagtgaaattcaggacgaaatgtcgacaagatattggaatctttggccacgcacgcaccaattcttgggtgacgcggccggaatcgaacggcacacccgacccaacccaacccagcgaactaaacggagtcaatcatctgatgacctaaaaaaaagggaaacaaattctgccaaattttattggtttttctttcccgtttgcttcctctcttcttctgcttgtctctcttttcatcacttagaggcgtgtgcacgtctcgtacaccggcgcgccggtcacctgcgcgactgcgccgggtagggcgcgacgcgcgtcctccgtgtgccgtccgacggcacgcggccaccgacgccgccgccgcggcttccgccgtcgccgctgacgatgtcttgcagcatcttctgcaggtcctcgagtgtgtccggcttctgcacgcggcgagatcaccggtcatcgcttaagtatgataactaagcctttttttaaaggtgataattgtggcgattacgatacgaattggtagagaaagtggttgcgtgctcaattgcgcctacctcgtttttcacgttatccatcatcaccagcatctcctgcatgaaatcggagaaatcctggccgtcgaaaaacagggcagaattttaataaagaatattatatactaatatattttattgcactattagccccaaatttttttttaaaaaagaatgataatattggttgctacgcaagaaaaaaaataatcgaggtttcacctggtcgtcgtcgtcgaggggatcgaacagcccggcgtcgtacatggctcgcttccccttgtcggacagaactgcagcaaccgcgcaaaaaaggatttcgttcgatcatacacgtagcgagcgcaaactgggggcggccgagcgggtgagccttaccggagtacgcctcttggatccgctggaaccgccgattggcctcgccggggtcgctcacgcaccggtccgggtgccacttctgcgcgcgcaaaaaaaaggatccaattcacaacacaatccatcacctacgcgcgccggcgcgggcgcgggcgcgggcgcggccgacgggggagaagagagcggaggcgggggacgtaccatggcgagcctccggtaggcggcgcgcacgtcggtggcggacgcgttcttccggatgccgagcagggagtagtagcagcacgcggacgcgccggcgccggcgccaccggaggcattgccggatccggcggaggcgtccatgggggtgcggtggcgggggcggcgagcgaatccgcgcggcgaggagggcggggcgatgcgaattgctaccgcggctgcatcgaattgggagggagaggggagaggagatgggtttgaagggcgcttggaaaaagaaaaaaaaaggttattattccgcgaggaggagacggatgcgtgggaaaatatctaaatagagtttttggtcgtcgggggttggggccaggtgaaggttcgagagctcgtgccgatgcgagatattttcgacgcccgtttcgggcttcgccctcggggttcgcgagtatttacgagtttgggattctctctcgcggcgcgtctgccttctagagccgtgaattacgctgcgtgggctttgaagatttgggctcgtcggggcattaggcccattttccctcggttcaggccttcaggataaaattggttgtgggcctttgctaccagctgaggctcattttgaaagaggatatataaaggactttttaaattaaaaaatggatcttaaaggatatttttttttcctaaatagttctttggaacaaaggatttgataccattgaattttatgagtttcctttggaataggtccaaagttagcatgaagttcaacctcttggaaagtctcttttcatccaattcgtatgttttcattcggtccgtccaaatggtttcccttatgttttgcttttttttttttgtataggcattcttgccaacatcatgtgttttaccatcgttgtgtgattgtgtctgtgatagctaacagttacgaacaccatgattcttttaagaaaaaaaatcatgtgttataccatccctattgtttcaaagagggttaaatagctcgcagttctacataaaagtatggtgaaacaacttgtaatgaaaagcattcccaataagcatgatcaacaggcctgggaagcatgatagagatctgcaagttaagagtagtatgataattcaatgagctatgcctggctaggcatggttgaaaaaaaatcctatgtgtttggaatgatacaggcggcagggaaaagagtacaactaagaaaataatacgtactgagaggattagttccatactcagtacgtacttgtatggaataaattagcctcaatctccatgtgagggtttaaccgaaagaccttacagtctttacagtcttacatatgctaacccgcgaaacaatgtccacttacatcccaagttcagagtacaagcaaaaatatccaaatctgaaccagaacacttgattaatccacagaacataaggtgtgagaatcttcacaatgtgggaagatcacatatccaactccagaatagatggaacagaatttatatcacatctcctattcactgttacagttaattactccataaccattgtaaactgtgaatgacatcgatattcaatgtcagtcatcaaactcccatgaccattgcaaacagcccaccttcctccagcgatattcaatgtcagttatcaagtggagtacttgtagaacaatatacttcatccgtcctaaaaataaacgaatctatagatatgatgtgatattttataatataacaaattttaagatatctttgtacaaatttgttgtactagaaaatataacatcatatttaagattaatttattttgggacgaagggagtacaccgttgaatattttcaaaccaaaataacgaaatgcgtgagagttgatagtaaatatagtttgaagctaagcctcttgcagtgaattgtaccaaaattatcacaagaaaaattagccagccacatggggaaccagctactcctacaacagtaggaaggattgatacattattcaggcattaggctccggacacctaggatcataattcctccgaaattgaagaaatccatctctaaacaattaaatcggaacagcacaatcatcaagttacgcaatattcggacctgcatatagcattcgaagattattagaaagcaagggaactattaagcatggtttgattttgaccgaaacatcagagaaccagatgatctttgacagtttcacggaagtaggcactgccccgctcaaaggaacattttttttttaagataaccggcatctacacccaaaggatgtgcacagctcaaaggaacatgcatgaaaataaatatagaatatataatgatccgacctgcctaagataattgcgatataaaaacctatagaaacaggagagctaaacataaagatcacctaattaaagtttggcattaagcaaaagcaattactcaaccccagaattgccattcaaagagataaatgaaaattcgcatctaaccaactaaccaagatcttcagaagcaacgcataactgaatcccaaaaatcctaaggaccttcttcagactgagcaccacaatcgaaccaaagaccatcgacatgctagaaataactgaatcccaaaattcccaaggaccttcctcaaactaatcagcataatcgaaccaaagaccatcgacatgataaaaacaacacagtagcactactcccacagttcaccggagcaaatcgacagaggccggcatctcattctttatacgggtccctctgagctctctgcatttccaagttatacaacgcctcttgcaccagagccgattgggcagcagcatccacggtagcaggagtttgctgccacatcctatctctgatctcttctcgcaggcctcttatgaataatgccacgtcgaagcagttgctggagactggatcgaacagcttggcatggtacaagcgctcctcgaactggtctctgtactcgctcactgtcatgatcccctcctgcctcagatccaagagtgccgtgagcttctgcttgtgatcatagggcccaaatctctcctccacggcctcacagaaccgaccccaatcacgctcatggcgcttctcataggtcatcatccacagctcagccatcccctccatgtgcatcgaagcccaggaaacccacatcttcattggcatgccgtagaactcgaagtagcgcgtgcacttggtgatccacaggcgcgggaacgtcccgctgaaagtggggaacttcagcttcgccagacgaaagaaccctcccgagtagccgtcgatcctggcggcgcgcgacgccgccgccgccgcctgctccttcttcacgtcctccaccagcgccgccgcaacggcgatctgcttggacagctcctcgaggcgatgttggtgcccctcgaccacctggctgagcaagggcagcgccttcagctgctccgcgatgcggtccagcttcgcctccatcttgccgtcggggagaaccgtaggttgctgcggcccagaaatttcgagacaaatcaggtccgatgaggtcggaggcgtccgcgaacgagacaaataattaggttttcaaagatcaaataaaccatgaagaagacgaataaataaagaacactaaaagagaaaaagaaaatcatggcgcgggtcgagaaggggtggttgctacgacctcaccttggccttcgttcgatcgtctcgtctcgtcggcgtcgccggttgcgctgcaacctgctgcggcggagcacgcggaagcggtgggcacttctccatctcctcggggagaggcgccagcttaagatggtgtttggttgttggggataaaatggagctaaattttagtccctcttaaaaaaatataagtccctattatagggacttataattttcccaaacagcccctaagtgcttccttctctactaagctgggccaagagaataggcccatgaagattagggctttctatccttctactgtactttttttttccaaattagatttcttttctggttttacaggcttcctatatattttaggctgcctatattttaagggtagagaattacaaagttgacaaatacttatacaattatcctcaccaataatgttattgctaatatgttttggtcttacttccttcgataataaatctttgacgttgatgataaattttgaattggaaatcttattatgttgcgttcgatattttgcacaaatttatcaaactaataaaataactaggggattttcccttaaaattttgtgcaagtatatataattgaaatataattatggatacagtatttgtaatttctactccagcggtccctaagtcaagatgcatggccaaaaataaggtgttttagggggggtggaggtagtacaatagtagatttacaaagtaaatttgaatcatatacaactcctatacaactcctagcacaccggcgagctggcgcccggctagtggccaaaacgacccggtgtgctagcggccaaaaatccaataatcttataaattcaatatcttcccaaccgtaaatccgtttgactccgttcaacttccaaaattcctcaaatctcgagatctatctaatggcacgcttagaggtcattaatagggctttattttcgccgtttgttgagttgtcccattttgcgtgtagtttcggagcccgaagacccgcagtgcgaggatttcgaggatcaagctcaagatctcgagcgaggcaagccacctttgaatatcttgagcctatatttgaacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgcactctgcacaagtatcgacggtcgccttcaaacctaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacttaagacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatatcgtgtgggtaaagtgtaccccctctgcagaggtgaacaaactgttcgaacagccgtgcccacggtcatgggcggatgtgaggtgattcctagcgtagttttgtttgactactgccttatgaaattgctgttgtggaaaggggatcgatgtttggaaaatctgcagctgatgggatcagctaggcccgggtggccgtttgaaagttgttggcccgggtggccgtttgaaagttgttggccgggtgccaaccttgaatcaattcaaaagactgatacattgcacatactccgaccggacgagacgcattgtctcatccgtgtcgtttgagaagcactcacttagttgatttcagaaaagagttcaaataaaatcaattgcaaaaacaacagcctttccttgaagcctgcattaaacacttatttcccgtggcttgcagagtactcccgtactcacccttgctctatataaataatccccccagttgctgaagaagatgaagcggatcccgctgacgaggagttcttccaggagcaagccggctacgatgagttttagggtttcggctagttcccaagtcgcgcctgtcggtgacatggggccgggggtatcgtgactagaggcttgggtagccgcggtcacccacgtggcctgaccccctcgggggggggggggtcgggcccgacggtcgtggccacccctccctctgtctccccgaggggtcgggccgctcccgtttcggccccgagggctggggtgccccgaccccttgtggttttggcgccacgtgtgtgggttaggtgagcacagcgggctcacctaaccgcatttatagcaggttggacgagcgcgccacgccgcatttaatgcggcgcagcgcacgcttatccggtccgtgaccagtcgcggtgtgtgaccggtcacataccggtcagatcgcgggttaggtggcaacaggcggcctgtcacacgcctcgccctgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccttgaccagaaaaaaaggaggcccaggcctaggaagaaaagggagaggaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggtaaaggggggcctgcgcggtctcctggtgaggagccccacgctccgtcagcgcctgtgatgtttggtccaagtcttggcttccgcttcccttttgtaatgcagttgtgagctcgggatctgtccgcagcccaacatgactgtactcctactctataataaacaaacctctattgctgtgatattctgtcttcctgtgataccagcactgtttcctgggaccggtatcgattaacaggttaatttggagcgtcacgggctagttccggtcgggactagttcggggcgtgacaatacgacatataaaaattgttaataaaacaccaaatagaatcctaatgacgattaaaatgagggacgacgggcaggccgtaaagcaaacgggcaaggcggttgccgggacttctagaaagtaaaaaaataaaccccattgataatcatatttgatttttaaaatctcaatgacaataaaaaggagaagtagcgggcggggtgaataggagtatagttgcagagccgccgatggttggcgggacttctagaaaataaaaaatgaattccaacgatagttatgttcgatttccaatgaacaggtcgtagaagagtataatggcagcgtttgacaggacttctacaaattataaaaacgaaacccaatgagacaataaactctaaaaactataagatccaagttttaaaggttgcaaggagaataaatagaaatagtggtagatcgagtaagaaaaaaaagaaggatatgacagaagtaaggggtagcagctggtgtgacttttaaaaactatataattagaaatacaaggataataaggtttggtctttcaaagttttaaaataacgagatagtttttaataaattttaagtaaaatcatattgaaaaatatatgatttcgtttgggtgctagccgcgcaattacgcgggccaccagctagtttatttagatgttcacgtttgcatctcgcaaatgctgccgtatcaaccacgtggtgacgactgacgagggcgggctagctttccagtgggccacaactgggttgggaaatgagttccatcccgaatttggtttaatggacggtgagggttaggctgggctggattagctaaagctaaagggagtttgactgggccaacaattttgtttcagtttcttggtcaccgatatcgccattggctcaacccgcattgccctcgacgacttttgcgacatgccatcgcgaaaaaccctaaaaccagttccgatcttaagattctgatacaggcatggaatccatgccatggattgagaggctggtcacaaatcaccacgaagaaaaggggaaggggctttttgggcaaacgtgctcctattctgacggcagtagtcggcgagtgcggagaagacgacgacgacgatgcctgtttggatgaggacgaggcaaattctgtgtggctccgagtagaagcagtggatcaccaaatgaggcccagccctcaagcacacgtttatcaaccaagtgatatttgacaaccccttgaccaaattaaaaaggcccattaaagttttccgtataaacaacattttccgccgtcaagttttcaatgattgaaggaaagcagaagcacaacgagcccggaaggagtatatttttcagagaacacaaatcagtaagatgctcaggatttcgcatctacgttttcaggaaaaacaaagcatctcgccatgcagtttttctttagctgaaaggcaagaccagctaattgccaagtagaatcgtgctactcctgcatgtttttttcttttggttgtttggcaatctaggagaccggagctgctgcctccccaatgccaaaggatatgtacctacctttgcacccaagaactcaccatgtgcacgcacaccctgttgctttattcctgggcataccactgctgatctcaacgagtgctctgccagcctctgcttttcatttctccctcagcccaatcatcaattagatgaacagaatatgaaattatatgctagtactcctactaattaagtgagctttgcaaattgccttgcgtaaagtcaagggatcatttgcagagttgaacagctcaaaacctcgcctcaaggtcaagggtcctcaggacctcaaggaccatgtaaatggatgagctcctgcgtgaaaccaatcagggccaccacatggaaggttgttggattcagacattcagttggtgcaatgaactgaaagtctgaaactctgtccgagccgatgccaattactagtaatcctatcagttgtcattgccaattaggagtagttagtgctgccatcatcatggccttatgatcaaaacggaccggataaggctgtatacttagaagcatcatgatcgtaggcctaccaaaaaaattctgcttgcacatattacaagcggaaatatttgggggtttcgatcgtagaaaagacaaggccctgtcaaaaaaaatcgttcgtggcagctttgcaaccctagagcgacaggtaatggcgttgtcgaagccagctgtagtgcagattgcagaagcctactgtctttgaattctccatcctttttttctcttcttctatgattctatccgtagcacaattcaatgcccccgtagatacaagtatacaacacggaaagacaatctagcacgtcgcagcagagagagagaggaatcaatcaatgaacaaaaagctcaccctgtggacacgtgtcgggctctggaggcccccaagcgtccgcgtcaccaatctcgaggcggccaccgcggagcccatgcttacagcctggcaccggtagtgacgccagccaccagcgcagcgcgcgccgctcgctcgctctgcggcgcaatctgtgaccccacctggcagtgacacggcgcctccgcgaaacgcaacggctaaaacgtggaaggccgcggcggcgtcgcgcgcgcgcgcacgttgggacgtcggggagggaagcggccaaggccaaagacgtcgtcgtgggcagcagctggtgaaaaaaaaaatggccttcaaaattcgaagcggcgacgttatcgctctctcgtcgtgagcggggcgtcgtcggctccggtggatagtcaacggtcgacgcgaggatagttcaggagcggataatagttaagaaatcgttgagattttaccggcgttttttctcccagagatggttgcaaacgcagttgatttattaggactttaggtatatatatgtaagcttttcctttttctcgcgacatgtggccttgtttctgttggccgatcgtgatcagcgtgcacttaccttaggaacgggtttttgattttgggattaaaaatgtccttgatcagtactacacatgttctcacctttttagttctcatttctgcacgagttaaggatagtcaagatggttacgatcgcaaggtgagtggatcaaccacactctctgtcatgttaacatcttgctctctctctcttttatttactgtcaaggcgccgtttactttgtaggggtcgtactgttcatatttttcctttcgtgcatttgacgacgacttctcagcaataactcgctgcctgaacgtgtagtgttaatcatgttactcgcctacaaatggaaccggaactctggaagagaaaaaaagaagtatttgcgagaaagaagagtagctggaaatttgatacggtcgttttagggttgaattgatatcagatcctaaattctctctccaaaccccatactaattcggcaggatatctttcacgataagtactttcctgattcatctccttatctcaattaaacgataaatatctcaaagaaaacgtgttgagcggaaccagattaaaccgaaattcacaacaactcccaaatgtcgcgcgaaatatactccattttttcttgttagtacggaacaaaaacaaacacgaaactggagctgactgagctaaagagcagtaaaagaagcgatccgcttgacggtgactattacggccgctgccgcccagaggcaccacctcacctctccccttccacttcgctagcccgcttggcttctcagagcctggaggaaaaaaggaaggtgggagaggcagcagaggcgaggcgagggagcgagcgagcgagcgcccgaatccccaaaatcgcagcgcgagaataaacaaaaccgaagcggcagcgggagcagcagcatcggcggatacaataagcaaggggagcagcagccacgggcaggagaggagagtgcgcaggcgtgcgggagggaggaggggggaagaagaaaatcgcctgcctgccgccgcggtggtgggttggtgggtgccgcctcctcctgctgctgctgctgttcccccattacctcgccccgcttcgcatggattccccctcgcttctcccccactccacccgccgatccaccggccggggcagcgcgaggcgatgcaattgaggtgaggtgagaccgccgcttcttccgtcgtcgtcgcgtgggttttttttttctctctttggtgctgggggatacaacaacctggcggccgcgctgccgctggacgacgccatcgcgcgcctgcacggcgtcttggggtggacgaggcccagcagccgcggcggcggcggtgggaggaagaggtggccgcgcgggggaaaggggagcgccatgctgtgggcggcgcgggtgtccgggttcttctccgccgccatggtgatggtggtgctgtccccgtcgctgcagtccttcccgcccgccgaggccatccggtcgtcgcagtttgacagccacgtccgcttccctggccagatcgcggggggcgccaggggcctcgccttccgtcgcgcccccgcgttccgcaatgccgctgactgcggcaacgccaccggcaatgtctgcgacccatcgctcgtccacatcgcgattacgctggacgaggagtacctcaggggctccgtcgccgcggtccactccgtcgtgcagcacgccacgtgccccgagagcgtcttcttccacttcctcgtctccgacccggcgctcggcgacctcgtccgcgccgtgttcccgcagctccagttcaaggtctactacttcgaccccgaccgcgtccgcggcctcatctccacgtcggtgaggcaggccctggagcagccgctcaactacgcccgcaactatctggccgatctcctcgagccctgcgtgcgccgggtcatctacctcgactccgacctcgtcgtcgtcgacgatgtcgccaagctctggcgcaccgacctcggcggccgcaccgtcggcgcgccggagtactgccacgcgaacttcaccaagtacttcaccgacaggttctggtcggacaagcagttcgccgggacgttcgcggggcgccggccgtgctacttcaacacgggcgtcatggtgctcgacctcgccaggtggcggcggacgggctacacgcggcgcatcgagcggtggatggagatacagaagtcgccggcggggcgcatctacgagctcgggtcgttgccgcccttcctgctggtgttcgcggggcacgtggcgccgatcgagcaccggtggaaccagcacggcctcggcggcgacaacgtgttcggcagctgccgcgacctccacccggggccggtgagcctgctgcattggtccggatccggcaagccgtgggcgcggctcggcgccgggcggccgtgcccgctcgacgcgctctgggcgccgttcgacctgtacggcccggccgactccgccgcggaagggtcccggtaaccgcaacactaaagatgattcttttccttctttcgccgaccccgtacaaatttctgagttctcaattcttctccaccattacctgttcaaacacctacatgtttattttttcttcatttcttctttcttttgttctgttcgattaaatgccttgtgttagattgttcttgttggtattagtgatctcttcttccactttttttgatcgttttgttactaaaaaaagaggtcatttgtatcctactctacaggtttggaaggcttgcagcctcagcatcatcataaataaaaagcacagaaaaatagacattgcagcagcatgtgttcttcttcagtcgctcctctttctcccctctcaatctgtttgttggcttcagcttcagcttcactctcgcaattgatccacccatccatcaccaagaagggtcagccgatccaatgcagcaccgcacaccatcactgccgccattgacaggttttacactaacaaagtctaagtcgcaaagacgatcctaaatcgcaatcgcggacaagagtaacttggaatccacgtctttgtggccgtgcacgaactgacactaacaagcatttcgacattaagcacttgcaggtgataattatagaggggggcgttgccgttaagctctcgaggattaaaggggaggaggggagagacggagatagatggccggtgggggcggccaacacgggacctgtgagctaccgcccaagatcatttctttttctggggtcctttccggcggggcctcaccacttcggcacactcacacaccctctctcgccgctttattcttttgcaaaatcattattgtgctcctcctctcacattgccaatgccatatgccatcaaagatttcttttctttaatgttcttttctcctccttttcttttcgcacaaacaaaacaccccctcaggctcatctcacctcatcttcaccacaactctatagtagaggcgtcaagaaccttttgttttttttttattgatcatctcactttccttgccagctcgcacttagcatcgacttgtcgccctccgctaaatgcgtccaaccaaaaaatataaatatatatctccccccgcgaccgcgaggctgcgaagattgtagaagaaacatttcgtgtcatttggtacatggaatcgtcctcgtcgctggcaggtggggccatggtgaagggcacgtcccagctcggcgcgcccgccacacgcgtcggtctccgcccgtgccaggccgcgggcgagccgggccgggcgcgggtgtggctcgcgcgaaagtgatggtctaaccgacggggttcttttctgactttacccgtggcttaatcgcctgcttggattcttgctgtgcttggagttggaattggagtctgttcgtaaatcggattcgctgtgatgaatctactccgttgcgtgccttgcgatcgaggtgttgtgccgtataaatgtttttttctttcctttggtgggggttctgacaggtacgtgcttctgctgctgattactactcgattttattcgtaaagctaaagctaatcagcacctgattgactagttgtgtgtgtgtgtgttttcgtactagagagtccgtcgcgcctaatgtccttgtcgttccattcatgctcttcaatcaagctcattcttaattgcagacgatgctgatttctgttggtagtaatattgttagagaagaggggagccgtatttctttctttgtttctgtcttttgtacactttaggttaacaatgccagttgctgtattgtagtatcatcaccgaaaaagccacaccacctttatgccgtacctccggcgaaactgtgtctctttctcctctcggtagaaaaaggccctcaacaaaatgttgtgtcctttccgcggaaaccctaaaaatgtactactgcgcagtacagaataccggtgctgtctttctcctgacccctgtggactgtggagtgccgtattgtgatacgctattgctcgcccacgatggacgacggaacggatggagacggccatggagggggcggccgcccttgattgagagcgaactgcgcgccgtggtcctctcgctagtagtctctcctcgccgcctgatgccattggcattggcatgtcacgcggcggcagctcacatcatgggacgcgcggtcttctctcccgcctcgttccccgtcggttggcatgtccgcgtcgccgtgcccggtcgcctccgcgaccgcgagtgaaaaggaggttcacgatctagtagtttttgttgccgctgccgccgaagcgtaatactccaacgtgatgcgtcgtgacgcgcgtgctggtagtggtaggtaggtgcgcgcgcgcgcggccgccgtgccgtttgtttctgtcgtcgaggaggccgcggcggcgcggccggctcggtgaggggtgttcggttttttgcctagattttaccatcatttagcatgatgtgcagttgcatcaacgtatggacggaaggacctggaccacgggggaagtatgacctttggagtttggatagttgacccttcttcattagccgggctaggttggttgcccacaagagagggattccaaaatgtggggataggaacacatgctgttgcgttgggtggatctgccaggaaagaacggtcgatgctgtttcagggttcgcgcgcggtagccatgttccgtggctggggggtacattcctgtttatcgatctgtggctgttaaagattttccatcctgggctgcttggtcgctttggatcgaatgtcgctgctgaattatgcctggaggtgtacggtgaacaatggcaaggacattcccaactattgtaaaacgtgcaatcatgctgcctataggtcgggtgacgaggcatgcagcaatatgtttgggtaaattccagcgtattccctgtgcaatattgcaacgtaatccgcatgctttgcttgtccttgccgtccatcagccatccattcttttgctccaaaaaaggtcgaatatattgccatcatagatgcaacaggcaccttccatgctccaatgattccatccaaggcttatcatcaccctcgtccttagcaatggtcgccatttgtaattcacccaaatctgtgattgcaatctaatggagagaaaatctcttgttcatatcaaaggtatcatcaatccgcccccacgcattagcataccgccattcatgtcccgtttatgccatggaccgctgataagaaggacgtagatacatccaggacaagttaggttaggcccctgctacatgatctgcattgcacgtatgcggataaggctggaacattttggtgtacctgctctccacagaactaaacatgacaaagccagaactcttatctaggtctccctaccaaccatcactggaattttgttagcgagtacaaaccgaaaagaaaaaaaatcttaaatcgtttattatactatagatattagcctgtgttctatgaaatttatgacattatgtgatacaaatgagcctgaaatattggtgagcttgtcagagcaggtaatagcaggttataagccatctataaatatattttaaagagataaataaagagagagaagagcagcgggctacagatttgtagccagctgcagcacagactccaaacgtaatgtgtatatgacaggtgggaccagatattaatagtatagtaagcaactattgtatgaattggctattacattggctatagatgatttagagctagtagtgagctgtaatattgaccttgctcttagagcaagtttaatagtatagctcactgcttattattagtcaatgttaaagctaacatgtatagtaggttggctataagatcatttttattttcttcatcctctctctttctctcagtatgaatttaatgcatatttcttgtagcttgtgtatagtgagctcttacatgagagccaatacaccctacttttgtttatctctctcttccacataagcatatagcttgcttatagcccactattatcttgctcttatacgtggtcgtccctacgtactctgcctcgggaaggggggctcctactccaagtcacttgcagtggcagcaggagtcctccagggttccaggctgtgaagccagcttatccaaggctgtatcgctttgccgccgcggtctccgccatcttccactgcgctgccgcttgcacatgcaaatatgcaatgcaatgcaacgtctcttatcctaatcgctttgattgcctcacactcccctaatccccttcgtaaatcccaatccttccccaaatgcaagtggatattggcttaattcctacgtgtctcaaatgtcaatactatacactaaagcattctctcgagccaagggggaccctttggccgctttggactaactgcaggggaccatgacacacatacgaccctgcagtatggtcgtgtatatcctagccgaaaatggttggtatgtgacaaactatacaggatcagagaggatgagaattgcgtgttgcaagatttgacagatatttctggaagaacaaatggatcaaaggccacctactcacctgataacggcttaattagtccatggggatcgaactcatacgcctggcagctgcaagagaacagtagtagggtccatgtatcgactctatcatctctgtgttgatgctgagattgctggattgcagttgaaggggacccatttcctctcgctgtccatttcttttgtgtacggctatatcaccatctgcatctatcgcgaccgtcgatgatgagatcatcggctgcgagttgtaaatggacccagaactgttgatcgctaaacaggacgacgtgtgtgtatccaccagggtttacaatctcgtttggcgattgaaatgtgagccctagcaagttgacgagtcttgtgaaatatttgagcaaaaattaagaatttcaatgtaagttgaaaagaaacaaaatgtgaatataaattttcagcgactgtgaatcaagtaatcaggtatgaaattcgattaaaatcctagaaatttggaagtattagttagaaaaaaataaacatgaggcgataaacgaggggatcaatagcccaaattaaattcaattatgttttcctacaaacagacatatcgcccaaaaaatgtgagaaaaaaaattagaaaatgcaggagaaatgaggagaactttaaaatatgtggcaaaaatatagtacaaaattaggaaaagggatggggaaaggtggaaaattatgggaatgcgtagagaaatgtagaaaaatattaaaccaaatattaccagttccaaagtataaggaattttacataaacaactactttttgatgaaggtagtatcattttttgggggtggttggtagtatcattttttttattgaactgatttaattccacttgatatcaaactgtttataggatttaaaaaaacatatttctcatttttcgaaagggtagatttaccgtccttgataatgtaccgagaagtaccacattttctagtgtaaaatttggtacctctagctactaagtatcatatgtaccaaaatttctagtgtaaaatcttgttatctctaagtactaagtatcttatcttaatgtatccgaatttctagtgtaaaatattaatacctttagatattttctcaagaactgtaaaatttctctatttgaaatggccgtagtccattcgaaattctagcgaaatgttgtttctatgtggatcgagaagttcatttttgcgaaatgtgagaaaagtttcagcaaaattacaaactcttatagcatctccaacaacatctccaaatctcactctccaaatatgcatttagccaccttgacaaaaatttggatagtcaaatctgcctttcactccaacagcctctctattacagttctccactgtaactgtgggtcccacgtgtcagttttttcacccttcttctccacccccctctctctctctctctcttcttcttcttgttcttcttcttcttcttcttctcctctcatctccgccggctgaacccgtgcggtggcggaggtgctgtggagcccgcgtggcggagaagggaaggcggcagcgagggaggcggtctgccggcgggagcggcgcacgcgtcggaggcgttgtggagccgcgcgtggtggagaagggaaggcggcgaggggggcggtcggccagcgaaggcgctgtggagcctatgcggcggagatgggaaggcggcggcgagggagacggtcggccggcgggagcggctgtgtggcgatgggaaggcagcgacgagggaggcggtcggccggcgggtgcggcgcatgcagcgatgggaaggtagcagcgagggaggtggtcggctggcgggaacggcgcttgcgcggaggccgatggcaacgacgagggaggtggtcggccgacgggagcggcgcttgcggcagaggccggtggcaatgacggcgcggcggaggaacggtgttggcggcgcgcagaagggcggcacgcttgaggagaggcggacggagtgagaaatgggtgggcccatgcgtggggcccatgattagcaaggcaattttggctggccatctttggccaatgaggggagccgaccattatattgaagaccgagtgagccgaccaaggcagtcttaaagaaataggagtactaattagggcgtatggtttaagttgaggcgttcctttcaccatttcatactcgtgataacattgctggccatagcaggggttttcctgagcaagattcgtacagctgatcgctctctcacttactagaaaaatagagaaaaataaaaaggtgacgcgcgatgtcatggcacatctgtgcaagcgatcaagttaatattaccgagcaatcacaggcaggttgtcgacgccgacgccgacgggccaggcccggccacctacttcgttttgtagcaaccaagcgaagtgtttaagcctttttgtcacgcaatgcagtctcgacgacacagctgcgacgttcgtgtcacggctcaccgcgcccctcgctaaattgttgttgagcgtcacatgaagccggcagggccggccggtggtgaatgcttggaggcactcacgagccatgcagaagccaacattttgcgtacgctaacccatcattaccaacatgtacgttgtacagctagtcaggagtcagccactagctactcctgtgcatatatatagtaggaaaaagtatactagctgggaacaaaccttaataaaactgcgtgatcggtgaccgatcaaccgacagcgtgacagcgccatcccgactgatgaagagcgcggaacagaggcgaggaggcgagctgctgcatgcaggccagatcttgtgttgatactggcaacgtgcagcgcgtagcgcacctattagtgtccagcccacgccgaggcaattaatcaggcaaccgacactgccggcgagacggaagtgaaacccgtgtggcaccgtggcgcgtcgtcaggggacggaggctgcgagtgcgagacgatttgtgtcccctcgcgtgcgtcgtgcgcgcggttgagaagggggcccttgctggctgctgctgctgttgcaacagcgagcagccccgcgtgcgcgatcaccgacagggggatgcgcggatccaaggcgcgggaggacaaatgccgggcggcgaggcgtacgcctgcctgtacgggtgcggccggcgacgaaccgcgcgcgtctgcagtgcagcggcaaattattttagctaaattattttagctgccacgacaaacgtactccctccatctcaaaaatataagtatttttaactatgaatttagataactttatatccagatttataatcaaaagttattatattttgcgatgaaggtgttagcatcaagcattcattcggtaggttcagttgcttgttggaccgggctcgctaaccgaaataataatgtgcattgcttgaaacagcaaaatttgagtggattttgagttgtaggaaaaacaagcgtcaaatattgagaatagaaaggcaaacattggttctggcagtgagctttctttttgtacgatcagcttcaccatttttctgtaggagctggggtatataggatggatgacgagggatggttgactggtcaacttcttcggttggagcagtactaggcatcagtacgaccataaatatagtaacccaacaagcaacaggtccatgtgcagtttgttcagattgcatagtttgagagtagcagccagccagccagcaagcgtcccagtgtcagcaacgtgaaggtccaggaaaaacggaatggaacatgtacacaacaaaaggacgtagacagaaagggctaattcctgaacgttcgtgcttgttgtttttcaccgtgttctaccttttcactgatcgaaaattatgcactagaagtttacaaaccaaaagtttgtacgtccaacttcgagtttgattcaaatgttgctacatcaaaagtttctacatgtaaataaattttcttgtagaacagaactcacaatgaaccaagcacacgtgaaccgagaatatttaactatttaccactcttagatttagcgtttaactatttgaaaataatgtgtttatgacatgcatgttgcaagtatagttaagtaccacacttagagcagatacaatagcagactataattcaactataaccacatatcgagaagaaaagagaagagagagaagaaagggggctacagatttgtagccagctgcaacacggactccgaaatgttacgtgtgtatgagaggtgggaccgagtattaatggtgtagtatatttttatagttaactattttatgaatgagctattagattagctatagttgatttggagccagtagttagctatactatctaagagcaaggctaataatacagccgacctattgtctataaggttctttgtagtcctctcttggcctacccatataatagttagctctttacaattaatacatgatccacttgtctctctcatagtgtttcttggttcttatgtccaagccggctgtaagtttacagcccgcttcttctctctctcctctcttttctcctcaactcagcatttagccggtttatagcctactattatacttgctcttaaacttgctcactccccggcacacaaaacgaagcaacgtttagcgcgagattaattaagttgtagctttttttagaaaaaaggattaatatgatttttaagcaacttttgtatataatttttttttaaaaaaaacacaccgtttagcagtttgaaaagtgtgcgcgcggaaaacgaggaggggagttgagaacggcgggaactaacgcaggctaaaagtgccaaatagttaaatattctcgtgaattgagccttttgtgtccttgcaaaatcgtacaagaacatatccatctcgaggaacaggaatatcgccgaggcccatgagtttcagccgttggcagtggcggcaaggtctaggcttatggaagtatacgacttatggatgagtagcccaaattggttgaacagcccatataagatgcatacgtggagatgactgggcctgctacgaactgggccttgtaaaaagctggccctttctgaacataacttttggcccacgtatatttcctatccgcatatctttccggaataagtctaattttccatcctggaaatcttatacttgatcaaatcacatccctcatccgtaaaaccgggtataatacctctcccgacataaaaaaccaatacagattgactcctttaatggtttgtaaagtagtttatgctgacttggtccaagtatactgttgtggcagcctaggcactaaaggaattgaaaatagaaagtctccccacatatatgtgagaaagggtaaaaaaatggagggacccacttattagcctcacaactcctctcttagtcttgacacgtcgccctggtgtcgcaatcaccacagaagagtgagtggttggtgggcagaagcggacggtgatagtggggacacgtagcgcttgtgatgatgatggtcctcgctaccacgcgtgccgccccgtcatctttcccccgaggctgtccgcacaaatcttgccatgctacgtgtcgccgatggccgtccacaacttacaacgttgagcctaggggcgcggtgtgcatagcactattgcccgctgtagaaataggcacgaagcgatgtgaggttcttgtgatggagagtggtgatcgcgactaccttgttgcgaaactcccgttatggaataggcgcctagcagagttgcttgacaaccatgatgttgatgccacccttgagccgccaatcaccacctgatgcataataacccgccctctagaaccacaacccgacccttccgacagcgcgggaccacttacgcatatcaacccatttgcacttcatgatcacttcgtgtaaaaggttaatttgggaataatatggttgaagggataagttgattcactattgctcaattagcaaggtgatactaatttgagccttgttattctcttgtcccaacttatgcggggtttgaatttgtcgagttgtaccagtgccctaaacctaagtattttattgatcaggcaccacccatatttgaattggattcaactcgctctactagcaaggtgctactaatcaagtgcatagaggattcatggaccacacatgtcacatcccaattaggccggtatgtcaagtacatctcttgcaaaggagcctacatttctgatggttcaacttacctacatagccacacaggtatatatacaaatgtccaggaacgtgccccctctcagcggatgttcgtgcgtccagcgtcggcgccatatgtctcgcacagaggtcacatgcgccatgcatcatatactcatatgctcgcacattaacccatatgcacaaccgctagggtcggctataatatcatttgtaacaaccctgtcctcaacaaccacgtagcccaatccatctgacagacaagtcccacttacacataccaccccacttacgctttcgtcatcgcttcctataaaagagttaattcaggagtaatatggttgaagaaataagcctttataagttggttccactcttgctcaattagtaagtagatactaatcaattgcacacaacagtcatgggccatatatgccacatcccaattagcctaggatgtcacatgatgcagacgaccaacaccacagcgagagcactccattgagctcatggttagtgaccatgacaggtcattggcgagctgactagatgggttgcatctatggagtatttttaagttctcatctcgaaagaccagaaaacaaaaggatttgagacaaattgacaagaaagaagagcaaacaaaggctcacgagctcgtgtttagcgtgacgcccagcgagactacccatgtcggcaagggaagagggaagtgaggagagagagaggggtgacaaagaagatgggatgaggtgtaaatcattaacatgtgggactcacctactgattcaagtatgtcaaccgtgattaacctatcaagttagcataatccgctttcaaaaaccatcaaaagagataatttgtaccaattttcaaaaattaatgagacgttatggtaattttatgattgagggagacgatttaatcaaagagtaaaagataaggaagagggagacggaacctttgctttccttgctcatttcggggctaagggcagtcccaaccctccacctaggatggtgtctacagtattaactacattgtcatgtagaacttttagcttatgttgcactatattaattaagagagagagtgaagagaggaagaaactgggtctcatgcaaggcacaacttcaacacgagaacctgtgcactagactgggagagaatagtgttttcataatagatgaagaataaatatgattggtagagaagagagatgatgtatttattagtagcctactttaataaaccatgggttatagagtgtagtttctattgtgatgtcttattaacatggcatcatagacactgtttatggacgctatgggttgggaccgacctaatttggcctgatacacttgtcctacctaggttgcgacgaccacggagacaagcaccctctgcatgttgcacacagagacggaatcaacggcaatcacggcgatgaacgtgagaccacgtccacatgtcgcggcaaactagcggaatgaaccaataaactattgacggtacaaaagtgaagggatcgcggcacctgttcgggccgggattcagctcatcagctggctccgccgagtgctcggctgctcgctgagctgaggcatcatcgagacgtacgggtacaaaccgcgacaggtcctcacatctggctgggtcacaggcagaccggttcgacttcgtacgtgcacgccgcacgcgacgttcctgcttggctccggtacgaggagaaaatctcacgtcaactcgatcaacgtcgagccaccgacccccgtgcgaacacgtcgttattagcaggcgtgcatagataatactcctactatggacttgttctccgtgttgcttatttatgttagtcaattactctttagcttttttattcaccgcaatagatggaagcctggacgagtaacaactaacaactcatgcgcaataatcctcatcgatttgttagcaaaaactgcttgattagctacgcattttgcttcgttttcgaccccacatcaattttccatttttccttcacaccggaaccatcgcgaaatgccgaaatcctcatgaaccctctgctctgcttgattcaccgagtcatcaaccgaccttgcgcagttgtgctagctagcaggagagcaccctgcacgaacctcacatgtgtgggcggtggggtcacccgaccttgccaaacaaaacgtctcatcggcacatgcgtgggcccacccatccatcccaagatcaaacgccagcctgatatctgaccgtccgttcctgccctagctagcatcggacggctcaccccgtgtctcgccacgcggcccgaagaagaaaaaccctaccgtttgagcagtctccgctccacgggcccactcgtcagtgagaagtcgcccagttaatcatcgcctcatcggctccacgctcctcgtctctctcggccggcgtcgctttccacgcccttttgttcaaaaaccacacagttttttttttctttttgagtttttattagcaaggggaaaacacggagacgaaggaagcagccagcaagctgctgacgcacgcggcgccgctcccccagttcaaacccaccaggccaccaccaccttcccccaaatccccagctgtgtgtgtgcacgcggttttccaatcgattcttcttcttcttctacctcgcatccctccccccaaattcccgcattcgctagctcctgattcggccatggcggggtgtattgttgttgtatttggggttctggtgctggtcgcggggatggcggcggcgcaggggcaggtgccgtcgccgacccccgcggcggcggcggcggcaccggcgcccacgccggactgcaacggcatcctgctcacctacaacttcgagggccgcgccaagatccggccctacgtggcggacaggaacaagcagccctactcgttcagggccaacgccaccgtgctcaactccgggacgcgcccgctcaagtcgtgggcgatgctcgtgacgttcgggtacggggagatcctcgtcggcgtcgatggcgccgtgctcaccggcggcggcgagatgccgtacaacaccacccaggacgccggcaacgcgacgtcgttctccggctacccgcagaccgacctcctcaccccgatcgccaccgcgggggacatctcgcagatccaggccaaggtcggcatcgtcggcacgctcttcgccgggccagggccgttcgtgccgctccccacggcgctgtcgctcgacgacccggcgtacaggtgcccccaggagaccaatgtttcctccggggtgctctccacctgctgcgtcctcaccccggaggcggaggccaacgccaccgtcatcaacgccaacgccaccgacccgaccaagaacttcctcccccgcggcaccggcgacctcgtcatcacctacgacgtgctccaggcctacccctcgagctacctcgcgctcgtcacgctcgacaacaacgccaagctcggccgcctcgacaactggcggctttcctgggagtggcggcgcggcgagttcatctactcgatgaagggtgcgtacccatcggagaaggacacgaccggctgcatctatggggcggcagggcagtactatcagagccttgatttctcccaggtgctcaactgcgacaagaagccggtgatccttgacctgcctctgtccaggtacaatgacactcagattgggaagattgaccattgctgcaggaatggcacaatcctgccgaagtccatggatgagacgcagtcaaaatcagccttccaattgcaggtgttcaagatgccaccggacctgaaccggacaaagctcttcccaccggccaatttcaagatcgccggtgcatcatcactgaacccagactacacctgtggccagccggtgcccgtcagtcccacagagttccctgatccaagcgggcttgattcaacgactctggcgatcgcgacatggcaggtggtttgcaacattaccacgagtaagggggcgaagccgaagtgctgtgtaaccttctcggcatactacaatgattcagtgatcccctgcaacacctgcgcctgtgggtgtccgtcgaaccagcggggtcctacttgcagcacgactgctcaatccatgctcctgccacccgaggcgctgcttgtgccattcgacaatcgcacacagaaggcattggcatgggccgagttgaagcactacaatgtgcctaagccaatgccttgtggtgattactgtggcgtgagcatcaattggcacatatctacagactacaacaagggctggagcgctcggatgacattgttcaattgggacaatgtcgacttggcaaactggtttgctgctattgtcatggacaaggcttatgatggttttgagaaggcgtactctttcaatagcacatcagttggcaagaacaccatcttcatgcaaggtcttgaggggctcaattacctggtgaagcagaccaacatgagtggatcagactaccttgtgcctgggaagcagcagtcagtgctctcattcaccaagaagctgactcctggcatcaatgttgttgctggagatggtttcccttcaaaggtcttcttcaacggcgacgagtgtgcaatgcctcagaggattccaatgagcaatagtggattcaggacccatctcagcagtgtcctctcactggttttggtcctggctgcttcggccttcgtattgcttcagcaataatcctggccgttgctccgattctttcattctttcaggtggttggatcgacgccatttgtaagaaacctttttgtttctggcggtttactagatgcgtaatggttgctatgtagcagaatctggcagcaattgtgcggcgagatgaacacatagggggaggaaacattgttgcagacttgcaacatagcatcaggatcactttcctgaatcctgatgatatttattactacatgtttacatcaagatgagtgatattgtacatctctgatttaagttggtgtagttgccaggaatgtcttatgtttagttatgttatatacaaaatacattttgccatcaaaccgtatgtctgctcattttctgtctgcttttctgaagctaagctgctctcttcagtttattgtcataccatacgatacatggtactagtaattctgaaactgttgctcttgcaagtgggagcaacattggatgcttcttaatcagatctctacagtattaaatacgaactaaatgaatgttcgtatgcttcttgtatacaaacttcaaaacatgtttggaggataacgctcgaaatggccgttgggttagctggggaccacagcttcagtgccaatgtaatttcaaaccatttggcaactttgcaagcctatagtttttttgcaacgttcaggtttcaaacagcaagaagcctttcgctttcttgaaagcaacttgcagctgacaatcttatgcccttctttatgagcattgaccgaatcaaagaaacggacgatactggtatacaggatagatattgttttctctagtaatcttatgacatcgcacacttcagttaacagcaacgtccttttggttctgaccatctcctccatccagagagtccagacttgttccgagttgcagctgaggaggagtagcgtattatcatctctgcacgcaatatcaatgtgttatatgtccatgtcaaacctgagataacataactggcacgcacgatcatgtgtttgttttatgcttatatgcatgcaggattggggtggtttgttcgtgccaggtggtggaacgcaacaaacaccgtgttttagatatagactgcgttaaccctggggactaccgattgctgacattttctaactgtacaggctgttgatgttgtcaaaagctgatgtgttcaaaacctactatgattcttcacgtgagagcttgtccacacggtaccactgtttcatgttttagtcatctactagttgtgaaaacaggaggcaatgtaattgggtggattgacaaaatgatgtagctgcattgctcagcaatatggaaatcgaaggtccagcaaccaaaatgatctggcatgacggtacgaatttgacgaagtgatgtactgctagatgtagccaggactgatggcactaacatgctgaaaagtgatttgaggaataaatattttttttattgattcattcatgcggagcatgatgctgcaaatcctgcgctaccgttggtgcaagctgagcatcatttggttgactttcttttaacacatgcgggatgttctggttctagctgatctttctccttaagaactcagacgtcctggcgttaatgctacgagtaaacatagacttcttgatggagtcaaaacccagaacatcctccccaaaaaaaaagtcccctatgccgcgagttagagtctcatcgggtgctcatacaaagtatttcccaataagccgttttggcttattagaaaataaaaaataatatatttgttcgtagcgatttaaaaaccaatattaaaaaaatacgttgaaaatatcttaaaatcaattttaaaatttagtttgaaaatttaaattttagcttttactttgacttattaggtcaagtgatggggttcacactggccagtgatcacaaatcaaagtgacggtgatgtaaacgtgctaggggcaatattccactggaaacttctgaaagtagctgattatggtcgttttgaaaagtacagtgtttgttagcttctgcttttctcgttgatctttccttcagcgagaacggtatttgattcttgatttctaagtggacgcaaagagaaccaaactagagcaaatctcaagtcaatgcgatctttgctatgcctcagcttttccaacaacgaggagtcccacaattgcaaatcggcagtctccagttctccaccaaggtttatcttaccagcagcggaaactgccggtaaaatttggtaaattagttcgaatttagatttgaaaaaaaaataaaaaaataaaaaaaatcatataagtaataccgagtttgtagttctatctgataataaggttctatgaaatgtactaagttaactccatgtattgcagccgaactgaaactgagactaaaattagaaaaaatagacagatgggctaggccaatagtgaacactattcatgaagcccattaaagtccgcttgagggaaaaatgtgattcctactttatttcaagacgagcacatgataccattcgaacgagatacttttatggaggctaacgtcatcctgcccctactcctcgtgcttgcgtcctcgcgccttgagccagcgcgacagcagtagtaaggaacaagggtcaagtcgagaaaaaaggagaatatgagaggagacgctgatgcttggtacttgctacctcgcaagtactaatcctgccatcctggtacctagggtactatgtatgatacctattgtaccgctacgaacgatatatcatgtaacgtacctgcacaaactccaacgagaagcatgatggctcaccgtcatgtcgctgccaatgaaaacaccatatctagaagcttcattggtcacacccttccatcactctcgacaacatgcctagaaggaggaggttgagaagcccacgccaatcaacgtccttcctaatggcttcacttcttctgattgcccctggttaccatgagagctagattccaatgggtgtcgccatgcctcaaaagcatgagatggaggaggccacgagattggtgccgtccactatccttgttgccgacatgcgctcggactggatcaaagcagtgaagagggcccatgcctctagatccgttcttgggggcttgctccaccattgccatgtctacatagggaagctctttgtggagaggaggagaggggaaaaaaggggaaggaggggaggataacgaaggctcgaataagactgaatcgttatctacttatcccatttccatgggattttgtagagtagttttttatgttattttaattttcaaagcatagcaaaggtcatgccaaaatatcacgcatggctcctaacatcctgttatcttttctattttctattttttccctacaatttcttagttttctacaatttatagttttccaaatagtatatccgtcccaaaatatgttcatttttcacccatcaaacacatatcaataaaaaaagattagaaaaccactactttatcaaatcacaatgcaaccattcatcactttatctattctcaatataattattccctactttcacaacttcaatgcaatgattacttaacaaataaagttattttatgataatgaaagaagctaaaacaaatttaatatgggatgcataaagtattgcgtagaagctcagaaacctagtcaagactcgagaggcggtggcgcgtcgacttagccgttgggtaccagccggcagccgctactatgcggttgttctgtgcaacaccaatccttattattgccgcagagaaagaattagagacgaaacgagatgaattcggcgtccacccaaaggaataagttcactttaggtccctctatttgtcgctcagtctcattttcgtccctgcagcacaaaaccagatacaacacatcccccaacttacaaaaaccgtgcaaacaagatctctcgcgcggtatagtccctggttttagctgacgtgacgcctacgtggcgtttgacatggcaaaaaaacctaggacccccatgcaagtgattgttcgattaaaaataaattatttacggtgggacccacgtctcctccagtcctcctccccaatctcgctgtctcctccccaatgcggcgacccagcggtggcctccccatctcctcctcctccgggatccatgcggcggcggctggaagggtgggaggacgagtagtggccggcgaggaaaaagggcagagcttgccgacctgtagacgctaggaggggtcttctcctcagccgacgttgtcctcctcacagtcggcgccgtcctggttggcttcctctcagtgtccgtagcaaccgtcttcgcctcaccggccgccattctttcctccatggcgccgcctgctgccaccttcctggacttcgagacgatggaaggggcctttcgttggccggctcaaaggagcccatcatctcctcgaggtttagcgagctgatccggatgacgtcctcggtccatccccatgaggtggtcgacggtgagcggcatcttcttggccatgacgaggtcgaagaagttgggattgacgaggttgggggtgatgggatcaagtgggacggctcccatgtagccgtcctagccgttgcagaaggcggtgatgttggatcagtaggtcatgtcaatggggccatgtcgacctcgatgaagaagcacttggccttgccgatggagtggccgccggtgaggacaaccatctcagcagtgggcggagctgagggcggagcagcgacgggccgcgggcggctcctctcctctcgccggtggtgccccgcgtccctccggccatcgctgtgacttcgcctgctccggttgccgcccaccacgctccgccggctggagagagagaagagggagagagaggatagacatagaagatagagagaagatggtagtgagagcaaccacagtgtttggttcgaccattgtattgatcgaagtcgaatggagagtgaaatcgatagctgcagtgtgaaatcaatttgtggggccataaaaagaatccatcaatcaatcagtgtgtctaatttctatgtatgtatggacaacaaatattttttctccctagagttcgacttcaacttagagttcgatttttttttctgacaccatgagtcggctgccacaatgtgtatggttcgcttttctccgccttaaatcgattttactttcacgctggagatgctctgaggatgatgtgtgggtccacatagggcccaccttttttattttttgtgtgaaactgacatatgggtcccacgggttttattattttttttatctaattatcacgtaagcactacatcaatgatacgttggacaaagacatagtcaaaaggagcctcataggcgccacctcagctaaaaccggacacaatactactgagggacctcatttaaacggtttcgtaagttggggacccgtcgttttgtgaccagggtccgtaaatcggactggacgacaaatagaagtacccaaagtgaacttattccccacccaaatcccccaacctcaaaagcccagcccaacaagaagcccacatctggagagagaaccaaaacggcacggaccacgtgcagagcgccgtgccttgaagcaaaccgaaaaccagccaaccatttcgaagccagaaaaacctctctccattttctgaagcgcacacacgccgtattcgctttgccacttgcggcggaagcgccactctctcctctcctctcctccctcccccccacccatcccccgcgccccacgcgcccacgttggcggtgcggttgatccggcaacagcgggcgcctcctcctcctccgcccccaaccaccacccccacccctgcggcgcccatgggtgtccgttcctgagcacaccccacgcttccgctccgcgcatctccgtgggtgggttgggcatataccttgcttcagtcgctttcccatctcttgcttcgtcctgccttcttctttcttccgtgatcccggaacccggtggtcgccgccgcctcggtggatcttgctcggccctgcggggtgctcaggtgcgtcatcccttcgctgccggtgggcattggcttgtgttgctttggttagtctctgttcaggcattccgtcgagcacctgtgctgcgttggggcattggaggccttcttgtttgtttgatctgtaattagctctggtggtgctccttttttttttcgtgcattttgattgttgtgtgtatcttcccttttcctagttttagcggtcctgaaaaattctgggttttttttttctgtgtttctttcagcatgtccccttcatagcaatgtacgctggtcatgatctagatccggggttggctacttgatgtgtgaaccgtgaataagtttggtaatcaagtgttgtgagttgtgatttggaatgggtttgcaatcatcttgtgtgaaccaagcatgttcactactcaaagcagggtgaattttcagcatgatgtttgaatttcatcttatccatgttgcctggttatcgttgtctcgttgatggtattctgtgaattacattaggttgcagaaaatgtttatacacttacctgcctggtgaaattgcctattttgtgtctgcattgtagtgatcgcatttgagaagcttatttgcacaatgtcctacacaaactgtttgaggagatatccagttagagccatctttccatacactaatgccatcctccgagcttctttggagaaaggatctccggaaaagtcactgacagattacaacagtatgcttcgtttcactgctttctgccctgattacagaacatatgtgctccttctcaaggcttgtgcaaaatgttcaaatatctatgctatcatggaaatccattcccatctcgttaaacttggcctgctatctaatcaacgtatagtaactcatctcttcaaattatacattgatcatggtcgcgtgatggaagcttgcaaactattttggctaatgctggagtggagtgccgaacccttttatggaaatttgatgctcatgggattcttgaagtgtggacagatagacaaggcatatcagattttcaagaggatgcctgtcaaggatttggtctcatggaattcaatgattgcaggtacagcaaggaactcgtgcctgaaagatgcaatgaatattttcagcaagttggtcaattcaggtctagtgcctgatggcttctcattctcctcagtcctatcagcttgtgctcaagctggtgcccgttgttatggtatgtgggttcatcaactaatggctgaactgggattggaaatgaaccatattttaagttcatcacttgttgatatgtatgcaaaatgtggaagaattgacgtggcaattgggatattcatgacaattaagagaaaccatgtctctgtatggaacacaatgattggtggcctggcagcacatggtcttggatctgatgcggtgatgttcttccgtgagatggaaagtgaaggtcttgttcctgatggggttacatttgttgcactcttgacagcatgcagccattccggcatggttgaagaggctcgtcaatactttgaagcaatgactacaaagtattctatcactccgaggattgaacattatggtgcaatggtggatactttgtcacgagctgggctactggatgaagcatatgacttggtaaagacaatgaatgtgaaacctgatgctgtgatatggagggcattactcagtgcttgttgcaggtaccggcaaactaaactaggtgagatcaccgtcaaggagatagcgttccagggcagtggtgactatacccttctttcaaacatctactcatctgcgaatagatgggaagattcagaggaagtatggaaagagaggaagaaaaagggaattaggaagagcaagggcttgagttgggttgagttagggaggagcacccatgaatttaaagctggtgaccgatctcatcctgacactgatggcatttataaagtgttgcatcggttatcaaacaaggccaagagtgaaggatatattccattgactgaactagtgtccaaagatgtctctgaggaggaaagagaagaaaaccttaccgtccacagtgagaagctagcggtggcatatagtatccttaagacaatgccaaggacagagataatggtgtcaaagaatctgcagacttgcagtgattgtcatgaatggatgaagatagtctcgaaggtactttgtcgtgttataattatgagggatagagttcgatttcaccgttttgaaggtggatgctgctcctgtaaagattattggtaattcctgttttggagacagatgctgctcctgtaaagactgttggtcagtactgtttggagaactacagaattgatttgtttagcatcatatcaacagttctgacaggaggtacaagtagaaccagtggatataactacattcccttgtggagtcatgggtggtctatgtgactatgccaatatatgacccctataatacatggtattatcattttgtctgcacagcaggtgacatgaaacaatggaaatatgggtaaaccagcgcacacatacatgaaattgtgtactatacacgcacccaccaagtatgtacaagtatcctacagacttgaagcctgtcacccacaatagaaagatcaaaatattatcttctggatttttttgtattttctaattgactttgatgctcttatggctttccatgtgtgtcatggaaaatttttactggagtatggcattttctgcacttctgccatcttcgcacttttttggttgctttcgtggagttgatgtgtcacaggctcacagcatatgatggctgctttcttttctgtttggttgtattcttgtacatctcttctccgactagtttaatttttccaactaaagttattctttgtttattgtttcaggattaacagtgaggggacattctgtattcagtaatatcaagtttctacaaataaataggtgtaggaatacctttgatgccccatttacactgtttgtgcaatgtctttatattatattttctgtgggaacttccatcaactaaggaattcaataggaagctgttctagtaccggtttgcttaaatgcggattaatctatagaactgtacttcagaacagaggaaataaaactcgaccaatcagtacgacaatactagcaagaagtacaagaaaagaaagtaagcagtcattcaaaaccagccgtcatttgcatagtgaatcggttgagtcatcgattgaagtgctcaaacagtcagatcttgagcatcttaaatcacttcaatgctacaatattccacaaaaggtttccggagtgaagaccgattggcctgcaactatccttgtttttgatattgaaactacaggcttctcacgccgctatgaaagaatcattgagtttgctgttcgggatcttatgggaggaaagaatagcactatccagacactcataaatcctgagagagagataaaaaatgcatatgttcatggtattagcagcagcatggtctgcaaacctgatataccaaggtatgacattttcaacagatgctcagctgatattgttaaattatttcttcttatgcaaactgtacttttcatgcaataaggaaagtatggaagtaaaactgtaaaagggcatccgagagaacagtggactagttgcaaactagatattgtatctttccttgcttgcaaccattgacctgccatttttttattgtgatgctgtcttctgaaaaaaaggttccctcttctagatattccgaaaattcggtgctagaagaaatgtgaactgatatcaaaattccatttcctttttctgggataggtgcctcttttaatcatctccctttagtataagcttcagtcattgagcactaggatgccaaaacttgattacgttggactttttatgttctgtaataattatagaagttcttttttctggctatgcagatttcgggagtttatccctcttctattacagtatgttttgagtcgtcaaatggctgataaaccagttctgtgggtcgctcataatggacgtagctttgatgtaccatttctcatgtatgaattccaacggagtaaaatagagatgcctggtgactggctatttgtagatacacttccaattgcaaggcaattgattggttctgatggtacgttcttttgtcaagtgttctgtttacttgcatgaacttaacttttctgactaatttgcactgctagagattagagctatatacagttcaccctgatattacagtgtaactagcaaaacaaactagttttgctattcaacttccaacttttcataagcattcatgtgattttaattgttatgttgaatcctgaggcaaaaataaagttaagttagcaatattaggtcttctctaaagaaagttcagtttttatcactggattctttttctttttttcttttttactgcaagagagaaggcataatatgggagcaaagcaggtgactgaaagtaaaaccttcctgttattttatttgcaggggaaaaactgaaatctgtatctttagacaatctgagggagcactacaagatcccattggcagggagcgctcatcgagcaatgcaggatgtgatcaccctctgctatgttctccagaagttgaccttcgagctgaaactaactgttcctcagctccttgagaggtcattccgggtttccgatctttcaatccctcgccctggaaaatgactgcagttgcctcgccgaaaggatcacacagaaacctggattgtttcattgtccttgtatccagtgctgttgtttcagatcccagctcatatgttattccgacaacagaataaggcaggcctgatcgttaccgtgatattaatcatttttagtttagtactgatacttgttgccccttgaaacattgattagacgtacatttattcaaagttgtaaagaccaaaacatgtcctggtttccaacctggaagaaatgaaacgttcttgactatctgtagtcactgtggtactcctgttccagacaattttatgagctcctgtgtgatagactgacatgtagaagtaacaaagagaaatttattctgcccttgttgagtaggagtactagcggagtaatctccgcaagcggactagcggagtcaggagctcagtgatttgtcaattcattttcatccatgctgggctgtaagcagagtggcgtatctagaaattttatgggactgggcaagcctaacaataaattataaaatgtacctaattatatacaaatctatagattattttggggtgagcatttgctttgttagttgtagtttgttctaagcatgttaattatgtatgtacactatactactgcttctgtcagtgacttagtaattaaaatgattagcaatagcaaggtaattaggattaatttactgggacatagctgggcgtttgctccgccactggctgtaagcgaaaacctttgctattgggtgaatagccagttcagtccttcaacttttgttcatgggtcgaattagtccttcatgttttataatgtccaaccaagactctaaagattatcatgcggcttaatatagtccttagagccacttaaaacgctacgtggacatgccacgtcattcgtgcatgtaagataacatttaaatgtccattttaaccttcaattttctatcaaataaagaaaagtaaaataagaagaagcaatcataaaacaaagaaaaatgttaatttttttatctatcaatgctatatatttttgccaatggtcaaaagcttttttttttgtgtgttttctcaatagttttcctttatttcctatgaaaacataagggtgtaaaggacatttaaatattgaatttgcatgcatagatgatgtggcatgtacacatggcatgtttagagggtcaaaggactatattgaatcacacaatgaacttaaggtacttgtttggacaatacaaaatgtcagggactaaattgatccttaagcgaaagttcaaggatcatattgggtattcaccctttgctattaattaatagcatgcttattcagagttaaaatatactatgacaataccacaacaagggttttaactgcaaacaaacatttttatctcattacagatcattgcgatggtcaattgcaaagtttccgcggtgaagcgtgttctgaacttctatataaggcgggggcaatcgagtcacttcccccgagtctcaaaccgcagctagcctcccgcttccctccaattccccaacccaacgaccacatgaaggtaaccgccgcgagctcgtcgtctccctctcgatgaatcgatccaaaccctagcctcatctctcttctgctgctccatttgcagcttgggatctcgggtggcgcgggcgaggcgatggagggggagctcagcttcgtctcgccggcgaggtcgtcctgcttctccttcgagggcggcggttctggatccccgacgtgggtgtcgacggtggaggcgctgctccgctcgcctacatcgagcgtctccgatggcggcggaggtggtggtggtggctacaactcaccggcacgggcgtcgtccccgctgcagaagcagatcccctactgccgcgacgctggcgacttcagctctctgacatgggcgtcaactctggagaagccgctcgagtcgccctcctcgtgcatctccgacggccgcggcggtggcttcggctcgccgacaagcgcgttcccgcctgagaagctgctcatctcgcccccaacgtgcgtctccgacaaccgcggcgtcggcaacgttggcggcttcccctctctgccatgggcgtcgtctctggagaggctactcacgtcgccctcatcgtgcgtctccgacagccgcggcgtcggcaacgctgacggcttcccttctctgccatgggcatcatctctggagaagccactcacgtcgccctcatcctgcgtctccgacggccggagcggtggctacagctcgcctctcggggcctcggcggagcgagagcgcgaggtgcgcgaggcggagatgctcctgcgcgcgatcgccgagcgctacgacgactgcttcctccgcctgcgcgacgccgcggccgagctctcagacctccaccgcgagcgcctccgtctcgccgccgagaacctccacctctccctccttctcgaggagctcgagtccgagcagcggaagcaggcatccgccatggctccgccgaagctagaggaggacgaagcagcacaggggggcgcaccgaagagcatctccattcgttcgccgggctacctctctcagaagccgccgcaggggcaggccaggccacagcgcctccgtgttcgcgcttctcaggcgatggaggtgagcccccaattccttgcttgttaagctcgtcagacatttgcacacgaaccctcacagataattcagagttggttcatatgtgattagatggtgagaatgccagcattaatcctcacagataatttagagttggttcatatgtgattagatggtgacattgtcagcattaaactttgcaaaccacacatgctttggtaatttgatgccttgtttgtgatttagcaatgataggaagcaatgttgaattggatatgctcgattctagatttgcaaatgcggtagcagtcaatctcttaattctgaaagtctagttagtgaatctcgttggatatttgcacacgaaccctcacagataattcagatttctaataattcctgcaaattggttcatccctgtgattactgattagatggtaacaatgtcaacatttaacttgcaaaactacacgtgttctggcaatctgtgttagcaatgatacaaagcatcaaagtgtgttgaattcaattctaagttgcatttgcaataactttcagccttgtcaatatttctgaaagtctaattactgaatctggagaaacttctttaagatttcgcaccccaactgtttgatttttgtgatggggaatcaatgttcaccgaaggaggcagcggcagcaggggatgaggaggatgaggaggacaagggcggcggcgaggtggaggtggaggcgtacaggcagggcgcggcgaagacggagctgtgcaacaagtgggagcgcggcgcgtgcccctacggcgcgcgctgccggttcgcgcacggcctgcaggagctgcgccccgtcatccgccacccgcgctacaagaccctcccctgccagatgttcgccgccgcctccggctgcccctacggccaccgctgccacttccgccactccccgctccgcgccgccgccgccgagtccttctgctactaggccgcgttcaaggtaaacacgccttgccgcctccctgagcccataagctgttcatgtttaagcctcgttgcttgtagctcgtttgggccgtggtagtgtctagccacgtgatgggccaaatgggccgtatgtgatatgctttgcctatatagccctgggcttcttatcatcccatcacatggatactgccatactgggttgggctctatgtaaagcctggatccttcctgtttttatcctgcgcgtgcccctgcatgtttcgatgcttctgccaccatggggagtaggttagcagcgttgctgcatctgcatgtgccggatcaggtcgaccggaaagctgtttgcatagcaaattcagtagcctatagccacctctttgcccgtgtctgtacatgtaaaaggatcaactcgatgcacgaagctggcgaatcataaacagtaaaaaaaacaaagggaagtaagcaacacagtaattctacagacctccagggctccctccagtttgctaggaacatcagggtatagcacttagcattctttgtgcacacctgtgtgtcggccatgtctcctagccggcttagctcatgacgacaccgagtcagcagcatcagcatcagcagcagcctcggataccaagcgcgagcccagggacagcaaagggccgagcgcgcgcccaaagcgggcgaggggagaatcagcatcgtgtgcttaaagacctgccctttcttcccacatggacgaggggagagctaggatgcctcgcctttgtttgaattgctttcctggagatttgaagacagcaatggcagtgtgtggcaagagaaaaaaaaaggaaagccctagaggaggaggagcatgatgtaagccgcttttcagtttttaggggcaaaggcgacggtagaggcggatgagaggctctcccctctgccgccatgtcgtctgcttcgttatcctggggaagtgtgtgtgagtctgtgtgtgcctgcctgcagatgccctggtttcgcactttctaggattccttttcgggaatttggggggatgatagaaatgagaaatccatttggatgcctgcgcctgcacgtctgcatggccagtcggccactgcatacctgcagacttcacatcaggaaatctgcagagaagaagactagaagaggcagataggcagtgcctagatagaggatcagattagtgatgctgatactctgttgctcaggacaaaacaaattactaagacaatacacgccctgatcgttgaactgacttactgaactcgcaccattcttcttccgttccaagttccaacacagcaattttcagtagaaccaatcatgaactgatcaacagtgttcgttcgattttattctcacatttccaccgctgaatggagcaaaggagagataaagtggaaaagaaaaaaaaaagtaaacgcaaaggctcctatcacctcatctcctccatattctcgccatgcaaaaccagcacacgtacgaacgcacacgaacgcccgagagatggaggagaagaatcgcaaccccgcactctgtttttttcatcctctgctttgcgctttctcctcctcaaatctcctttcttccctctctacggtgttgcaccgcgcgcgcgaggccgcgaaaagctcccctttgtacccatctttcatccccccacgaaagcctactaccacccatcctccccgtagtagccaccaccaccaccaccaccatggccgttctctgcttcctcgaagcttctccaaatccagccgtgcaccagcacggcccgcaccccgatggcccgggcgtatgcccattccatcgaacaactccggggcgctctgacctcgcccccccgctttgccgctttctgacaaaattccgcgccctttttggtggcggcactgaaagagaggagccgaggtgagggggaggaggagaaaaggcggggaggagggagggtgggtgtggccgaatcttggcatttctagggattctgatgaggagctcgccgctttgcgatctttttgccggggaggcctagctcgtcatctcctcctaccgggagcgtgtccgtgacgagaccgaccccccctctcctgccgccgcccgtggggagaagcttccacgctgcttcctctcctcttgcccccgctatttatagccgacgtggtttctccccagggttttacggcggttttgttcatctcaggtgaactcaactcaactgaagtctggtgcagtgcagggtagtgtagtgtagtgtagtgtagcttgttgattcgagctgcattgcgctgatggacttgaagagggttttggaggtggaggaagaggtggtcgacggcgacgaggacgagctcgcctccccggaggccaagcgccggcgaactttcatcaagtgagtgaaaatggcattgcatttgggcatttcggttaagttcttgggattcatgagttgggttctgactgactgactgacgttttgtcccttgtcgttttcattgtgcagtaatagctcgatgcaggaggccattggcgcgcagtacatgcagaggcatctgcccaagctggagccgtttctgcgcagagttgtaagcaacattctgtagcagctactatacggttagctgcctgtcgagttagattctgctgaattctaaattctcatggtgtcactctcctgaattcaggtgcaggaagaggtgcagaatgttcttatccgccacattgattcggcacacaggttggcctctacattctatttgcattcagtgtttcatagtactagtagactagtagtacttcctttttgtttccatttacagaagtttattgctgtggcactactaatgacaacatagagcatctacgagttcaagaccctgtttatattttctccatgttatctctgaaatttaattcttctggaacttccaatgtcactatcgtatgaaacattctgaacctcaattctcagctcatgctaaaattccttcaagctgtcgcttatactaatttctgaatgcatgctgtcagttcagtgctgtccttcaccttttgactgctatatcagttttaccaaaaatgcccactcagatgttcctgtttttgtggttggaatgtgtcctgacttgatgtttgtcctgcattcgtcaggcttccccttcagctaaagacaagcagtaaacgatacaagctgcagttccagggcaacctgcctctgaccctcttcacaggcaacagagtggaaggggagaacaagcagcctctccgaattgttctcaccgacgctgtcagtaaccagacgatcacctccggcccgctgtcctccatgaaggttgagctcctcgttcttgatggcgatttcaacgctgacgagcgcttggagtacaccgagaaggagttcagcgagagcatagtctttgaaagggaaggcaagaggccactgttatccggcgaggtgatcattgtgcttgagaaaggtgttgcatctatccgcgacatttctttcacggacaactctagctggataaggagcaggaagttcagacttggtgcgaggatctctcgggccagctccatcgaagaaagagtgcaggaagctgtcagcaatccttttctcgtgaaggatcaccgtggggaaggtatgtccttattggtattcatttcatgctcaacctgttcgtcagttctatccttgcagtgttaaagaagaaattaatgataaaattttcatgtttcagtttacaagaagcatcatcctcctgcactagctgatgacgtttggcgtttggagaaaattgggaaagacggcgttttccacaagaagcttgcagactttggaattcacactgttcaagacttcctccggaacttggtgatggatcaatatggactacgtagtgtaagaaattaatcatcccttttacaataaaaacttctatttttttagataaacttctctgtccaactttaatgtagcttccatgcatatattctcatcctgaactgcatgtccatttttcagttacttggcagtggaatgtcaaacaagatgtgggaagcaaccgttgagcatgcacgggagtgcgttctggacgacaagctttactcctactgcagcgggcatgggataatccttctcttcaactgcatccatgaggttgtcggtgtgatcgttggaagccactgcttcactctgaatgctcttactccaacacagaaggtaaacacctgaaattctgagaaagacttgcaagttgccatcaatggcatcgaaagatgcctgatgcacagatgaaaggacatcctcattatgagcagcacctggacagcgtccaaaagtagttactaattgattcagatgcatggcagtataattgtcttgtcacccaattaatattgctaattaatttgcaggcgctggtggtgaagttgcagcaagacgcctacaagttccccaaccgcatagtggaattcaaggtgcagtcccagtgcaccagccagtcatcaccaaccaccatccagtcccagtccgtgcagatgccggcttcagagaacgcacagattctgaacctacctcaaggtgcccattgctttccatcaggtgtcttagctaggtcaaagccctcatagatcatccaacactgacagagaaagaactcgccactgtttggtgtacaggtgagctgccgagctcttcacaggactgcttgctgaatccgctccagtaccagccgctcaacgaggcgctggaagacgtcctccagacagccggcggcagccaccaccaacaccagggtggtagcggcgagctgccatggatagcgtcgtcgttcggagcgggcggcttcgtcgacgcgagggaccctttcgacgtgcagttcagcggctcccagccgtgcgggctgctgctctccagcagcggcgccagattgtgaggacgagacgcgtgcgtgtgcagcaatgtgcaatgcaagcctccgtctctttgcatggagccgagtaatggcgccgccattgtagctaagctaagctcgagggtagtggcgtggggtccatctaactgtttgtctgctaacactcacaaagttgttttgggtgggatatatagagagagagatgatgatgcagagaagacaataagtgggtataatttggtagggtatgtgatctaatctgtgctgttttgtggcatgtaaaatgacaagaaagcactggtctggagattttttttagtgctaaaccctggatctcctttgtgtaaaaggtgcttctttgtctcatcgtcttttctttagtgctctctcagttttttttttccaattcatttgcaagaacagcaaaatgaaataggctcgtcggtggatagatatgctatgtggtgtaatgagtttggatgggtccatagctggcagtacttggattatgtaagcacctactttggcgtttcagctatttatagaccatggcaattggccggcatgatgagtccccaacccacccttgtatcttgtacagtacttgccaaccgaaaatgctgtgccatataaatgcattcatcaatcattcgcagtgaaccagcaaggcgtcctccttcgtaagggaacatatcctgtacatatacaaggtattttcagttagtgtgcagggccagtgcaccttgtgcgcacataatacactccccttttgtaaagcagtaataattcatttgttgacaattctgcagagagagagagagagagagagagagagagagagacgttcaaggcttcaaggagaggtgcaattgatcaatatcaatgacagcgaaaatgccgtagttctagaatcagaagtccggaatccaacgtagatttttttctcgattacacgatagatttctcgattacacgatagatgcacatgtacatagttacacacaacatcacattcacatccccgtgaatgcgttcctcgacacatgctaaagagaaaccagcaacatgccggcatatccctaatatcataatccaacacagattagggatatgccatgcccgttcatagtggataaattccacaggaacttagaaggtaaaggaaacaccagatgcccaaaagcctaatacaatgaaaatcagtccacgtagaacaccgaaagacattaccattgattaggatagcatgagataaataaattagtctgttcggctccacaagcatatacattccaaggtagaacaaggagccttgccaattgccatctcttacaaacattgttaagctagacatttcactttacatactaaggttcaaaaaaaaaaaaaactacggggttgaaatcctgtgagctatcttcccagtgcaaacagaaattttcatctgcgctgttgatagactcccaagattgttagtagcccaatttgttcagttcaggctagattgcagttagtttcaccaataatacttggatccagcagcaaacagattattatcctctttttacatgtggcagacaaccgaaccaggagaccagtttgcacgaacaaggaccagttagtcctattggcaatttcacctgcacgctgttgagcgactagatcttttaccttccattgcatccttctttttcctacaatctgaacaaagataagggccaacccatggtgtcgatggggcagaacagcaaccacctccattatctgtcactaaatcttcaaaaggtgcttgatccacttggcagattgcacagcgagatggggacgagtttgcttttgatggaaaattcctacccaacctgcaaaagtataaataggctgttaaggttctgttcaatagcctcaaatgcagagacgaggtaacaacagagtgggcttcctcgacaaacagaacatcaatcagtaatatatcttagttatcaacagttaattggacaatgtgataaagaagcgtgtgataatgaggaaaacaattcaacagaaaacatattatccatggcatagctcaagtaaaattcttctaactactggtgcaatatgttcattcaagcactatccaacctggggaacttggaccatcaattgagaagataaaatagtaggatggtgctgtatagtctaggactctagtagcatacaactcaaatatgacatagtaacttaggctgcaacataaacgcaaactaacagaagtgatatttcattcttgaaggtcacaaaagttctggaactgcatgaagcaaagtagaagttacatgacttctgcattgaaagagaggttgtctccaaatcatatcaaccatatcaaggtatgccaatctatccttaccaagctagctactcaatcccttttgctttggtctaactacaatatcataaatatttatgccatgcaacataataacaaaaaaaatgtttcaaaagttaattcgtcagcaatttccttatgtgccataagccacacaaaggaacaacagaaaccaaagaagtggcaatagcaacagggaggtcttagtatgagtacatattatcatgttgccaagcccacaagatataattgacaagccaggattctattgcattgagttcaactaatgagccacaatcgggagtggaaacacaccactaactaaagaaaattatgaagtattcatgtagttttactatactgttttttcatgaaaaaaaagccacaaatgatattggacaactgatcaagaaaaagacaaccatgcatcaggaacttaggatggaaaagttcaattagtggttagtggaggctggggacccccaattgttccccatttcaaaaatatatcatatgttataaaaccaagccagggacatgtgataagggaaaaatcataaaggaatcaatgacgataacaaatacacagatgacaatcaaccgagtgattaataatgcatagtaaggtactaaacaggggataacaaaatgaactgcaacaggaaaatgatgcatgcctttcatccaacattgcggaaccctcttcaaataattcctccacagagtcaaatgaagcagacttgtttccaagctttccaacagaactatgtgacctcctaccaaaaagaagagatctcaacttgttctggtttttctttggagatagtgatggaggtgttgaagaatgatcagatgggatgatatcaacaaccacacaggtggtgtcatctttcagcccacttgtcttcagtgcttgctgtacaatatgaatggatctcagttggatgatcaagatagtgaagcattccatataaagtaagatataaacaagaaactgaaaccacacgtgaaactaccttcacgacaagctttgcagccagctctgcaggcaatcctcggcatgcctgagcagcagcttctgaggacagtgcatcccaaattccatctgatgcaattattagcctccctccagcatttgatagctacaatttcccagaatgaaaagcatacacagttaagttcattgcgataagctactccttgcatttgatcaaactcttaaaatttcaccttcacttgcttgacatgtggaattggcacaatgaactccccaacgtcagtatccccaatcgatcttgaaaggcacaatccacctggccagcatctgagaggtcccacctaaaacaacagcaagatttcacatcaaaacccataatgagaaatgctttgacagcattgaatgtatccttgaagttctttccaagaatatttactagcagcttacctcctgtccaccacacaggttgagccggctgacctcccctccactcgcggtgacgcgctcccgctcctctacattctcctcgagacgatggtccacggttagcagcgagatcacaccgccctgcgtgtccaatatgcacctggagtccccaacagacgccaccgtgaccgtgaacccatcgacgacgaccagcgtcgctgtcgtccctgatgcctcccctgcaatcacactcacacaacatcccccaaagttaacatcttcacagcggcgatggtccaggctttcaagtttcaacggcattgcgaggatctctctcacccttgcgttggaagtcgatgtccgtcttcacgaagcccgcgaccagcgcgcgcggcagcgcctgcagccagtcgtcgcggccgatgccctgcggcacggcgctcatcacgtgctccagcaggtgctccttgctgaacaccgccgccgacacgccattgtgtccgtcgaacacctgccaaaccgcagatccaagaacaagaacaaaacccgacacgccatcagcatcacggaatcccgagacgagaccagaaacgcgacacggggggagggcacgtacggcgaagacggagaaggcggaggaagggtcgcccgggacgcggaggcagtcgggcttgacgaggaagtagtcctcgccgcgcttggcgaagccgaagtggccgtaccggacgagcggccgctcggagccgccgccgcggagctcgcggccgatcagggtcgccaggggaagcgacggggcagccttcccctcctccccggcggcgctctccatcgcagcctctccccgagccgccgcactcctagtcctcctacccaccaagcatcatcccaaactgccaagaactcaccgaaacggcgccatttcttccgcggaaaaaagctccggctgctgccaacggcgggaggaacccgagatggatctgagattactcaaggagtactcggatttggaggcaatggcggcgcaatgcgggtggcgaacagctgcgatttgggggaatttggtggggagagtgaaggaagaagaagtaccgaactgaggaacaacgatttaattagctgacgatagtagaagaggtgggatctttttgtaattcgtaggtgaaatagggggcctcggtgcaaatgtgcttgccaaatgcctgcatttctgcaagcttgcagcagcagcgaggccagctggtcgatagtggttagcaacttttggattaagaaatctgagttggattaaagaaaagtgtgttcatattgtggatttagccgcaggttgtccggttctgaggactactagtaatgtttttaagattttttaagcatgtttgaatgtatggttgccagctgctaaaatggatatgtttgactgaccacaggtggttttggtgtcaggtgttatggacccatgtgctattgcttgcaagtccacaactccacatatgagtacaagaatagtagtaccagtagtaagcttttccaaaaatgcatttaaaaacttaagatttggtgcaattattttatttagtctttacattcatatgcagctgtttagttttatgccgttatgtggatatcattttttggcacgtctcgttataagtaaaattaaatgcctcgtcctatgcatgctaggtggtgtttggatccaagaactttagcattagagaatgtttacggtagcatcacataggctaatcatggattaattaggctcaatagattcgtctcacgaattagttcaagattatggatgggtt

SEQ ID NO: 42993 - DNA, 5967 bp, Oryza sativa
taaatattaaacgtagactattaataaaactcatccataatcttggactaattcgtgagatgaatctattgagcctaattaatccatgattagcctatgtgatgctacagtaaacattctctaattatggattaattaggcttaaaaaatttgtctcacaaattagctttcatttatataattagttttgtaagtagtctatatttaatactctaaattagtgtctaaatatagagactaaagttaagtccctgatccaaacaccaccagatcaagcataatgtccctttctatgagaaaattcaatgaacaagaaatataacaaaaactagtaggagcatgagttaggtgctgccctcctcccgacacgcaaaacgaaatatatattattacataattaattaattaataactattttttcctaaaaaataaattaatatgattttttaaaaacaactttcatatagaatttttctacaaagcgtgtgcgccctggtaaaaaaaacaaagtgtgcgcgcggaaaataaaagagggaaaactaggagaagaacatagccttagtggtgagtacagctggtgaacccagatcactgcttgaaaagcttttttctttttgctacagtctataaatcgaaaatagattatcaaagtagcaaaaataattaaggttatatttttacattttaattcttagttgtccaaaaggaagtctaggtaatgaaagcaatgaaaaaattaacaaattaattctaaaattcaaatcccaaaaaatgcaaatttgctcatgacctccgagtttttgacacaacgggctgtaaaaacacaactagcatgcttttatccattaacctaagggctgttctaacaaccacaggttgaaaatggctaattagtggcatgtaaaatgaaaaacctaattaattgagtatttttcaaaattaaattatgaattataatttattttattttttaaaacgattttttataaaaagttttaacataaaacatatcgtctagcagtttaaaaggtacgctaaaaaatagagagagtagcgaaacaaatcttcactttacaacattccccaagtccaaacgatcatgcaaacaaaatcgcctgaaacattttgtggcggtgattactcaacttaaggtgaacaagagagaacaaaatcacaaccctattagaaacagagcgaatagttttcgctgcttcagagaaaagcgaatacaaatatctttcggtttggataattttcagatagctcggatacagatacgaatacggatatttcctcccggatacgaatacagatatggtatcagggtttccgccggatacggataataactcggatatccgactaacaatgctattcggatatccgcagaagccatgagacataccccaaatctttataactctatgactttcaatatacatttttagattttaatagaagttcatctcttaatactagtccacactattaatattatttaattttttaaataaatatttataaattatactacattttaaataaaatgaactaattatatatgttgatatttgtttatattagaaattgatttgatttttcgtgttccgagaaaaaattgtttccgtattcgtgtccgatcatattcgatttttattcgtattcgaagtaatctgtatttgtttctattttgagttgtccgtattcgtatttaaagaaatataaaaacaaatatgatatgagcattatacttccgtattcattccgttttcgtcctaaaaggaactagggttgggtgagacgaggccgtgaaggagaggtccagtcgtcggtgaaacggcgtagccgcgtaggcttttctttctacggtcgcgcggcgtggctttgttggtggtaggacagctcaccttttccctgcggtgagttggcctcggctggcaaacatgggctttgggtcgccgctgcttaattagactttgcgtagttgttgtctacttgcccgttgaatacgcggatggttttcttgtaagatcggtgctcttgaatcttaactgaactcgatccttcttcatgcatgcacagcgtgttgcatagtcgccgaaaattgctagattatgctctaagtttccgaaaaggcctcattgggcattgaaccatgattatgtagctgggcacaacgcttagtggaccagtctctggccttgaactactaggcagtgctttgtagctagactaactgggccaaagattcctggtgagtattagaaaaagaaagtctatattacaatctgagtttcctcgcaatcgaaaaatcatgtatacaacctccctcaattatcaataccaattcttcattttaccttcctatgcagttcacactggtatcatctggcacctacgtggcacttgggttgcattacaatcaataaaataaataaataaatagtaaattttagaaaactacaactttagtgacaaaactatcagtttgttgcaacattagcgacatgttttagtttactgtaacaatagcgtgagaaattattacaaaactgcaacttttatattatatgctgctacagttgtcacctatatgtactgtagcagcatataacgtaaaagttacagttttgtgataatttcccacgctattgttacaacaaactgataattttgtcactaaagttgcagttttctgaaatttactcataaataaataatgccatgagacctatatgtaaaagaccatgtttatcttcttcctcctcgtctttcccttctctcatttcatgccatagttgggattttggtcttgtggggctcggctaaggtcttttttccatggaactccaagactgcataatgaatttcctccaagcaatgctcttctcctccaacaaatgtgttgctccctccgtttcatattataagtcgtttgactatttcctaatcaaaatttgttaagtttgattaagtttatagaaaaatttagcaacatccagaatatcaaattagttttataaatctagcattgaatatacttgataatatgtttgttttgtgttgaaaatactattatatttttctataaacttggtcaaataagtttgattaggaaaaaagtcaaacgacttataaattatagtaatatgaaatggagggagtaacatttattgcactaagaggtaagctcaactcccttcaaaaaaaaaagaaaaagtaaagctactatactgtagtcattctgtctaaagctcagatatatgttggacagtaaaattgtaaaacatgtcactgcaatgtattagatggtatgcaccacagctacaacagacatgattctgcatggtcacttacaggaatgaatgaagtggtatgtacaatccaacgagcacttccagaacttaagcaaaaggcaagacttcaggaccatcacctctgcagcaaaaacatgtttccaggtttccaggatgatcagcagcacaagtttggctagcagtgtcactgtatgacacgatagctgacataaatcaatatcaatgtacaagaacatgaacatgaacttcatggagcgtggacccgtggaagagaattccaaccaaagcaaaagctgtacttgttagaatactggagaataataaacgaaggacattggaaagaacctttatcaaaagataaaagcgttcaaagagagaaattatgcacccgcttttgatcaaccaattctctttcttttctcttcattatatatattatgaacaatacacaaagaattagcaagaactcaacatagcctgataggccaaataaaaaaaaaggttaatggcctcacacaccagttgttgagatcacaactcaccacactgagacaatcaattgggtttattgtcactcattgctgtactcgagaaaaacctcgcaatctctcatgacaaacactgaaagaaagccaagaaaaaaaaatgcacatgatcattgtagtagtccctactttgtaccagcatgtctaccatttgatgagagccttctgctatcgctaccacttaaaggttgccgtccagatctatttccattggaggtttttctcgaagcagatggtatttgagaatggagtggtgtcctgatgagtaaatacatggaagcatggaatatcttaatcagcctttcatggagtaaaatgatatatcttatgcgaatagtttagtatgttatagtttagattatatatttttctttttaaataaatattagtatcaaccaaatataaaagaaccaaaagttaatgggattaatatttaatagatatgtacttccagtacacatttttcatactaattaaatttcagagaattagcaactctgtgactagccttagcagaccacaatcttgaaattcacagcaatcactattatgcatgaggtgaactatatctttaaataacaacataaagataattttccatccatgcactattagtcataacccacaattcacaattagtgtagtcccaagtaatacgctaatatccaagtccatatgactgtttattcaagttcagttcatcatagttaaattatttatatctgctttataccatgagtattgtgggtgctaaaacagtgtaggatgattttacttcaacaaaaacgggacaagggagttattagccctgttattcttaaaaaataatgtttgttgtaaaaaaaagttgttaatgtaaaaaaaatggttacctggtatctgagctctctcttagcttcgtttgtggtttcttgatctttgaaccattctcgctaattgaactattgatgctttggacattgaactgccatagtgcatctgattctgaggaatcacttgttgcaatgtcaatgtcatcagaatcatcagtatttgtggaataaaatcttggtctttgctgctcaaactcatttccgtccttttttcttgagttatttctcaggtattgcttatctcttgtacctgaatggtacctttggtaaaagaagtcaggtaaagctgcactgtcgccttcccaatcacctactgagttattgttgttcactacaaccttatcgatccattccccaccaatagtcactctttcttctcccatttgaaaatttgcccttgaaatgctatctggccatgatggggaatcatttgacgctaataagtcctggagatcaaagcttggtttcttctgtcttaatgttggattggctctaacctgtataaaaaccagatcaaacatgatgggacaaaaacgttaacaacagcatggccgctgaaaggacagttgtattatcataatttgctaatatcacttgtgtaacttgtaaatgtcaaacaaatatgaatcgtagaaaggtttatagaagaaataatgcaaggcattagtacctctatgtttccaacgtcctccattggttgtctgaagttagtttggctagacaccaactcacaactaccctgtcgcctatttgaaaagccaggtgaaggcatcttcatgttaaatgcctcagggtcacggttaatgttttgctctgatcctgaatctttcattgctaatgatgatttgagtcgagcaatctggatagagatagaatatatgcataccttaaacaacaaatgcagtgagaaaatatgatacaaagcatagtagcagaaacaaacctgctccttaagttctttaacttctccagactctttgttcaaccgagcagcgccaagttcaacagtggatacacgctcggcaaacttcaatgtgcttatgctttctcctaaagcatcactttctgggcttatatgaacaaacatcaaggttttggcctgacctcctgtagacgcattgttaaaattcgaggaaatataaattatactcagcagtcagtgacagcacattaagaaattgcaagaaggttaaatcttaccaagagaatcttgcaggagttgtgttaattta

SEQ ID NO: 42994 - DNA, 21626 bp, Oryza sativa
tcaattcaaattatttcatgtgatttttttacacagaaaaggttgggttacctgtgggaacgactgctccggtcatttagtgcagtggcgccgactgcacggttcttctgcccaacattcatcaattccatcacgtccattgttgatgcgacacagacaaggcttgcatccggcacattaagtccattctgagaattatttcgaatctctaatgtatatacttgttaaggaagactatttacttcagcagtacaaaataatttacttgtgaaagcaatttataacacaaataaagtggcacaatttgatagaaacatgctgttgtgaggatatcttttgttcagaccatcattgacaaggaggtccctgacttgctcattataaatctctatcatttgcacagcaatatcataaatgaatgctcctttcctttgttcggcaagcttaaatagatcacttagtgcccgataatttacaccctgggtttgctcagtcatgttcttgggcccactctacataaaagaaatagagaagatgttaatggtacatgaagggaatccatggtagtatatgctttagaaacactattaattgatatcagtcatatatattgaccaaatattgttactgtactcaccattgtatatgtcttccctgaaccggtctggccataagcaaagatgcaaacgttgtatccatcaagtactgagcgaataaggggctgggtatctaagaacacctcatctgcacgacaaaaaaccattcgatcttcttccattcaagagctcgaaaaaaaattgagaaatggacaggtagaaaaccttgtgttgctgaagggccaaacaccttgttgaagctaaaagtctttcgaccttcctttccagacttggaaggagtgatgatggttatattgccctcatcaattgaacccacagcacaagaacttacttgtccaggtaaaaagggtcgtactctacaatataccctgatactccctataaacatggaaaataatcaaaatacatgctttctttctgcttctcacagcacatttttatccttaattggtccagaaacacttggcatgaatattcgatataacaagcatacctttaagatcttgcacttggttgtacagcttgcgattttcttcaagaactatatgataacctgaggcagcatgtgcaaggctaaacagatgccttcctggaataaaatttgcaaatgcatactttgtttattagcgttatattaaaatagttagtttaattaagcacctcgggcatgcccattttacctaagatgttgatgtcctcggagtacttcatttgcataaactccatgccagcttttgtagctctaatatcagccttgagttcctaaagaaaagaaccacaagcagtaatataaatatttaatcaccaccaagacaatgaaaaataaaatgaataattaaaataatacctcaacatgctttgactgtagttgtagcattgaatattgcttcagtgtaacttctccatatgcttcctttttggtttgtctatgtttggagtaaacctctatcgtatccatctatagaggaagcaaaagaaatgttggttggaaactaaaaatagtagctgctagcaacctacacctatctatttttgtgattgcaacagagattcctacagcggttgaaaacaaatattttgaacatactaaataagagcaaatttatagcttgcctttttctcattagaatttggggtggcttcaaccagaacctttgatttcgagaaggatttggtgccatctgtaccatttttcagagccgccttcacctgttccaatgaattaaaaatttgattgtttatatcatttccaggcggcccagtctacatattgccatatgtcacgcagaaaacgatttcaaaaacaacagataagaagtgtacaaagatgatatctaccaattcatgttggctagtcaatcgattctcgaattcctcgacgagtttactcagcatggactccaagagctgcaggcaaacaatagcataaaaactccaaggaaccggtaaagcatcacatgaaagggaaagctgcttgcatgtatcccattgaaccagtaaacagcttactaaaaaatggggaacctgattggcctacctgtggaacttcgtcgggcctcttgtcggacaaaactgcactaaccaacattttcaaagggcgtgacgtcgactgcacgaagcattaaccgtttagccgcatatcgtctagcaaaacaagacaaatacaaagcagcttcaaaattgaagcacggagctaaccatgtcaccggaatcaagatgataatcaccgctgaatccagcctcctcgtaaggcacctcgccctcgttcatcgattggcacctccggaatggctcggagttcttcctcacgaacgacttgccggaagccgacggcttcaaattccccccgtatttccatggcccggtgccaccacattgtttccagtcaccgtacgacttcaatgccagtacgcagttcaccaccctggcgctcttccctccctgcgcccagaaaggcaaaaaaaaggcgcgcgtcaaaatcacaggctccacaagagagtgtgcctaaagcaatcgacgatgagggtgatggccgctttgctgcagctgcaagcaacggcgcatgggggccgggtggcgcgctccgacacgaacctgctccaaatcggaggcctcgaaacacggcaggccgatctcctgcgccgccacgaggaagttgcgcacgttctcgaagtactggaacgccgacagcgccgcgccgtccggctgcagcacggagtccgccgccgtgttcaccaccacctgcggggcgcgcgcgcgcgcaacatcacagcaaccaaccatcacgctacagtggcaaacagcgcagcgggagcgaatcaaattaacgaacacaacgtgtgcgcatgccttggggacggcgcccgggtggaccctgttgagcgcgccgcagaggatctggccgttgcggaggccgagccggaactcctcctccgacggctcctccggcaggtcgcgcgcggccaccgcccccaccgtgcggcgcagccaccccgccgcctcgttccgcctcgccgctgcacggaaccaaacaatgtcgcgtgagcgagcgaagccagccgatagcgggtggcaaattggcaaaagaccaccacgattccacgcagaacacgcgaagcgacacgacacgacacgacacacgcaccggcttcctccgccctgcgggaggcgaggtcgcggtcgctgaggcggcacccgtgctgccgcagcacgtcctccaccacggcggccgcggagagcgagaagagcgccgccgcctccgccatccgtggctcgcgcgcggtgccgcctcgccgctgcagctgctccgctccgctccgctggtctgtctggtttgaaatggacggtggaattagggaggtggcgagtccattaatggggcgatgcgtggtggttttgtgggggtggttataatggaggggggaggagacggagaggtgggagctttgtggttagctgcaatgcattgcgattttgcgatgcgccaatgcctgcgctgcgtgtatgcgcgcttttctttcggctgcttcgggcttaaaaattgtggttagtggaagtggatttcagttttcatttcctccccttttttgtcttctcatcttctgctcttttttctttgttttcgccgctctggcgttttgtttgagtaaagtgtactctgctccggtgctccctaactacagtacggcggccgcttgtttttttttctgttgttaattttttttcataacgaaatgataaagattggtccacgctgcacatggtattttcttttttaaaatacaattatgtgctttattcaaatataacattgatcactatgaaacttaaggcttggtttagactacgtggagcaactaagacgtgaaaataatcggtgaagtagctaaaaacaatgcaaaaatattttagagataaaccgtgttcgtttcggcattttggtgattagccgcttagcttatcaggaaagacactcaattagtatacgattaactaactgctagctagtacaaagttaaaattttgagttgttttaatcttttaatacgaaaagtttttcttaaaaaatgcaccatttggtgaaatgtgttatgtatatgtgtttgattattttatttttttgagaaacacaatacaaaacagagcgttttgtttgagtaaagtgtactctgctccggtgctccctaactacagtacgggccgcttgtttttttttctgttgttaatttttttttcataacgaaatgataaagattggtccacgctgcacatggtattttcttttttaaaatacaattatgtgctttattcaaatatagcattgatcactatgaaacttaaggtttggtttagactacgtggagcaactaagacgtgaaaataatcggtgaagtagctaaaaacaatgcaaaaatattttagagataaaccgcgttcgtttcggcattttggtgattagccgcttagcttatcaggaaagacactcaattagtatacgattaactaactgctagctagtacaaagttaaaattttgagttgttttaatcttttaatacgaaaagtttttcttaaaaaatgcaccatttggtgaaatgtgttatgtatatgtgtttgattattttatttttttagaaacacaatacaaaacgcaggcactcacaaggccggcacccgtctaggatttgaacccaggtgggctggttccaccacaaggaacctaaccagtcaagctatgctcacttcgcatatgtgtttgattattgctgtactagtatattttatattggaaaatgtccatataccacttctaaactttagctttaagttaataatctaatcaccataaactttaaaaatgtccatttaactctctaaactttacaatattgttcatattttctaaagacaatggaagctttattgaatttaaccaattacatttgttcatatagcctcctaagaggattttgcaaggtattatagttcctgaaaacatatatgtcatcttgtagtgaatcatacttatacgtacaaatgtaggcgctcaaacaggtgtataccacccatataaacgcacacatgtacattctaccactatgagcacttttcaaaagactgcaccgttatattttgagatttacgctatgagcacctcctagcaaatcatacttatacggtataaacacaaacactcaaacatgcgtacactcacaccctgtctctacgagcacttctaaaatattgtgccaggatatcttgagattgacaaagtcaccacagatgtctcgctatcgataggtacgttacatgccactaaaagaataattagttgtaaacttgaacccaggtgagcagatcccactgtaacccatccaatttagctaatctcacttcacatacttgcaggtgtaaaactaaaatagcctagtattaaagtagaattgctagtggattttaaagagactagcgtgggaatgtttttttctaaaaaaaaatcgagtgcattcaatttcagcatttcttcaaacttataataagttcttttttttttacctttttatctgctattatgtgtgaaactactccgtcatttccgctaactccaacattcatgcattctctgaaaacgactgtctcaaatgacaaggggtcgtgaaggttatgcacagaacgatgtttttggcaagtaaagtgactccatattgatattactggtttggagggaaaaaaagaagagaggtgaaatgttccattcagccgtacctacgtggtcatcactaactaactttgttgtacaatttgtctcgggatcaccaactcaccatgtttgaccttgccttgatccaccaggccacccccacacagtagtgcatattgccacttctctttctgtaacaccggtttttcttcttttttttctttttgtttggtaatgaatattcctagatactggagtagtagtagtagtagtagtacctgcatgttgtatgttttggtgaattttcgttcgtcctgtcaactaacaacattaacagttcagtacaaggagttcgattaattcatgtaacaaccaacggagtgcaaatttcttcggacacattgcaaatttgtcttgacccatcagctttaaaaacgaagtgtatcggttcacaacatttcttcgccgataggtcaagtgtcagtgtgtcacggacttctcatgtactttgccttaaatttcaagcatgatctgaagtgaagtactgcatttataagatgggatcatgggacgttgtcccaataaaggactagctaatgcctagtatatgtgatcaaattaagtggagtactataggttgcaatagtaattgttacatatagcatgttttttaccgaacttttttccattttcttcttagggcttctttgaaaaaaataatcagtactattgtttgttccaaagaaaaacagattttttgccgtttgcaatatgttgtgatgagaaaaccatcaatgggagacactagggatgtttttgttacttgaacattgtaataagagtaaaattcttagttctgtcggtaaatacaatacccgttttgttggtaaatatcagttatgtaaaaaatgacaaatgtttgtgaatatataacaatacgagttattgccttacacttactactattactgaatataaaacattagtaccaactttcacggtacaatatatttacatgttgtgttgtatactgtaggaaactgcgctaaggcatgcaagtggcaggaatgaagggccattttggattggtaccaaaatgtgccttaccaattttattggtaccttgaatagtaatagtatgggtttgtattgaagccaaattattggtaatgtcaatgattaatttgtcactaatttagaaccttcttctctatatcatcaatatttggcatcatattggtagtaatccaaatatgtataataaatctctaccctaccaaaaaaaattgtagtaccaaaacatgtcaaaagtttgctactaccagtgttttggtaaggtagagaatcaaacagccccgaaaatatttttataaagaaaaaccaggagaagtatttagattgcactcggtcaaatttgtaacccaaaagctccaaaacgggggagtagtcgaatccccgtcggacctgatcgcctgcggccccacgcacgctctcgctccgctaatctcctctccaacggtcgcccacaatttaaaccggggctcgcatcgcacggcacggcacgctcccactcccactccgccgcccgctcggcttggctccgcttccgccgcgggcccgcgcgacgaaagcgatggccccaccacagagatcggccccagccggcgcgcgtctttgggagggaggccggcctccgtgagccggaggtaaggagaaaaaatgggaggcgaggtggttgccgtcccatgaaagctaccggcggtggtggtggcgggcgtggggcccgccgtgtcagagcgcatggtgggagcttcggatcttcttcttcctgtagcgacttgcgacgcgtggtgaactggtgaatggtggtctggacttgtgtgggtaaacaacaacagtagtgggtcaaggggccgagagcaatcgagcgtccagtagaaagcaatgaaaagcatctatacaaagaaaaggaaagaaaaatgtaaaggacatggtaaacaaggtgtccgacctggaaatgggcatttctctaatcatgtccaaagctgggattggttagtcctagtactgaaccaccgatgactttaacaatgagtagcaacataaccaggtgaatttgacacggcagaccgtaaaagaagattgctcttgaaaaaaactatgaggtcctgattggtagtagttggaacttggaagaaggcggaattttttttccccacctagtagaaccaaaaaattataaactgcttttgataatcgtccaacccgcatactctgttcatatgcgaagaaccgaggacagcgaaaacgtaaaaacctagggcaactccttgatttttttttctgttcatttttctttagatgtaacaacccccaaactaattaatagtgtgctacaagcctatacccataatgttgtttcctatgaatcatttgttggcatagcatcgtgcctaaaagtgcactactggcaatggtcgccgtcccttttaatttgttctcaatttccggcgttaggtgcagattatgggggtccatttcgtccgaaacttggagcgtgtcatatggaccgtgcgtcaccacgtcccgcctgggttgctgtcacgctatgaacaaatctgctaatgtacgtaggacacagaagataatatatcaattaatttcgcaagcttgtactttaccaaatccattttgtatcccgtggtcacgacaaaatctaaaatgcttcctcatttttggaaaataataaaagcatttttcgtcaacagtttaacaaactatttgaagaattttgcaggaattatttcgccaccgtttccggatgattgatatactctctgtccaatcacttagcttgcactgtaatataatgcgttgttgcaacattcaggggtaagcaataggacaggttaattatagtactgtggttagtactacccattaagagtaagtcttctatctgacagcaacaaatactctgcactctactactctaggactgttttgattgccaaattaaattgaccctggattatccagaagctaacacattacttagcttaataataattccacgggtacgagacacgtctcttgcactaaactgaagaaaagctcagtagtgctgagcgttgtgtagcacaaagtaagcagcaacaaccaccggccttacagctaaagcgaggaattcccttagctccaaatccaccgttctaacgccaaagcctttttattcagtgtcgatggatcaaagcttgacgaggaagagatctcgctccagaaagaaaattattggtaaggttgttgttaggtcgtagaggtgatcggtagttccctgtgatcatggcatgatccatcttgaatccttgcttgccatcaacaacagctactctacctgttatgtgttacttacatctgcagctagcttcatctggcaaagagagatacgagcacaaaaggaacaagctatatgtgcaacctaagaacgactaagaacgatctgcttacatctgcagactgcagctagcttcatctggtacagatatggcagaaaaggaaccagcataagaacaatctgctttatgcctgacaacacggtattctgagctctgatgaaatgtgggttcagaatcttcagctatatctgtctacaacctatggcaagccaggtcaaaatggaaaatgctggttcttcttccatgggtaacacaagaaacagagaggatcaatgcctcactggaagcgtccaaagcctagtccactttaagcagctacttgcaatgcagtgtcgggcagagggaaaatcatggggggaaaagcgtctgccccggcggccatgaaaatggcctgcctgcctgtactcaagttaaacgcaatcatcgtccttgctttcactggattgaataatggtccatgcttacttagcaacagtccagattagaaattttctactgaatcatgcactcgctaaccactttaggaatcctgccattttgtgattgctctcgtcttttccccgtacgccaacttggagagcaaataggaacaaaacatatggtcctgcgcctatcggtgcgttcttctcttcagcccaagcctacaaaactgaagtacatttcagtgacagtttctcaatttctgccccaattttgtttcgttttgggtgattaatttgcagggaattttaactgctatgaagtgggtagttaacagaacttaccgacagttccaattttcttctgaaaaatggatataaaaagtggagtaaaatggaaagggaaaagaagatggtccaaaggtggctccttttcgctgggtgtggagctggctggctctgagatgcacatgacatagggctcaagcaacactcaaaagaaacatatgccaatatccttccattgccttttccccctctaccctgatgagcaaggactgtacaactctctctgcccggtctgcttgagccattggaaacatctctgtgcagcaatcaagatggccaggtaggccttgaagagctttggggtgcatcattgtctcagcaccgtaaaggagaggaggagggcgattggtggcaggcagcttggcaatgcgattatccaaatgcacacatagcctcttgacaactcatttcacggcgaaagctgcctccaaagactcaacgatgtgttggcaccgagaaagatgttacgactactaatttagggaaattgcagcggctaagtaggagttgcacttacgtgtcatgttcttttttttcccctgaacatacaacatgaaactatcaaaatgcctatgcactgccgacactgcgatcctgcctgtacatttgaagctttgctcatcgtggagagctatgttggaatttggatcccttgcgtattctgctgggggaatcatggcctgtgcttgcatgtgatgttttcagagactaaaatctactagctcggttcgtatattcagaaagctcaaatgattgactgctaaagtttctcctttccaatttattttagagattttttttctaaatttttcaattcttgtatgaacatttcaagataaactattgatcatgcagcaatgttgtaatattaacttcgagacccgagagcatctttcattagataagataagcaaccaaaggaaatcattgcgggagcagcttgctgagtatatgtatctcaaaaggcaggggaaacgaaatgaaaatgcaatggaaagtgttcttggatgtatagattacttcactgattggcacgggttatgatcaaacagcgctacgataagctaatgcaaaattaaacatgaccaggctacctaatctaaggggatcttaatgtaagaatcagtgggcgatgccatcattgcacaggattgagagaatggcttccagctcactcggggtttccaatcagtaagtatatggccatgatttctcggggtctcgttctcgccgggtcgtctcgatatgatagtctgcttccttgcaatatgatttctagagaatcacgcgtgctaatccaaatggttttatcgtggcaaaattctactcacgcataaccggagagataaattctactcacgcagtggcccaattcacggccttctcaggaccgagagaacttggcccagatagcaatactgggaggaaaaagtacaacgaaggtccctcaacttgtcatccagtcacaaaatcgtcccccaaccaagaacaaatatccggcgtctcttaactaatcaaaataggttaaaataggtacttcgatgattttaacccggttttatcctatgtaacagctgagtcagcatccatatgtcaggatgccgcatcagcgcacactctctctttcccctcgtctcccttcctctctcctttttcccctgggcgttgtggatggcgacagcttcatcgacgcagcggggaggaggtcaggaggcctgtcgtggccggcggctggcgagggacgactgcggcggtcgtctgccttccctcctcctcctccgcgtgccgtgcggcgccattgccgtggtcgagagagcggagcgggggcggtgacggcgggccgagccgtcgggctggacaaggctgtagagctcaccgatgcggtcttccttacctcctcttcctcctccagctgcgccggcgccgccgcggatgccgccgctactccgctccgctccaccgcccgagtgctcgcctgccgccgccgctctgctccgccgcctgcccgcccgcccactgtagcgctcgcccgctgcgcgctcgcggccgctcactagcctgccgctgccgctctggttctccaactctgcatacatatacctctctgtctccttcatctagatgctcaaggcattcatgcccgtcgccgtctactccctcatcgtctccttccacaccgactccttccgccgcgcctccatgctcaacatgctcggcatctccgcgggcgtcgccgtcgccgtcgccgcctacggcgaggcgcggttcgacgcgttcggcgtcatgctacagctcaccgccgtcgccgccgaggccacgtggctcgtgctcatccagatactggtcacctccaatggcaagtcgctgaacccccatcacctcgctctactatatcgcgccgtgctgtctcgtgttctagacgctgccatggtacttcgtcgagctgcggatgccgccgccgctccgctccactccactgcccgctcgctcgccgccgctctgctccactggtcgcgcgctcgcccgctgccgctccactcccctccatcggctgccgcgtgctcacccgcctcctcgggtcgtcttcatcgacctcctgctgctcaccgtctcggcgcaggcgaaggcggcgccgccgtggctggccgcgaacgacgtcgtcaccgctgtcaccgccgccggccgccggctgccgacaccctcctctctcgtcggcctcctccccacactgactagcctgcgcaaagagatgagagagaggaggaagggagagaagaagaggaagagcaaggggtgtgacatggaaaccctgacatgtagggctcatatggtcgcacgctgactcaatcgtcgcgtcatgggtcccacgctgactcaaccgtcagatggttttataagttaagagatattctatatctggtattatggttgaggacgattacgtaactcaattacaagttgaggatcttcggtgtactttttttcatactgggaggaggcatgtgggattgtgggccatccacatggttgcgagttgcgacccacagcaatggcagcagtctgacaccattgtcggtggtcgaggtggcattaccgacagagcagaacagaagatgagaaagaggggaaaacgaacaaagatagcgatacatcaactcagggttagtacattgtcaagtctaagctttgtgtcgtacaaaaacacaaaacgctcacgaactccgcggcacacaggctgcgacgagacgacgactcaaagtgatcgccgggtttcccagcgaaacgcccattcctctaccacgctatagccagcgtcgcacacggaaacaaccgcacataacacattcgcgcgcgcgccagcgccatggtcaccgccgcaggctccccctcctcctcctcagcccgcaagccagcctcccgcccgcggctgccatgccgcgacatcctcgtccacatcgaggcctacctctcccgccgcgacggcgtcgacaacctcctcaaggtctccctctacgccgcccgcctcgccctcgccctcgccgccgggcagccgccgctgccccacgccgccaccgcccgcctcaggtccttcgagtccagcgtcggcctcagccgcaaggccttccgcctcggcaagttcgtccagtccatcaacgccctccgcgccgccgcctaccacccccacccccacgtgcacccgctcctcgtcctcctcgcgtacggcggccagggcgtctacaacttcctcgagcagttcgcgtggctggccaaggccggcctcctgcccgcgcgcctcctcccccgccgcctccatcgcatcggcgtctgggcgcagctgctggcgcacgtcggctccatcgcgatcaagctggaggaggtggcagagctggagtgtggcgtcgaggcgcggctcgaggaaggttgcggagaggagagcgaggtggtgagaacgctgagccggaagctgctgctcaagctgatgtcccttgtgcaggacatggtggattccgcgatgacggtaggggacgtgaccggccggaagggtttgctcggcagctcgacgctaatggcgtccgccggcttgctgtccgcgctgatcagcgttcacaagaactggaattcgtgctgaactgaaagcccaccaaaggtacatgttataaaacatgatgtaattgaacaataattaaatcttaaagtggtgagagtttgaattagtaaatcaaattactcctggactctggatgtcggggtataaattaatcaaaaggtggtgctggtgcatttgagcggatacaaaaactgggctttctccgccatggtgatcattcaattttttgctcatgcttctccttattaacaagtgtatatcaacaaagccgattaatatgtttcctcataattttttatttctttctggaactatagcctgtataaacttttttaagatatataaactgtttacactgtaaggctgctgtaatactaacttcaaaagcatctttcgttagataagcaaccaaaagtaaataatcgtggagctgcttaccaagtatataggagtatgtctcaaaaattaaagcagagggaaaatgaaaatgcaacggaaagtgttcttagatgtactagtatcccctgattttttagattacttcattaattggcacggcttgtgatcaaacaatgtatgctatcccaagctaatgcgaaattaaacacgatcatgctactaatccaaggagatattaacgcagtaagaatcaatgggcgatgccatcatgcattcttcaaagaaaagagtggcctccacatcctctgaagtctgaattccgaagccaggctttccggtcagtgccagtataaataaacatgatttatcgatatgataggctacttaatttcatgtgatatttactatgcatccaaaatcacaaatggtaggtgcgttgtgagcgtctatatttgtactgtgtttctagaaaaaatcacagatgattttgttgtgacagaattctatgtatacataacaagaaaatcccaacaaagtgggtcaggaaacactgggcttaaaagcaaaggtccagaaagatgataaagcggcccaagaaggtccaatgtaagagtttaaggcccatttgctaggctgacgcatgggacccatattgcggttcggcccaatgacacgtcacccttcgtcaagtccaagttccaaacccgtacgaaacgcccactcccctaccacgaccagcccgcaccgcacacgcaaccaccgcccaactcgcgcgcacccaacgacggcgccgccgctccgcctctctcttccacgcagcaaccggccgccatggccgccgccgccgccgccgcgggctcctccgattcccgcaagccagccgctcacccgccgccccgcgacttcctcgtccacgtcgaggcctacctctcccgccgcgacggcgtcgacaagctcctcaagatctcccgctacgccgcccgcctcgccctcgccgcgggcccgctgccccccgccgcctccgcccgcctcaagtcgttcgagtccagcgtcggcctcagccgcaaggccttccgcctcggcaagttcgtccagaacgtcaacgccctccgcgcccatccccatccgcccccggccgtcgcgctcctcgcctacggcggggagggcgtctactacttcctcgaacagttcgtgtggctggccaaggccggcctcctgcccgcgcacctcctcccacgcctccagcgactcagcgcctgggccgagctgctgggatacgttggttccatcacgattaagctggaagagatcggcaaactggagtcttccgtcaagatgcggctgaaggaaggttgcagggaggagagcgatgtggtgaggacgctacgggtgaagctgctgctcaagcggatgtccgttgtgcaggacgttgcggacgccgtgatggcgctaggggacgtgaccgacgggaagggtttgctcggcagctcgacgctcatggcgtccgccggcttactgtccgcgttgatcagcgctcacaagaattggaattcgtgctgaagcccaaaggtatatatatatgttgtaaaacacgatgagatgaaataataaagctcaaactggagcaaaattaaaacaataaacaaaagttgtccctggattatggatgttggggggtataaatcaaaagcgtggctttatcaccatggttgttattcaatgttttatttgtgcttctccttaaaaagggtaatggttctcatcaaaaccgaaaaccgattaatatgtttccatatacctttctcctttatgtaataaagagtttgtgttctttcaactataggtttaggtttatgtaaaaggtacaatttgtagttagaattaaaaaagagaaaagctaaagacactctggcggtgacttcttctcaatgtcttgtatacatagccatgccaatgaaaattactttgcactttgcagcactatattttcgtatatcaatttagtgattggtcagcaactcactataatatggcctgcatgcacaatgtacatgttagtagaaagatacttcaaaatattggatatttaaatcgtcaccgttttatccttttttctcctctctgttcatatcaaagagaccaaggaaaacttgccgagttgaacagcataaacaaaaactatgaacagcatgattaaagcctgatacaccatggaactgaactctgtagcataattatgtgaagtggatgaatacaagctgaaaccatgaatgaacttgacaataagatgaaatccaagcctgattatagttcaatacagttctagtatccagtccctcagtctgtgattctttgttttgcagaatcataaatcaatagtacatggaattgttaacttgatctagaaactttgcctaacatggatttgatacatttgctattatgcttgattgctacctactactaaattagtttaactcaacatgcaactatgcatagttggtaaccacctgcatcttttactagtataaaacgtaccaaactatctaattggcatgtattcatagattccctgagttacatagtgaacacatcaggattggtgagagtgttgcaactcttatgtggaatatactataataagggcaccgattgtctggtattgtgttgtgcttgtacttgctgttttttttttccagtatgtagtccacaacaatttgaatgagccatttcggattttcctttttatgaaaaccttctttgtttagttcattacttccaaattctaccaagagttgccctgcagagcttacaggcggtcaggtagttgcttcttatgttccttccaacagtattggccccctggtgtataaagttctactgtactttctgtgagcactgaagatcacttaaaattcactcttctattgaaccggtgatgatggagggctccggcactctactgaggtaagcagttgaaatctccagagggcagagatcactggtctgcactaacatatttgtgtctgttaagcaccattgacactcaaatgtctgagcaatcgttaagcatcttagattggtatttcagccacgttttggattaagaggctgcatatgaagaattgattgtcgagctaagaaaattgcatatatggcaacacaactctggttactttgattgtagtaatgtcagtttaattactcgctgttctggcattcagcaacggctgacaggctgagtaggtgctgtaatttaaattcatttaatcatttcttcaattgctcaaagaaaagagaagaagccacaatatagctattaatattaggattgaaacagcaggatggtattattaacctattagcagttgacataaaaatgtatcctatgattcgatgcagcaagttacttctatttctgtcgaatttgatttgttcaatgcctgctgaaaaaactcgatttctaatgcctgcttataatttgactggtaggaaagaaattattctgggtcgtgatgaattgccttttgggcgctgtttgacagtttgagacggcatgattttggcaaatcatagctgctgtgattccccttggtgtgccccttcactgaaatcacgaaatgccatagttgtctctaacctagatggaagaaactctcattaatcttttgcacccagaccacgacatgaaaacagatttctgttttaatagcaatacctgccaaggcgaccaatcatctgattcctactagtgctgcagcctgcaggctcgagtcctgccctgtccatggagcaggtaaagctactgcaactctgcgagtactcgggtcgggcacaaggcgatgccgtcagattccagcaagggaagggagaaaaaacgagggccggccgatgcgctccgaaacgaagcaatccgcgcgtctccttttccggctccccgacgagtcacgtacacgtcagtctccaccaccaccggcacggcacggcacgacactgccccccaccgctggcgcacccagcgcgcgcgcgggcacacggccgaaacccaccaaaaaaccgatggaaaaacacgccccgcccgaaacaccaatcatccgcacagctgcacaggcatagcagcacgtgagaaaaccgggctgcagcgtgtgtacgttcgccatcgataccgcggcgagcggggcgggggcgactagtccaactccagcaacgggccaaccaaccactagtagctagggagccggagccaggaggaagccaccagcccggccaagccagccagccacccctaccaacgcgtcccgtgcgaggagagagaggttgcaagcgaggataaagcgcccgcacctcgccgtactccgatccgatgcttcccccctccgtcccctcgtagcctccgcgttcccccgtccccgtcccggcgcgcgcacgctcgcccccctttccgttttcgagccgagctcctcgccgccgccttctctgacctgcgcgtggtcgtatatattaaaccgattcaaacccacggggtaaccactaggcgctggaaagggaaaccaccagataagctctggagctggtattggattagtgggtggtggtggtggtggtggtgcgaggccgtcgctgggcggtgctggttttctcgcgcggctggtgcgatcggagaggtgggtgtgtgcttgtttcggcgtgtgatttgggcggagggatccggcgatctggttctgattcgttgttttttttcttcctcttggtgtgtagggatggggaagggaggggaaggggcggttcccgtgggggagagcggcgggcggcggcggaggaggccgggcgaggacggaggcgacgacgacgacgaggagtatgtggtggaggaggatgaggaggaagagtgcgacgaggatctgtctgcctcgagcgccggcgagggaggagagggcacagacgaggaatacgaagagggtgatgaggacgaagaggaggatgagaccccgcggccgaggcagcctgtcaagagccgcgagaatgggcggaaggggaaggcagacccacccgttgcgcgatctcgtcgacgtaagtacgaggatgacgatgactactcggaagaagaagacgatcgggtcgacgagtacggcgaggatcttgaggaggaggaagaggatcttgaggaggaggaagaggaggacgatgaggcgccacgatccaagcgcatgaagaaacgtggtggccgcaacgtggaggggaagcttcctctggagcgatcaaatcgccggaggtatgaggaggacatggactttgaccctgacatggatgaggaggaagaggaggaggatgttgatttcgatcctgaagtggaggacgaggaggaagaagattttgaggatgaggaagatgatgaattggaagcgactaaggtgagggttaagaatatggggcggcgaaagtctactttgaatcagcgacgagggaagatgaagagcagctctaaggtggccagtcggaaggtgggttcagtcaaggcaaggaacgctgcgtctataagacggaggcagaaaaaacgttcaatgcttgatcgttatgaggatgacgacttcattgtggaggacgaggttacggctgattggcaaccaaggaaaaaggctagaattaggaagcagatggaggttgatcctccgacaccagtttttgaggctgagatatggcctactattgattcagacacgacagacttcgaatttgtaacatccgatgaggaagcagccattgctgagcctactagggttattaagaaggggaggaagaaaagggtatttgtgtcagattcatcctcagattctgaattcgttgtatcagataaggaattggggaatttgaaggagtctgagcctccagagtctctgaaagtgctgccttcatcacccaggaagatttctgttacaggtaatggggagcacaaggggaaggagaaaaaggaaccacaggaggctggaagggcaacgtgcgggatttgcctttctgaagaacagagagtgactgtgcagggtgtgctggattgctgttcacactatttttgctttgcatgcatcatgcaatggtctaaggttgagtcaaggtgtccgttgtgtaaacggcggttcacaacaatcacaaagtcgtcaaaggaggatactggtttggaactgacaaattctgtaattagggttgaagaacgtgatcaggtaacctttccttgctgcggttgtcatataatatcaaatccgacagctaaatttgttaacttcatttctgatttatatgggcagtctattcaaaataatattcatgaatatgtttactgtcattctgctgtacacgtttcatttattcttataaatactcttatcctttcattatttttatgtgacttctcactgttactgcgtttgttcatttccatgttagaactagttgccttaggggacaaatgttatttggagaactaattttcggaactatttttcatttaccatttacaaatcataggcaatgttattttttgcattagctttcctggtacttcagctatatacagtttgcaaagccttccccgtcttaatggtctttgcagagaaaagttattcttgctaatctggtggagattttccatcatcatactatgctgtcaatataaagacaaatctttattgctcttacgatcaagtatagaaagctatttgatggatgagatggcataggatatctgaggtccaacttgtggccagatgatggggaggctcttgacaacgccttcttttgttccaaaaatggagggaaagggcaaacttcatgtttggtttatttttgtttgttgatttctaaaatgccagagatctagtgttttatataagagtttgttatgtacagtgcaataatattataatcttggaacatctgaacatgtaacatcctgcacagttggcgttgttggagtgttcaatgtaaaccacattaattccctggtttgattatgttcttggacatcatatgctgtctcttgatttttgcacaggtttatcagcctacggaagaggaaataagacgttgg

SEQ ID NO: 42995 - DNA, 58793 bp, Oryza sativa
  unsure (1)..(58793): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcactccactgtctcttttccggtggtataatttggtgcggcggtgagctgccggccatgtcgaccgtctcctccgcgctgtcgtcgttcctctactgctgcttctcccccaccggcggccaccggcacggccaccgcgccggcgcgtactactacagcagccacccgacgagcaccaacacctactactacgagggtggcctcgccggacgcaggatgggcaggagcaggccactgtcactgcaggtatttgttcttcttcagcttgctcgttcgttcttgctttgcttgctctgttcctcgcttcctctgtttagctatgctacgcatgcagaagacggacatattctttgttcagatgaatacgtatttgcaagctagcttgtttatgcgatattgcgattgcgactagtcgtgttcagattattctcctcagatttttgtccgccacttctgatgctgtctcctagcttaacgctaattaatttcctagcatatgctcgtagcgataatctgtgctgctgtgcacgttgctgtctagaacagcccgcgaaaccaagctcatgcatgcgtgcgaaaaagagagcgataaaaggttgaaggaaaaaaaaagggcaacttacataggacaagggaaacttttccctcggcttgccgcatgcgccggtgttggagacagtaaaaatgtactcgtaccagtagcaaaatactacagtaggtgtatgtatcattcatgcgtgcgattgattgaattgctgcatgcgagtacatacagtaaaatatgaacggttgtctcctctgttttcccccagacagtggagctcaaggttcggatgtgctgctcaggctgcgagagggtcgtgaagcatgctctcatgaagctcagaggtatagtttgcaaatctcaattatcataaaaagtttttgaatcttggcaactaagggtttagatcaatttgttgtgacaaatttttttggcaaaagttttggcggtaaaaaatttggcattgaagttttactaattggtgcatagatgcatggtaaagttttgtcattttactagcaaagagagagagagcacggctcccaacgtgcttttttgataaaatttgctactctagacttccaaatgacaaatgttaaattgccaatttttactactatggcttcgattcatattgataaaaagtgctccaaaacagtataacttttgtcattttggagcaactaaacatggcttaatttggtgaaatttgcatgcatgtaggggttgattcggtggaggtggagttggagatggagaaggtgacggtgacggggtacgtggagaggcagcgggtgctgaaggaggtgaggcgggcggggaagaaggcggagttctggccaaacccagacctgccgctctacttcacgtcggccaaggactacttccacgacgaggagtccttccgccccagctacaactactaccgccacggctacaacggcgacaagcacggccacctcccggagccccaccgcggcgccgaccccgtcagcaacctcttcaacgacgacgacgtcaacgcctgctccatcatgtaaaaaaattcccatgcccgcctcgcattgcacgcgtactactactactactagtagcagtgagatcgatcgagtgtgtgtgatcatcattgtgtgttctctcttgtgctcggcgccgtggtgacaggtcaggtagtgtgctgtgtgtccatggagtagtagtagtagcagatgctaaagtcagtcagtcagtgtggcaatatcgaatgagtagtggcgccctttacgggttacacaatggaaagccaggctctgtgtacgtacgtactctctgtcgatctgcaaattgtcaatgggcccgaaactaaagccaattgatcgaatatcgttttttaaaagtagtatttttttgtttctaatataccaacatcgtattgatgtctctattaaatactactagttaaattcataaatatggataaatactggttagtaggctgtgtttagttccaaagtttggatctaaacttcagtccttttctatcacatcaacctgtcatacatacacaacttttcagtcacatcatctctaatttcaaccaaaatacaaactttgcgctgaactaaacacaaccaaagtttgaaattggagatatgtgactgaaaagttgtgtctgtatgacagattgatgtgatggaaaatgactgaagtttggatccaaactttggatctaaacacagccgtagttaaattcataaatatggataattctgagaatcgggtttccatggacaattcatgtgatgatgttcctccgtgtgagtatagcaacgaatgggatgccagccagggtatcttcttgtgctcgtagctatagctagcagcagctaggtttggtcgttggtgattgtggttatgccagtttaaatattctccactgctggctgcatctgcacgatgatttgatggatagtactactccagccaccacagagagaaaaagcctgggaataggacgggagcatgatggtgttcgtggagcctgcggaacatacaccaggccaccagctgccaaaactcagccgccaacaatagtgaccctaaaattaaaaggcttactactagcttcgagctcttcagttcaaaattgaggaccgattttagttacaaactttttatttgaacttctaactttttcatcacatcaaaacttttctacacacacttctaacttttctattacatcattccaatttcaaccaaactttcaattttagtgtgaactaatcacaccctgagttcactcttccaactttatcagatatataggcactcgattcagaaattccactctcaaaaatcataacacacacgaacgtttgagcataagaattcaatctatctttgaggtttcaaactaaaatcaggtggtttttgtggtgttcatgtataagctcatctcctcacgttctactccaattcacgtgtgtataggctgtaaattaaaaaactaaaatttcggcccatatgtttacatgggccgtgacgacgcctcgagtagcatattggcctgaagccctgaacacggatgagaaaaaaaccggaaaaaacttggccgatctcctcctcaccgcacggcaaaggctcctttcccctttcccgcaaggctcccacgctgacgaaatcgacgccgatttcccgaaatccccaatccccaatccagaatccactcgcttttcgataaaatttctgttgattgcgtcgaaaccttcgcaatcctctcgcacgcatcacgccttgcgcgccgcatctcgtagccctgaattttgatttgattctgctgcctccggcgcgcccctgattggcgaggaggtggtggtggttgtggtgggtgcggccatggcggcttcgacggcggcggcggtggcaccggactggtggaacgacgtgaacaactcgccgatgtggcaggaccgctccttccacgccctcgccacgctatacggcgccgtctcgttcgtcgcgctggtaagccctagccctacgggacacgttagaatcgatttaggttttgaaaaacatgggctaataataggggaggatattgggtcgtgtagccgagcagtttggaagtttcgtctttaattgtctcgatcgagggcttagatttgatttaagctgatgttttgtgcgggaactttgtagcttaccgtatgcttgaattgtatagtgatggagacatgggcatcagtctcatttgagtcgtttgcacttttgggagaatttttgcaggtccaattgatcagaatcgaatgtagagtacctgagtacggatggacgacacagaaggtgttccatttcatgaactttattgtgaatggaggtgagcatacttttgcactttgccactgcttcattgatacatgctagctttttcggaacttcagtttatgattttggactggtttgtttcagtgcggtcaatcgtgtttgtgctccgacgagatgtgcaacttgtgcagcctgaggtttgtggggggaacagtttatgtttctctgacttgtttctgcaatttttttcgaaggtgcaaagtaggaatgatgcgtaaccatatggcattgtaggtatttcaacatgtgctcattgattttccggggcttgcattcttcacaacctatgctctgttagtgctcttctgggctgagatttactatcaggttagttttacttggatatattttggttttgtcccatgggtgtttttgttctcattggttcatgatggcatttgttaggcacgggcaatgtctactgatgggctcagaccagctttttatacaatcaatggagtggtctatgcaatccaggtgactttgccatccacatttcttactgttgatataattgcttctctctacaaactcatacatgaaactcattatcatgacaattggaaaacttgttactggacggatcatccattgataatgtaaagtgattggatgagtcccaattgaattgttatgtttgatagtatgctatcagaaaaaaggttaaacagagaaaataaagcaaacactatcataaaaccctcgaaataagttagttagcgtagcatgattccaactgactaaatcttgactgcataatgtacaattactcatcattgcacaaatagtttattttattgtggagacaatgatggctgttagcttgtggggactccctggatgtacactttctgttgtgctacattttggtgggcatggatgtcaaattaacctaccacttgccattcagagcatttttcagtgtggacatgttcacaaatttctaccgtattgagagcatatttcaatacatagaattacacaaagttttgctacctttcctttttgaagtacttttggaatgatctgatctttgcatgattttcagataatactttggatggcgttgtggtggaaaccagttcgagcaatggtcatcttgtctaagatgttctttgcaggtaaatcttgtgtaatttgccttgtcttgcagttagtatggattttttattttgaatgagagcttgtggaaatcatagctggagatagatgggaaaactatctgatcataagttaaaaaaattctcgcgtacgtttagttcctcacatcccctaaatattaatgaacatgaaggaaatacattgagtcatgataaaccaggcgtagtgcaattttgagttttcttgttatacatgataatttatcatttattctactaatacaaagttatttgccagcgacatctttatttgctgcccttggatttcttctctatggagggaggtaagctgtccttggttttcttatttttgttgttttgggtgtttgtcttttgaattatggacaagaaattagtatgcttctgaagttatttcccacatgttatgtccatgagcttttgtatattggattatttggaaattggaagtaggcatgcctgggtgggtgtgcagttattgggtactggttgcggtgattcttttcatagcatgttacttagtgtaattttgtggttatctttgtaggctatttctgatgttacagcgttttccagttgaatcaaaaggaaggcgtaaaaagttgaatgaggtactatcttttatcattggcttctattccagaattaatactttagataatttgcatttctaacacatctactttttcataggttggatatgtgacaaccatatgcttttctggcttcttgatcagatgcgtaatggtacgtcctatgtcaatattatgttagggaggtcttcagactttaattactccacttaattagagcatcttacagatgtgcttaaatgcgtttgataaagaagccgatcttgatgttctgaaccatccaatcctaaacttcttctactacttggtatgtcttcctgttcacttgctttgtactcaaccttgtagttttatacattgtttttgtttatctcgtggcatttatatcttgatctcctctaatgtcattgttgtttaatgttagaggctctgtgttggtcattttaatttgccatgttcgaatgttcacatcgaggaaatcatttcttacataattttaactggtgtcaaacaagggataatgctagaatgtgatatagacttgtggaagatatgtttcttttgcttgtttttaccctgattggaacatggggcacatggtgggtatgctgatatcctaattaagtgattgtgtttacaaaaagagctgaactgaaattctgttgggaatgtgactcaaggaaaaatggttttgctacattgtataaaacaagagaggaaactagtgaaagctatttatttggcagaacacagaaattgtatgtgcttatctgtgcataagcattccaaactatagcatattgattttgccgaatgagtttacaaaatgcttttgctgttggagtatattcagattgtatgaagtaattgagactcaagacagtcactgccatatttatttgcttttgtaagaatggtcattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatgggcctggatgtgtagtagacattgggcctcgttaacatctgtaaacttgagcaactgatattccaaagttgatcatagtgcgggaagtctagcaatgaactgttgagaagagaagatagatccatgttttgctatcaaacattgcaattataggttttgccacccaaaaggtatttacatacataatttgctgagttttatgtattacttttagtttcctttgttttcaatctggagatcattttcaaattgatcattagctgaaactggtagaaacaggacagatgtgctgagcccttgacattcaagaaatttatcaaattttcatcacccagttgtcaaatatgtttgggtgggtatgagatataggcaccagattgattccaatgaaccaaagccagtttggtcgaatccctaataattgtctgatcaaagaaagagagaaaaagagaacacatcgaaggtgacgaatcatgagtgaaaccgccgttaagcaaatcatattacgaacagtggcagatgatcatataataaggagtagcaaattctagagttgcaaccttcgagcgacaaataggcctaaggaggttggagaaaattacgaacctccaggtacaagttaccagtgttattagtcctctgtccgtcccaaaatataagagattttggacggatgtgacactatatccaaaatctagtgtcttacccgtccgaaatcccttagattttgggatgaagggaatacgtggaaggaacaaatgagtatatgaaagaaaatgaaagcacgcacctgtcaatcaggtcgacagcttgtatataccgggagcatcaaattcagaaccacacgaacaggttgtccaattgacagcagaggaatggagacttggagagggtataaacaaagctcatcttcatcttaggccttaggagtgcatttttagaggcttctattctgactggtagctgtgtgttcctgttgggaatatctcaatccaactgcgattcaactcccaatctaactgccatttcccgtttctgttgggagtagtagcgttaatgacgttggaccagccctgctggactgtttatgaactattgtacgtctgaattagtaattccaactctgctttacttgtccggacaaactctgacgaaattcttgtaaagatcttgtgaaatttgaacattccatatttccattctacatctactactgctacatgcaacacaggattctggtccaagacagtaaaatgcttggatgctctctcggatgccggcagggggaagggatcggcaggacgggcccaacaggaaggactcgtgtgcagacaccggacagagtgagagattgctgtgctttgggcagcagatgtgtcagtgtttatccatccattcctcggctaccttttgacagcaagaaatggatctccatagaaaccgcatggccccagcgaattcagcatccacggattctttgcttggatttgatgttcttcttcttcttgtgctatgctctctccttcaggccatccatcatgctcaagtctgaatactgaatccatggctttggctgatgctgtcatccatatagtgtgtgtgtgtgtgtgtgtgtgtgtgtgttttaatgcatgattcttttattgaagtgcattttctgatgagtagttaccgtggatgattgacttctaagcaagtgcggagttggtaagttgtaccacagacagacaacacgtatctcatgtacagtacagttcagcagggtaacgtagtacccttgctaaccagggtcgacagggactcgcagtagttgtaaatgggacatatacactgatagtggtactgttcattcattgattaacggctacacctacacctttcctttcagaaacattattgtggtcatgttattaattatagagaaaattgcaaaaaccaccccgaaagtcacttgaattttgacattccaccctataagtcattttgttgtaaatacccacctgctactaagttttgtttcaaaaaccaccccaatgcgcacgtgtttaaccgaatcaattcgttattgctgatgtaggattaccacaggctaagctagccaagtcaatcttgtctaagtgcttgcattagacttattttccatatttgattgattttttttttgcatatagcaaaactcagtgcaacaatgtttaggctctcgtcaacaattttatatgtggaatctcacaaaaaatgtatcacgaatactctagaagtatttagttttggcaaaggccatattgatggctcacattttataaaaatatgttgattcggttaagcatatgtttaccggggtggtttttgcaacaaaattgagtaggtgggtggatatttgcaacaaaataatttatggggtggaatgtcaaacttcaaatgacttatggggtgatttttgcaattttcccttaattatatgccaaagtagcaaattactccctctgttctaaaaaaactctttttagatgccatagcaacggtcacttaacacattattcaggtaatgttttttccccaactgtttttactgaactgattagtgctaacaaaacgagcggtaactcgccggtgatatatttttcctggctgaagtatgatgctttaccactgaattacatttggggaaaatggcctagcttagagtagcttagcaaacatccacacacaaaggtgaaaacctacaaagacaaccctgcacgcttatattttggaaagtagtatgtagtggtagttggaagatcaccatccagaaatgcgttgagctcccaacttgggacctatgcgtttgcaggaattagtggactatggaggtagttggtgccggccggccttacacttctttttttttttttgaacgaatgccggccttacactcctgaatttgctactccctttaaatttcgaattcagacggcatggattttgattataaattaccactagctcgtagcagatggttcttggccaccttatccatgataagcttattactgcatttttgtgccttctggttggattcaatctgaaatgtggctagagtagtttattactcctatgttgcttgatcattaaaaaaagtactcggttaacattgggatcatctctaaactaaattccattgtccgtaatttacgtagtaggctagtagttgtagctgaattcattgattagctctcatatctgttcctgtttatctgatgtacacagttcattgccatttgtaaacatcaatactttgcctagaaaacacaccacaactacacttcttctaatcgggacaactaagcaaagccaccctttttggtcaaagtcatgtattgcctatcattaggtgattgcataattacatgaacctaacccactgattatcctatgatgttagccatggaaggagaacactgaccaggaatgcgaaacaacagtactagatatcagcaagttgagcatttagcattcttatctgtgcttcccactaagaaacaattaggcatctttgtcggagcaatttatgcttgattagctgcccatgcagatccttgttgtcatttgtcaggtagtagtagaacacgtccacctgtttctaaaggaggacagaattttttcttaaaaaaaattgctgacattgaaatgcttttgctaccagaaaccaagaaggcaagaataatgttccctgagctaatgtttgcacgcccaaaaattaatcatacacctttggaaaagggcgtgccaaagagcatgaaccaaagagcaggcataagtttttgtttaaagaagatacggaacatgaacaatatatggaaaatggtgtaataaaaatacgttgcataacatttacgggaggaattgagagggtgaaaatggcatttcctttttacgctaggaagacagtctcaaagaagtttgcaaccgacgaaagtgcaaacaaataccattcccttgttctaaaatacatcattcatccaaaaatctaatctaaggtatatttaattttttagttttttaaataagataggtatatttatagtttatatgtaccgaattaaattgttaactaaaacataagaagtcattttaatacttattggttgcatgcatgtaagtaccctctccgtcccactgaacaaggcacgcacacattttaagattcattataaaattaagatttatttgataaatatttcattataaattaagatttatttgataaatatttcattggattgatatttgaatttactttcatataattgtgattttgttactataaacatcgtagtatttaagaatttcaaagttaaaagttagttttaaaaattgttacaactttgactgcacctcaagcttagtcagtggaacgaaaggagtagtttcttgatttgtcatatggtagatgagtttttttttcttggtcttgatgataaaagaaatatatcttaaacttttaaatggagagagtatatttatttctgaagactttgatagagaataaaaaacaaagataaaagaactatattactctttattaattgtcccgattgatgatagtcggatggaggttgtctagatacgaaacaatccttttaaaataaaatttaaatactagaaatagttatatttaagtgatcaaagggtggtaacttatatcacagggggaaacttgagaaatcaaaaatagaaggaatattagagatatacaaacaatatgtctctaacttaagcattgagttatactccatttatctcagtataaatatggcctaaagataagatatacgaacaacggagtattctcgtagttctgaaatatgtgcacggatagagttgtaaacgaaaaacccgagcattgtattgcaacaagagcctggacgctgaagcatgtgcctgcctactggctagggctgcacgttgatgtgagcccctagggttctccggtcacgtctcatcactatatgacacaaatattttcgtcctacccaagttttctttcacatattaatggactaataattaattagcacgtcactcagattcagagattcagattgccctccacacgtgcatctcctgtcacagtgtcacacaactcgtaaagtctgttggattaagtagcagtaatttgttagagctgcagcaataattcagtttgtctacaattatttgttggagctgtagcagtcactcaggcctgtttactcgaactaaaaagtaaagctgggtttagttccaaactttttttaattttttttaattttttcataacatcaaaatttttctgcacacaaattttcaacctttccatcacatcgtttcaattttaattaaacttttaattttagcatgaaaacacaccctaacctgaagaagtttggagagcacgtttgtctgtctcgcttgcttgctgcaatggcaaagttgtacggctcgagatattgctacattcaggcctgttttctcgcttccaacgtcgaggcatgcgtgacaacttcgactcctaccttcaggcacgctcttactacctctgtagtatttttttaaaaaaagaatcaacttatattcgtagttagaggttgactttttaatagagagtacgtccaaaatattgattacctaaaaatatcaattattgaaaatgaaataagattcaaacagggtcaagtaacataggaaacatatgaatggcaatagagcacctttatggtgctttctacggtatgatagtccagatttgttagaagagtttctgacaaccgcagtttctcccaaatccagaagctcctctaaacaattcaacattttgtctagatttttttaaaaaaatgtagttataaaattttagaaataaactagaaacgaaaagctataaagcctaacttttctatatttttaaaagctaactataaattaattgtttctcacaaacatatcctccatcagagtattagtattatcgcagtagaagtgatatcattttctgctattagcaaaatattttttactagtagttgatgtggtagtatgatattagattagaaaaaaaacggcttaaattagttcttttacccattagaacattgtaaaacacttcacggcagaattggtatatatatggtgagcatattgctatcgataaaaatgcctcataaaaaatgcttgtgtaatttgctccaaatccaagcacattgcaacaaaaaaaaaactattatcctattatagactaaataatagtctttcacgaaacaaggaagaaaggatccaaccaaatcagcactaaggctgtgttcgcattcaccttttcccatcccctttccctcgttttccgcgtgcacgtttttcaaactgctaaacggtgtattttttgtaaaaagtttctatacaaaagttgcttaaaaaaatcaaattaatccctttttgaaaaaaaatagctaatacttaattaattacgtgttaatggactgctccgttttccgtgcgcagaagttgggttcccatctcccccatccgaactcagcctaagggaagccttaattaatcagcttaatgagccccactaccactaaccacactataatacggtacaaatagatcatatatacactagcatagcacgaaatcgcaaagtccactaacatcccactcccccttccaagcttcttgtctcctctcctctccccaactcccacgccatctcgccaccaccaaccgattcaggccgcgcacgccattaatggagtacgagcgcatccacggccccccgctccaacgtcaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcagttaattttgcctcatttactgatttgattcaccacagctttccccaatttctttcagcttccactaaaatctttccttctttcctcttcctgctccagtcgggtggattctccccagctaagctacgagcaatgcttctcggactagagaaaaatcagcacaacggggaggacacatcgcctgaggccaacgattccggcgagctggacgaccagagtaagtccactaccccagaaatggtgttgcacagctcaatcattctcatttacggattcaccaaatcgctaattgcgtcaacagggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttggtaagcaagaaacttcaccatgccttttttaatttcctttttgtgctcttgaatatcttaattgataaggattgtggatttgtggtgtaatcaagaagttttagatgatgttctagtgacctgtgagagccacatctgtggtttggtgtgactagaatttcagcctatctttgtctgcaagttaagaggttgaattagcatttctcctgattgtttgtgatgtagtctgttactgttaggttgaaccaagtattgttcggagactcgtagtgttaggtaggcaaatttgaagtggagtagagtgaattgagaagacacgtaacattgtgagtagccggtgcaaaaagggtctgaaattgatgtttagctgtttttcatgacaggaggaatattataattcatatacaaatttgttaaatataaaatcagaaagcaaacaaatccatctgttttcattagataaacctgcttataagtctatgtgccttatgtatcgcccatttaaatgaacagttccggtatgttgggtgaatgcctattccagggatagtttatctttcacttactagttgctataattcaaaatctctctggcttatacttcttagatgacagcaaataaattttgtttcctctatgcttctaccttttgtaaaattcagtatgccactgacggaaatgtcctgttctattttgtttgcagctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtgtgtgctcattcttggctatctactaacagatactagtgagcttgtaatgtgataattctcaaatcaggattaagtagggaaaacatgcaagcttgcattgattaatattaagatttaagaacaactagggtagcccatctcgtagaaatataacgcatggcaaggaaatcaaaacttcatattgctaggcttatctgaagaatttgcacatttccctgacagcatgtttatctttcttttttctcctaccctgcaattctaggtttcagagggaagaggtaaagattcaagcttgggaaaaccaccagaaagcaaaaattgaagctgaaatgaagaggatggaggtagaccatcgatctccctttgattattttgatgatgataccatgtatactcttcaaccaggccaatatatgcagtttcctagtttttatcactggataaaatagcttcagtaacttgtcaaaatcattaaactttctctgcaaaagggctaggagtacatcattagcaccaaaagtgtcttattctgcattggaatgggactgtttatgagtttatctcatgacacatctatccaagtccaagacacagaattgaacagaaacccaagaagcttcaggcaatttcaatttctgacaatcacctacctctgactgaattgcaggcaaagatagagatcaagagagctcgcgagcaggacaggctttcgagcaagttggcagctgcaaggcacaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcctctcgatttcactgatagaatcagggcgtatctacctgcataactactccctccgtcaaaaaaaaaaaagacaaaccctggtttccgtgcttaacgtttgatcgtccgtcttatttaaaaaaatatgaaaaaattaaaaagataagtcacgcctaaaatattaatcatgttttatgatctaacaacaatgaaaatacgaattataaaaaaatttcatataagacggacagtcaaagttggacacggaaacccagggtttgcctttttttgagacggagagagtatatattattactcgtagcgacgacgaggaattaaatctcgctgttattcagagtgcagcgcgatcaagcctggtttcgattggggagggggaaattttaggctgtgtttagttccacgctaaagttgaaagtttgaagaatttggaatgatgtgacggaaaagttgaaagtttgtttgtataggaaaattcgatgtgacggaaaagttgaaagtttgaagaaaaaaaattaaaatctaaacagggccagggcctgactgttttagaagaaagctgccacttttaccttgtaaacccacgtacacaagccatatatggcccggatggacggatgcgaaaaaagccatatatggagatgatataaaaggctaaaaattgtttcctgtagtgctctccgtgcctctttcaaatctacagattgccactcgtccagtcatcctctccgcgcgctataaaaggctaggaaatcgcagcgcccgccatcaaccgatcgatctcctctcccccgtctaatcgatctgttcaagcggattccgacgagacgatcaatggaggcgccatcggcgtcggcgtcggcggaggagaggcagcggatcgagcgggtggcgcggttcgtggcgcgtgaccgggacggcgacatggcggaggcgctgctgctccggctgttgaagatcacccgcaacgcccgccgctggggattcctcgaccgcgaccaccccctccacccgtattacctccagcagaaggtctccgagcagtgccgcatcctccgcccccgccccgccgccgccgccgccggtgatcgctgaccagatcacgtccatgggactcttcttcttcttctacgcccacgcggacaccaccacttgtgctcagattttttattatttaatttatatatttttttaggatctttgtcaacattaatgaccccatgagatttcctcttgagattatacgagaatcagcggctgttcatcatcagccagatcaaagctaattaattaattgctcgtaatgcggcagatttgaggcatgttcttgccgtgtactcgcatgtgacaactatctgaatccctgaaattgcaagggcaaactgacacccaaatgggcctaatctcgtcggcccaggtatcaaaaccaagccgggccgtcccaagcaaattgggtctcaatcctcccgaatgggcctggggacatgtggtatcttgaattgggcctcaccttgtcagcccacgtgaataatttcagcgattgggtcgacgcgtgccactgcgagagaaacgtgttacctcgggttctctcgagaaatttcattatttgatatccaattcgtaggcctttcagggcaagccactcaatacacactcctttcagattttgtcactgagatagcaaattcctttattccgtgccactccgtcgccgatccgtccgtccgtccccaacgccagcttttccgtcgtcttccccacctcgtcacgctcgtcaccggcgccggcgtgggccaaactcttggagagttggaggggctcgagctcggactccggcacggatgggaggaaccagtcgtctctaatcttgcgaagcagcagcaactgattgtgcatagatatagcttgtgtgttaattgcagctcgctaatttcttccctagtttcttcgttctctcccatcaattagttgcgtaatgtgatttctttcttcttcgttctgacttctgaggagcacgcttggtagtttatcaatgaaaacagtagattcctctgtcagttttctcaatgcatttgtttgggaagattaacaattttttgctgattatggcatggaagagattagctctgcagttctgcctggtgctgaggtcgcacgtctgcgggattagatatggccttcgttcccgatgtggcccgggttcgcgaaggtggccgctcgccggctacgtcgaggtggaagacgctggaaatttcttctccgagttgcccaacgattctgcggtgtggagggcggccgcgacgtctgcggctggccccgcctcgtgcgtctcggctcgcccgtttcgatcggctgctgctttgcgagattacaagacgactggttcctgacatccacaccggaatctgagctcgagcccctctagagcgcagcccacgccggcgccggtgacgagcgtgacgaggtggagaagacgacggaaaagctggcgttggggacggacggacggatcggcgacggagtggcacggaataaaggaattcgctatctcagtgacaaaatctgaaaggaatgtgtattgagtggcttgccctgaaaggcctgcgaattggatgtcaaataatgaaatttctcggttctctctctctcccactctcgccgtcgctctccgccattctccaccgcccacccacaccggaggtcgcccaccaccggggcctcacctcctcctcctccccctcgtcatcaagcagagggggtgatcggggtcgccgcggtaagcttccctatgcttcgatctcgccagctccaatccctccctcgatttctccgattcgattccgtatctatggccttgtactgtttggttgtaatcacaattttggtgccgctcgggggtgcgcggatgcatgtgaaacggagaaaaattaggtctcctgtgcgcgattagggtgagatgtcgcgatccccatgcgattggcggacgtagatatgggtgtggtcttggtagggttaaaggtatcattatcacgtaatcacggtttagacagagacagaggagataaagcatgaaagaggcagtcatatcgtgatgggccattatattagtgagtaaaagagactgtctttttctatggagggttttgtttagtatctagtgggtccccatcaccccaaactccacaggttttgattctgatggcgttgaagattctgtgttctgtagttctcactaatccagttgtgtcgggctcctgtttcgttttccatttccgtgtgtgtaaattgttaaaagtttctgcttccattttggtttctcatacagatggatcctttggaatctgaaggtggctcacagaaatccaacaataagcccaaatgtactctctttttgtccccgtgccattttttaattggcctcgaatacatgttgtattgctttagggatttttatattgtttcatggggttgatgatttattttgtatgcagattctaagtttacgcaacaggagcttccagcatgcaagccactactaactcctggaattgtaacttgcccatcaccaattttactatcttcaaatatgcatattatactacctattagatttatgagttccttttatgcgattgtacgtgaaaatacataggtggttgctaccttcttgctgattggtatcatatttgtcccaattgggctcgcgtctctatctgcatcgcaagaggtaaatgcaaatttgcgtggccagattgttgttgtcttttgtcatttttatggtgcatttgtttattctattactcgggtacattgtagatcgtcgaactggtggatcgatatgacacaaattgtgtgtccacgcttgacaaggttgggttcattcagaacaccgatactgacaagacatgcacaagaacactgactgtgagtatcgaatggaaatgtcaatataccttgcctaccacttatcatgttggcccttaccatctcttagaaatatgcattcaattgtttttgctaaagaaaaaaaaagatccatgatggattatctttttgttgtatgtgttaggtgcctaaacatatgaagagcccaatccagatatattaccagatcggcgacttctatcaaaaccatcgacggtaattcgtgcatgacattcctcattttgttttttttaaaaaaatacttccttttttattccagtttgggatttataagaaatatgaaattaccggtttgacaccttttgatttgatccctaaatttattgtattcttactggacatcatttgatttgaattatgtgtactttgagagcatcctgtctgcatgacttatgttgatataatctgaccaattgttgacttcttatgtatataggtatgtgaaaagtcgaagtgataaacaattgcggtataagaatgctgtgcacttgacaaaggattgtgatcctgaaggtaatactgttgatggtgctccaattattccatgtggccttattgcttggagcttgttcaatgatacatatacaatttcggtgaacaagaaggccattgaagtgaataaaaaggatatagcttggaagagtgacaagaccgataaatttggcagtgatatttacccaagtaattttcagaagggcagtctaataggcggtgctaaactaaatgagagcatacctgtatgtgtttttcccctatgtacgacatggcatattttgttacctttatttcatacattttcgtctcattgacattttgttttttctgtctctcctgtcataaatagttaagtgagcaagaagacctcattgtttggatgagaaccgctgccctcccaactttcagaaagctttatggcagaatcgagacagatattatggcaaatgatcaattaacagtggttatacagaataactataacacatatagttttggagggtctaaagcgttggtcctttcaactacttcttggattggaggcaaaaacaacttcattggtgttgcatatctgactatcggaggcctatgcattttccttgcagtgggcttcgtagttcttctctacatggttaaaccaaggtacgccatgttattgctgccttgctggtataatgtgctcgctactatttcatatgcacacatgcatgttttgaggattacctccctcgcacatgatcccttcatggggagcctgctattctgttatttccatgtatttttacctgattatgtatgacgcgcttcatcattgtgctaattttggtacgaagatgcgatatagaactatttatttccatcgttgctttagggcaaccacaatgtgcatgaaaactaaacttaaggaataaagtagtaatttttgttgtacctttatacattgggagatgagctagggagagaatagtgctatgggcaaccttaagcttaaggctataccataagaattaaaaaaatatatcatggctttacaacatgcatgcacactttcaatcttgagtaaatatgtgttttttctcagtgggtcccaccttaaggtcaagaagctaccatatactccctccatctacttttgatagtcatatttcatcttggcacaatgaccaaggataagtaattctacgtatcatccatttaaacatgctactagttattcctcgtaaacaagtgattcattaatatttacatttctcgatgcctatgtagccaatcttgtgtggaagaatggagagtcacgcattaaatccaataaaatcattaagaggataggtggttggattgaaatatgcctatcaaaaataaatttttcagattttgaaatatacctatcaaaagtagatggagggagtacattgtagcatgtactataggtaaaaaaacataagaatgtgggtctcatcttatggctcaattgatcttcaacattgaggatgtcctaagtaggaaacctgagctctagggaccagcgtaatgcaatgttcagcattgacatggttgatattgccgaacataccatgtatatttttttgaagaaatttgaacttcgaactgttgcactaagaaaatcatgcttgattcctttcaggactcttggagacccctcgtacttgtcatggaatagagatactccagaccgtccaaactaatagattggaatctcttttctgatatataaatttaataaaggatcatttcaatgggtaaaatgtgaaattcctttacctgaatctatggatgatgttatgattcctatctaacgtgtttgtgatagcccgataggtccataggcatgagaatacatgagacagtgtactctgttgactccaattttacttgacaagaacaggagttgttcaacttatttctgactataaattaacccagagttcaactatagtactcattatttcagtgctcttttcacagtttcctgtctgtatcacacaaagataacccaaatactgtaaccaacagtaactgaaattacaacagttagtacctcaatcttatactatatttaggagattattcaagaagatattgaaatatcatatattgagaacaattctttcattgtcaaatgatgagatagatacatagtattccttagacatcattgtcctttgtcaccatgattctttctcaaatatgcaatctagtctgctttgtttaaaacttcaaatcactttatcggcaacctgtaatggtctcagtggttaattgccatagttttgtgggtacagtagctgtaaggtcctctgtcttcatattcatctaaggtcatcactggcagggcaagattgttggctccatgggtgttgatatgcttctactacacatttcggggacaacttcagtgaccccttcatcctgagtaatcattgttttactgataagtaaccttgttctggagagtgagtgaattagtttaaattaagaaaaaaaatagttagcctgggcattagcagcaataccttcattagattcctgaagtaaattgttgtgtaattccccgttggaaagaaaatttctattagatcagcaagaaccaactggggctgggagatagctccatcgaaccaatcttttttttaaaaaaaaaaagaaaagcaaaagcaaaactccattagacctttacataggttgaaaaacatggcactggagtttgagcatggttttgtaaaaacacaaaaacaaaactatatcaagagacctagtgtagagcatagagaaaagaattaccaagtttcttcgaatatcctattcttttatcaaatctccatatgctacggttggctacaaaactaaaacaagagtcacggtccacattaatgctctccaagaatgtggatagtttgtactctgcaggatctgaagcatatgtctgatctatgaccacatcaactgtctgaaaaatacataaaccaaagcttaatgttagatgcttaacaagtgagggtcatttaaaacttttgtgaagtactaaaacctttggtgtttcatagaaatgtccaattttgcccttgtctagtattagcattctgacattattttaactaagtaacagttctccagctctccaaaaagaaacgatggatctttagtgcatcatgagaaatagtgagacagatgattactctgacagttatgtattatcgatactcacacaaagaatagcatggaagttatccatatcctctggatcagaattgttgaatctcttattagtaatagttgcatcaacaacctctgctcctgcatctgtgacatactgcttatggcataaataccaaatgcgcatgagttgtctccatttcatttgtttagttgacagttttatgttcaaagtgctgcaataaacaaatgacattacctgtacaatccaaccatcactaacaaatgtccacataccctacagtggtagaaggaacatattgacaacaaagtatggtgcattccaaaagttacttatatggaccagaaagtgatgattttatttagtaaactgcttacctgtgtgaattcaatccatgccactataggtttgaatcttgtgctaagattcgcagctgctttgcttaagcataagtagtttgcctttatctgcatcgacatgctagataaatgagatcaattgtctataggtacttgattggacattgcaaactaaagtggtcttaaactagtttctttgtgctaatgaaactacagttactttttttttcgccgggacggcgaagaatgccgaccgatgtatattaagtaaaaggggaaaactgtacaaatgcagtgcgtcagagcaccgcctttacaacaaaaagcaaattacaaactacagttactttaaagtggtactatagtaaatgcattatgagcgcataaatgacaaagttcttgcatggtcatatcaatgcaaataaagttaaatttgctggtcttaactgcgtcataaactgtgttagccctatcttctgaatttgtgaaagctcccaagtacttgatccactcagccctctggacatagacgtttgaaacacaatattagtgtgtttgaatgctgtaatatttcaaatggagcattaaaaaaaataatcattgtttacttgcaatggtgtcccctcttcagagggtacataagctgcgaaattgcagccttcatctgtagtgctcaagaaatgtgcactaaattgtgtgagcatctgtgcatcggtcttgttaaaaagctggacatttccacttgcatatgattggagcacacactgggaggcaatttgatcagatgttatccccttcaagttttgtaatactccaagtagctgcatagagtgtcaaaaagtgctgcagggatcaattaatatgagagtcagaggcataaaacatttgcttctacagatgatatgtttttcctgttcagtttcagctgttgcttttgcttcattatctacgattgtacagattccgcattgaacagtacttaatttgtcccgcattgctcacctcgaagaatgacactgcagatgaaacaggaaagaacagtaatctgatcagtttcctatattgtgtacaaaaaagaaaaagcaactctaagtacttgctatgaaacaaattgaagatttgaacgaaaaatatcgaattgaagtttcgtatgtgctgctttcagtgtgtcagtttgcattatgtaactgttgcaagctatggcgccactccgaacagagaccgtttgaattgaaatgcagtctttgctagatcatactttgtacacatattaatatcgaatggttaacataacaactatataacagtggattaaacttcagtgcaagcataaatgcatacataatccagggtgtgcttgatttctacctggagaagccgtggtgtcgacggagtaattggcaagagggataacgaacgacttaatcctccccgtgcaatacttggtcttggtggccatcttggatgtgttctacgcagctcaccaaatcccaaaaaatcagcagaggtttatgtgccattttttgtgcaagagcaatgcgtactgtacctacctgcattagaaggtagctcttgccgttccagttgttcttgacgactttgaagctctggccgtagtatatctggaacctggtggcgtcctccaccttggacaccggcccggccaccaccggcggcgccgcggccttcggcttccccgccggcgacgagctcttcgcgccagccgccaccgcaatgtgcgtccacggcaggagcaactgccacagcaccaccgcctgcaggcagctactacacttataacccatcaccgatctcttcttactcggatgagcctgaaaacttctgaagtagctagtataagatagtaacaagactagctcgagttgggcattgctgtttcttttcttttcttccgttttggcattattgtcgggcattgtggttgtagtagtagtctagtctgaatgtctgatagggagcccgtgagcgagggaggccgtacgtgacagacaggtgtggtggtgttactcggaagaagagctggagagtggcggcctctttttgtcacggcgcggaatcggtaggattctcgtgaaaataatggaggatccatccattatttttttttgaacggaaaaaacagcacagatgtgccttttcattgaatagagcaggagaaaatacaacccctaagggtaaagaaagagaactatggtatacactatacaaagtgcgggactagatcgcgcaatcttttagctcccgctagagcccaaagactagcctcgtccttgattcttgataggaggaagcctgttgccatctctttgtggtcgaatatccgtctgttcctctccttccaaatttcccagacgactagcataatgagggatcgaaggcccttttttgggacgccaggtgtatttgctaaactctcccactaatgttggactgaccgtgcttcctcccactcattaggctccaattgctgataacccgtccaagaagcaactaggctccagattctcttcgtgtatctgcacttgccgactaggtgtattcctgtctcaggttcagaacggcagagagggcaatgcccattattttgccagcctcttgttgcaaggcggtcagatgtccaaactctattttggatgatgagccaagcatggaatttgcattttcccggcgcccagactttccaaatcagggagtttagatttgagtttggcgcccctaagcactgcgcatgataggccgaggaggctgtgtagtgcccattagctgtgaatttccaggcaatctggtttggctcttcactgtttagatgcacattccgaaccgtttcccacaggcagaccagttgctcgacaaggctgattgtgataggcgtggccgcatcgaaggtcagatcattcacccaggcgtcaccctcttttccttggcgcagggactttcctctatttttggagatagcatagacaagtggcatgaggtcttttggtctttgcccatcaatccatgcggcgtcccagaagcgtgccgtattcccatctccgacggctacctttgtcgcggcggcgaaaaggtccttgtttaaaccgtcacaaggcgtctccagtcccgcccacggcttggtaggatccttccattcatgccaaagccaccgcaatctcaaggccctagtgaacttgtccagatttaggactcccaagcccccctggctggtcggcaaacacgtctttgtccaattgactttacattttcccccggtgatatcactcgtgcctgcccagaggaatcgtcgtcgctgcttgtccagttgctccaaagactcctttgtcaccttcaaggcagtcaggaggtaaattggctgcgctgagagcacagatttgacgagcgtggtcctcccggcagcttccatgttcttacccctccagcttgcaaccctccctgatatcttgtcgaagactggttgtaaatctgttttccgcatccttcccagaactagggggaggcccaagtattttaggggaaaatttgccctcattgctgggatgccctggaggacctcagtcaggtctatgttgtcacatctgatggccgctacttgtgatttttggaggttggtgacaagtccagtggctgtgccgaaacgatgtaggatgtccgcgaaagccgtgacatcgcctcgggtgggattaatgaagatgacagcatcatccgcgtacatcgagatccgcagtcgagtcgttcttccccgaagttttgagattacgcctagctctgttgccttggagagaatacgctgtagagggtctatcgccaagatgaagagaagcggcgagagggggtccccttgccggagtcctcttccatgcttgattcgttgccccggcgagccattgaggaggacttgggaggtggaagtggatagcagagcccctagccaatccacccaccttgtcgggaagcccctttgctgcagcaaggccaggaggtagtcccaacgcaccgagtcgaaagccttcgttatgtcgagcttgaaaagcaactttgcccgtctcaggcggtgataacttctggccatgttccacacaaaaaggaagttgtcatggatacttctcccttttatgaaagcactttggttgaccgagatcaaggcatgcatgtggggcctgagacgcaatgcaagcaactttgagaagatcttggcaatgctatggatcaggctaattggcctgtagtctgaaacactctcggccccatccttttttgggattaggacaatgttcgctgagttgattaggttgaggtgcgcacacctaagattgaagatggagttgaacactagtagaatgtcctccttgatgatttcccaacaagctttaaagaaagccccagtgaagccatctggtcctggtgctttatcggctggcatttccttaattgctctatgcacttcctcctcggagaacggtttccccagagtggctagatcgaccggcatgatgtccagtgcttcccaattcagttcatttggcctcggccccgaccggcccatgaagctcgcaaaatggtcatggattgttgattccttttccccatgcgttaccgcccagccattatcctttcgcagtctctggatagtgttttttcttttacgcacattgatcttgaggtggaagaatttcgtgttcgcatcgccttcccggatgtgggttaccctggaggcctgttttttccttgctcgttcgatggaagcgagtccgaggatttttcgcttgagggcggctctcagccacatttcctgaggtgatagatctctgtgctcttgagcaacatcgagcctttggatgacgtcgagcgccatgtggaactgcagcttggcctccgtgcagatgccttttgcccaatctctaagaccgaccgcagtgcgctggagcttttggttgagccggtgcataggctcggtgtgcgacgatgactggctctagagagccttgactttgtccttgaaccccggtatccttgtccagaaattttcaaacttgaatctcctcggactgcgtgggcaatgcgggttggagaggaccagcgggcaatggtcagaaggtccagtaggtaaggcatgaaggacatggtgggggaaagcaaggtcccattcctcattgcaaaagcatcgatcaagtttgacgagggtggcccttcgacgctcgttgctctaggtaaacttcctattctgcaggggaatctcatggagctcacatctgtcaatgactgatcggaaacgtctcatgcgtgctaggttgatattgctattatttttgtcttgtgctcggtagatcatgttgaagtctccaaggattagccacccttccccggagctgggccttagtcttctgatatgccggaggaaagcgtccttgagatggtgcctagtgggcccgtagacggcagtgagtaggaacgtggttcctgtgactatgggcgtcacttgtgcggagactgagaagcggccgattcgaacctcttggacatccaaaactccactgttccaaaggaggaggattcctcctctcgtgcctcttgccggtttaaaagcgaatttatcgagcttgtagcctcctaggaaacgagcgagtccgtcgtctatgttctggagctttgtctcttggaagcaggctaaggtgcactttgtgtccagcataagctcgtggaccgtgttgcagcgcgcaggtgaatttaatcctcgtacattccaagaaatgacatctagactttgtgccatttatcaacaaaagttctctgggggcatgtacctgccttcattcgatttggtagtgaaggtgccggcacaaaatggtttggtggcccaaggtgaaacggcggcccaacaaatgggcggctctgcccagcttggctagacagcccgataagggatggcggcccaacaaaagggggacgacggcttgggaagcgacggcctttgggcagcccaacgcgcagctgtgcgcgcttagcgtggcccaggattggatgcgtgtgcgcgctgacgcgtgggcccgtgtgcgtgagagctgttggcgctcggccactgacgcgtgggctagggaggctgacagctgctgtcatgggggctctgacgctgacgtgtgggccggggcgcgttccgcgaccccaaggggaggccgagccgttcccgggcgcctgtaaggtgttcggccacggtccacgacgcggcttggtggacgagtctgtccggaacggcgacgagggtggcggcgacgagggtggtggcgaccatgcatagcagaggcaaacacagcaatccacgcagtgaagagagggaataccaggttcttgccgacatcggctacaaaagcacaagtagtctttcaacgttgttgggcaggctgcacgcaggccgccggcgatccaactggaggaggctgctcgcaggccgccggcactccattcacaaagcgaagaacaacgatacatggagcagagatgactcccgagacaaatttcgcagtagcgaagacgcattaggcagcgacgctctgctctgcttcatcggccgcgtcggcgatcccttcgccattgttgcgttactgggcagaaaaggttgtggagagtacttgtcgtcgtccccaggtgtcataggctcatggctcgtaaagacgatatatgcgtgtcgtcgcgtggactccgggtcggggagagcgcgcgggggcgggccaggtttcccaaaccgtcaggaccgggtttaccgtaccccgacggtaggtaaccgtgaaaagccgtgcaaattttatcaaaaatttaatttttttaaatttatttaaatttaaagatgttaccatagtatttatattaccgtgcccccacgataagcccgtaaccgcggtaaccgcacggttactggcggtaaagtaaactctggggcgggagccgccaccaccaccgcccccaaattcaccccccaatggtggctcgcgttgctccgatctgcttgccaccataccatggtcggcctgcggcgatggcttagctctgccttctcggacggggttaagcgccacagctctgcgtccatctccatggcggcgaagtggtggaaacgctgcaccctgaacagaagttaagaggatccacttcctaggagagatgagtctggtacagtttacagttgtattgctgataggataggttttcttaactttgtgcagtagcatttggaagaagagctgccagctttgctagcttaaggttcatcgccggctcgccgcaccatgtaaggcagcgtgtgtggtgtgcgaatcgtgaaaaccaaacaaatcgatcagccgcactagcactagaacatctgcaccgcttgctgcagacgagtacatctagctaagatcaaacatgctacagtcaatgtgagtctagctttgaccaagagggcatctctcattcagtagaccgccaaatacaatgccaaccattatcacgacattcagagctcaaattggccgccaccgtgaatgaaacaaatacaattaatattgaacattatgtgtgtttacatgtatatatatgtatacatctgtatttgcacttacaaattaacgatagtattttgatacaacagggttagacttagaatggacgacgaacaaataataattaattgacatacattctccagttatacaccagttaataacagagacacgaagacagttaattaatgttaaccttctcttcatgcactagctaggctcgcgctactgaggttatagcagattatataacagtagtgtcattaattgacagtcatggaaaagaccttttagtgatcgcactcagctggagtgctgatggccaacgcggaggttagaaacgtccatttcccactcaaaaacatgctggaaatgcccttccctttggagagcggaagccacaatttgttgctcccttcacgaccccatcccggcttcatcacttctttcgccttcttcttgaccagctcttgctcagtagggcagccattgatttgcttcggtgctaaaaggagtgacacaatctgcagcagctcattcactgtggtttctttgctgcccaacctttggtatgaatgtgatggcctcatcatcaagaacttgtcccttatgagtgccttgaacttgctaaaaatggaaaccctaccactaactttggtcgtaacggggaaatggaacttctcggtcgccttactgacggcggttgctgccgggttcgagtggaagctgaccttcttcgatggctcaatgcggtggaagaatgtcttcgccgcagcgacccttgaaacgaatagcctgtggttgacgtcaaccttctcgtacagatcgaaagatgcattagggttgacgtcgtcgaaaccagcagcaaagtcgtcaggttgagattgcgagaagatcggggcagtgtcgatgccgcctacgtcagtgggatcggtcatgcgatgaccggcttctcctgcaatctagctctgagttagtgcatgcaagaactgtatctgtatacagtctgtatcgaatatggaatactgctaattacttctgtggagcccatgtaaaacagccaaaattaaatattacatacctgaattatctgcagtgacttttatagggtactgcgcgatgatgtcttctgttggattgctttcatctccttctacaacaatctgcttgagacaaatgaagcatgaaagtaatcagtctcatgagatgtagtatatatataatgatgggaatatacttgtataggtatgatgcaaacaattacctccccaaggtcattgttcaccaacttgactcctctaaggttctccacccgcttcttctcgtccttgaacacctccatgtcagcgatctcgacctgtagccttgcggattcgtggtggttagaagtgccaacgccgcccatctcaactagagaggacagttcattgacgtagctagcactgcttgtgctagctcctaaccacatttcagggtagctactggtggagccattaattagctcctgagaggcagtcgcaactgacaggaattcttggagaatgtcaacttcgttggggttactgcgaagtatgccaatcttcgtgtcaaggctgacgtcctgtgggaaatcctccacctccaagggaggcaaggtgagcctgtgctgcagcctcgcacattccagtgcaacatccacctgcatatgaatatcattgcaccggtaagaactcattgcctgaatatacatgtcatctgtaccagtaagtaaccttcatttttgactatatatgtatatgtaccttggatggaaggcatgagaagttggcagaaactgggttcgtcaagaatggattggtggcgttgaaggcatcttcactcagaaactgcatccatttgccatcctcgtgaggtgcactcatctgcattccaaacccaccgtgcatggagtccattggcgtctctgttgggaaagagaagctgctgctctcaaagtcatcacctcttccatcacacgacacgtccaacgttggggagcgatcgatactgctcgtcatccattgaggttgctcgacatggtggtgcaccacaccataatgctctatgatctttggcccgggcgctgtcttcttgaacacccggcataaagcatatgcatcctacatatagacacacaaatgcaaagaggttgcatatcagaggccgcgtccatgtcaagcagctagtaacatattttactctaggtttataatttcagaaaagaagggctaaatataacatatatggtttatccatatattatggttgtagatttaaaaatgcaacaagattaatagtaacacacctgtaagccagtgtcagtctcgcattccctctcatcgaggcggtactcgtgcatgacccaatcggtgcgagaaccatgtggagctcgaccacggtagtacacaagagtcttcttcataccaactgcacgcctctgtgagttcacttttcgatctttcccagttgccttccagtatccggcttttgttgcacggttcgtccttgatccatttgggtacttgcggtctctagggctgaagaagtaccattcgagatctttactcggaagaaaggatttttctgaatattgaacgatcagttagggggtgtcatacaaacaaaaagtcatacataatcatgcatgcagcataaacattgaagtacttgtctactatcatgattggatctaatgacagagttaagatatggctatttaacatgatagcccaccatagctgaaagaaaattagaccaaggtcactttatatctcttggaggctgtgcggacttttgttcatcttcttgacctatatgttcatcacaagttcctttcttagtttcttgctttattttgtcaccccaagaaaaaaggctcatctttattttctctttttattcgatatttttacagcactcgcttcgtagaatgttgaatgctacatggtgtttttgtagtaaactgtcaagcttgaaagcaaacagcaagtggataaagagagaatatatcttttcctcaaatctctctgtgattgtgacatggtccaaaatatataaactttaactttgatgttactgatataaaggatttattttccatttcaagtatctcagtgcatggacgtatataatgtcacctttacacttggcagaaatttgacgtttctttttgaaggtaaatttcttttgacaaaaggatcaagatctatcaatatccctcctttcggtgtgcataagatgtttgaaagtaaagcaaatttcacagtatgattaatcttgttttcacacaaagctatgacagtgaaacatcgcttttgacaatgcttgattttttatatataaagagaaaaaaaatcaaatatgctttgatataactagcaattcaaatgtaccaaaatttacgaattaatcatggaaaccttttcttttgtgacataaatgacataaaagctacttatgtgaaataaaagaaaaactaaaacaacagatagagctacacatttatagccaggattaattagtgattattattacatacatttcaactacaaatagctagatgaagtgctcatcaagaagggaacatgtggttattctttcctcaagtagtgtaggcactggtgtttcttgggagggcataatagtataagaattgaataagattgcttagtgtctacataacacggcatccaataaacatactggacctatatatgtgctttccttggagaacaataaaggtgcatgcttgcctatagttaattgttaacctgaattttaacatgcatataaacttaaaacttgtccttatagcatttatacaaaagtctcatacaaattatatatcatgaaactgctattcctacccttaaaacaaaaagaaagaaactgttactcctatatagcaagagaatgatatataagaacgccaattggtgatagctgcatgggcctagggttggattgaaatatatatatcctagcatgggctacagcattctaacttctaccaccaacaagcaacataaaaactaggaatagatatctttagaacaagcaaactaagaacataccaggcagatcccaaggctcacacttgtaaagatcaacctctggaatgatttcgagttctatctgtcttccgttgatcttccgcttaaggtagtagatgattagttcttcatcggtggggtggaacctgaaacctggaggcaaactcacgggcgccatatgcttcctctagccttcctctcaaaactccaacagcaagagatgcttagagctaggcaggcagctggcaagccggctatccaaagctaaaatgtggacagccaccgaacttgtttgaatagctatatgaatgaattataatcagctacaatgtacaaaaacctgcaacatacaataacacatagatgagttaacaagaatgtcatgcaagtaagacaaaatgaagaggatcgaggaggaagagaggagaccttgatgctattggctaatggcacatgagagaggaagaacaagagagggagggaaaggggctgcgggagggagtgtgctttatagcaagttttccgagagtattttatgtatatgtttggattcttgccaactttctcaagaagctactactcctccatgtacagctctctcgctctctatgtctctctctctcaccttgggtgcttttgctttctgttgtcttgtgtcagttagctttagcggtgaatagagaaatatcccaatcttctctccttgtctttggctgccaataaagtgaggccctgtagctccagagatggagagatgccattggttgctttgtggggccaccatggctgtgcctagtcagctctcgttggaaagagtgaggggcccaaggttggtactcgattcgcgcgcttttttgcccctggcagcctcccccccttccctttgacggtttacgtcacgttcacacacgcgcccccatgtagattttgccgggggccctgcctcgatgcgtgtgccctgcatgattagcagctaatccatgtactatagtactaatactttgtcaaggagctgattaactgtctctcaactgagaagcacaatgctgagctcaagtttacctgtacattcttccgttctgggtgtttaagagtggatgccatgctcggtaaccgatgtgatggatgcagcctgctggccgacagtaagctactaagctggtcacctgtggagatactatcaagagaaaagttagtgttgaatatattttgattgatttctgtatattgtgcaaacttcaggttagtactctgaacgaatgtgcatgcatgcatgcatgcatgcatgcatgcagtggaagtcaagatataattggtgaatgctcataaaactacttcaaggagctggcttacgatttaaaatagtacataaacaacatatattatgaaaaatgcaacagccataacactagaatgcaatagccatgaccctaaaaaaatgcaacagccatgagatcaaggaatcaaatgacacttgcattgttcagttttcacagtttggcaagcatccatccaaggtgacaaatttggcaagcccatttgccagaaacaaaggaccctaataagagcaggtacaatagcgggctataaaccagctataaacatattttaaagagataaaggaagagagggaagagcagcgggctacagatctgtagccagctgcagcacggactccaagacgtaacgagtgtatgacaggtgagaccgggtattaatagtatagtaagcaattattgtatgaattggctattacattggctctagatgatttggagctagtacttggctatactattaaacttgctctaaagattgtgctcacaactgtccacactgaaaggattgaaaaaggcttctgttggatctagtgagcaaccagaaatccaaggtgaaaataggacccactaataccaaaatgatttcgttcacatttgacccacagttatctcattttactatggttttcagtaaatataatatatccacaaaccaccgtccttttactgaagtcagcaagagcctgctaaaagagccattttatcctacaaacatgggcatatcagaataaaagagatcactgattaggatgcgtttgaactatggttagggacaacacaattggttggtccatgatcgaattatactctccaattcattctagctaggtatgcaatgaaccaatgatggtgacgatctctcagcagctatcaaaaagaaaaggtggttatccaacaaatgtactgtgatagccaggctttcgacacgttcctctgctaagcctacatggcaagtgcaagagctgggtcccgggcgcttttgaggccctccaacttgcggctgctgatgcatagcttgtgggccacttttcctttttatcaatccatccgccccagctttaggttcctttccccttttcgagtttatgcttctccccaccacacatagcgagtatctccaaaaccatcccatcggaagctattctacgtatctagctccctcctgcctcaagcgtatcatgtacaagtacattagtaaatacgaataatggcacaactttaactgagtctatgatttgtggcaacgatatgatacgaaaaaggaacaaggtgtccaatgtaatgtaacatgaatggtaaaacaagtcggtcgatccgacagcttagagtgaccaggaaggacacacatgacgcaatctatttaaaatataaaagtgcagtgatttagtatttacttaatattatgaaatggtgaagtacgatcaaccagcttgattagtaaaggaggcacaaatctccacaacttcacatggcttttaaggaataagagcagataaagggagaatttagcccacctggacccagcaaatcagctaatgtatcttaacaatgatgacagattgccagagacaaattacgttctgatcaaactaatgattaggggcttaaggtctttactagagcctgttctatgatagctacatctaaactgtttgcctttgtatgataacacacaacctatctttatttttgtcttattcttaaacaccaagcctacaattggatgacatatagtcttaaacatcgtaatgtaatttgaggaataagcgtaactggctatagaacttcaactttcgatatatttcccctgaggactacacaattcagttcaccgttcagatagctagcttgccagcagtaccagttttgatgaaaaataactgacccgcaatagattaactgtgccaaagaataattcttagaacattgaagggggtgttgggatcagaccttgagtgcccacattgtcatccacggatagatcagtggcctctgccagaggcaagcaaagtacttcaacctggatacggaaatagttagaattaagatatgctgagatatattccattcaaaagcatttcacaaaagttatttaatcacaaaggttgcagagctgaatgcagtgtcggttctgattataggtgaagaggaatcaaaagaaaagaaaacagaacagtgtagccgaaaggataggccacccttagcctcccaacttttgaaagcccaaaaagtaagcccttgttcaagtatagtaccttccacaagaatcttcttgtacccagacaaggaaagaaatctgaatacctgaagaaatattatgatgataatataaccagggcagaaaactttatctgtttccattgtagacagttcctgctgttcaatccataagacataaagttcgtatttctcctgtagcagtccaaaactccaaattcagttcccaccagtgtcattttctcgactgatgattaaaatccataagacgataagtaccctgtaaagtaaagtagtttagacaactcgcaaagaatttgcttatgtcatgtccagtcactacgtgaggctttcacatggtttattatctctgatttgctggccatagtgagtgcaagaatcagtaatagcacttttatagcagcactaacagtaggaaccaacactcagaagtcagaaggtgtggctcacttactacactaaatctaataagccaagtttgaggactcactctgacagcattgctcagaggtaatctgaattaagaactcatgttctgatttaaccttgctgctgcctgctggaccattatcttcctggcagcccatccactctgtaccataatttattgtatcttccttaatagatgacaaaaaaaagatcaaattctgatattctaaattcagaattggaccattatcttggctctatatcattgcagctaggagcctagaacactagctcgatccgatgtatgtcaaggaaaatcttacatagcattggagagccaaaagacacagcataaattgtcattaacttcaatcagtttccagttcagactactgcagttctgcttgccagcttcatatctggtggtagaaactgcaaaagtaagagaagacaggaaatttaccatttacagcattgtacagtatactttgaagctaagttatgcaaacatcataacaaatacatatacagggagggaataaacttggtcggttggtccgttctcattgtatgtcttgtttagcacaattaaacagaataacttggaacacagagatgcaggtttttggagcttgcagcaggtaaacgcaagcacaaaaatggaggaaaacatgtcaaaatgcaatcttcaacaggaaaaaagcaattatagaactgaggtcgctatcgaaccaaaagttagaataattgtctttgttcattggatactgcaggcttctaagctataataaaggaacctgcacatgtttagcatgcttccttttctcttgacaatttgagaaagcaagatatcttgtgagcttctgaaatttgaatatgatacagttcaaggtgaaacgaacaatgtgctaccagagcactctgtctattagttttatcattgtgaaacctcttgaaaaaagcatcatgataagttgataaccggcatcatcatagtatatatatagctaaaatgaaaagggggaaaattggtagtggtgaaaaggaaccgtcattttcagttctgaggcaaagaaataaacccaccttgttaaataggatagagcattaaaacaagaagaatggactcatattgcggttaaggaaataaaccaataaatcaaatatcaaagtaaatgacatgttaaattaagttcctaaatagagtgaacagttcaaaaagtttacactgatagtctgttacatttctaatttcagaattttcttgtgtttaataactgtcagaaactcagaattcattaattttttttaaaaaaaaaactacaatccactgaattgaattttaaacaatacttatgttcaagtactagaatttagaatttctgtatgagaagccatcagcagggctttcacatgtgttttggccatgatttcgtgatcctagaagcacaaattgaacttaatcaacaaacacattgattttagatgtactcagaagattctactaaaaccttatataagaagatatacagccccaagcgattactataaacaactcctacttgcatgcttattatggtaatgttcaatctctgctattatccaaacacataagttaagagggcttatatttgcccacattacccttagcacttccggttttctttccagactaacataagaaaaaaagttcaacttaacacaagaacgatgaaacaattgtggtaggctggcagcctgcagctaagtctgcaatataactccgcaagtccgtaactaccctgtgaacaagcagatttcttcaaaatgcatgcaacttacgttataaacccaggttttctgaatattatatttacgctttcaaacataaagagtgacttcgcctcaagttatatgtagagttataaagtttaaaaggctagattatgaaccagtccacaatgttcttttgtttttccatataccagtcatgttctcggttaaaattatatgtgatgtgtaatgatgtttatatcctacattatggatacttcatagctttctcatgactgctaacatacattcaaactataatagattaaacaactgatattttcctatcatacccttgcatggcaatacaagtctccccctttaagatccagttgtgcaagtacaagtttatgcatcaaaataacaattaaacatttaaactgtctaaaatgatcatagttagcttatgtacacacattttttctctctctcaaagataagtcactttcatggaaatttccatagccaggagaatttatcttatgcaaggaccacccacaactcttagcgcactgattggtacttctttattatgttgatacattacagtgaggcctgacgctgactaaacactacacgaaaaactgtggctatacagacatggaactaaattgtaattgataacaatggcagctctcgttcatgtatatgaggtgcacagcaattttcaactggcttcaaccatgcagtgagataacagtacacatctaaaacaagttatatgccatcaaagtaagcagatgcaccagaaaaacttggtccccatatttgattggcatatgttagctcgcacaaaccaattgtacaaactggaaattatcatggatttagcagaaggaaaaattggaaagcggacgtgttcaaaaactgtcacagcagccaccactcaccagtcatgccgacccaccaaccagtggaaagctgtgagatattctgcaaaagatagaagtgcgcggtatgttatcagtgcgccttccttctgtttgtgataccttacaagtataatgtatcacatattcgcattacatacttcatgctgaatcagacatccagatatggataaatttggttcaggacagttatcaaaatggtgatatgtggcaaagcacagctgtgagcaagagttaaataaggttaccttttttagttaaccttctaaatagacaagtacaactacaaatccttaatattatagacatggcttgaaatccacattcttcgtaaagacaatgcaaatggtccctaaattttgcagctaaagattgaataggtcacttacaacaagttacagttaatttgaatcgacatcaagcatcagtgcaacacacacttaattcagagaacgtctctgcataaccaaatcaaaaaggcaatgggcagttgttttcttgaaatactatccgacatcccattttctcatttcgcccatatgcaacaatgtcggagatgctaaagtgccacaacctcatgccaaataacccatacagtacttcatatttcagagctaatttcgtgcccaactgagaatcaaatacctgcaagctgcattgacagccccaaattaaagaaagaaagaggtgatgggtgtagcagcatacctgttccagtacgcaaccgtcattgttgttcgatcggcggcacaatatgcctcctgcaccccacctccggtaacagcgagagcattcggattggggccgcgaggcatgaggggagttcactcgctgaggagaccagcgcggctggcccgagatgagactcggaagccaaagcgaccgatctactatcctcctgggagtggcaatggaggccggagaggagtggggatgcaaaggggagggagacgagcggccacgctgagccagcccgaacacagtcgcgccggcatacgaggaggcgaagagaaatccggcgccacccacaatcgcccggcggcgcgagagcgccgagcagcaggaggccacgtgcccttgcagcgagggttccgtttcgcggcgtcaaggcgcagtctctgcctgtgcggcgggtcccttggagatgggcaaacgaggggagagaatgggggtggaacaccggagcggcggcggcgcagccggcggtggtcgccggtgggggtgatcgctgcctctgtcgccgccgcgacggggaggtggcaaaattcggcaacgaggctgtgggcttggactcccagttgggctttcggcccagataccaacgagtcccgaagagcccaatttggatttttcccacccacccgttgaactttttttggaggaaaaccgccagttcgaatctcgaattttgaaagccaatagaccactcagctgatacatcgttcaaattacgagcattcacatggagcgcgaaattgcgcagtttgcaacgaaattttcaagatagccgcctctcaaattcaaaaatggatcagcgcatacaacatttcaaagcgaccaatggatcattttttggaagacagcaagtcggatgtactaatcaagagagaaaatgattcatttaatccaaccatccattcactttgcacaagcagaaacaacgaagtagtacaatttccgcaacgaaaccctaagcaacgctaacggcatcagatctggatcgagcacagggggccgggaactcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagccgccggatcgccggcttggtgatgccctggatgttgtcgcgcagcaccttcctgtgccgcttcgcgccgcccttgccaagacccttgcctcccttgccgcggcccgacatggctgacgatgcgtaagagctcgaggtggaagacgaagacgatctggaggatttggggattttgcttgtgagatgcggaggagatgggcggggtatttatagcggtgggaggaggcgtttgggcgcggaggtgaaaatggagcgatccgtgggaggtgggggtttcgcgcgatggatcggaaatggacgggtatgattgggtacggcttgggaggacggatcggtgacgtggcggggaggaggggttcgatccgtgtggttcgtaaatggagagaagtgattggttagacgtgagaaggccggatagatgacgtggcgtcatcggatttgtgaagaccgggctcaaaacttgggctggaattcgtgatttctcctttggacttgggcttttagctgtgggcttgcatctactcttgctttggttgggtacttgttctactctttgtaaatacttgtgcaccttttcacttcttttctatcagtatatgaggcaaatttcttgccttcatttcaaaaaaaaaaaaactacacttgatcacagattcacacttctagttagtgatggaaaacgaaaactgtgtcaaaaaactgtgaaatgtttgttatgaccatccatggattgccatctgaagatatggtcagtagatgattcaagcatttgccaaaacgcataacatattttgaagagaactatccaaagttctctacttctcatgtacacataagagacaacagctatgtacacagacagcaaattggtatatcaaagagtgcatagtctagtgatgtattctacacctctcagagaaagtacgaaattgtactcatattcagctttgtattgcaaacaagtacctagtctatcaaagtatttgcatatacagataccagatattacccatcttcagtacatagaagaactactgaaactgatgatacagtccaagtaagaactgggaatgctatacccacaagaaaaataaaacgagaatactactgaagttaatctcaataggtaatttggtatgagtgtttggcttctcaagtacttgcatactcaagtacttactccactcatcttcagttgtccagcggatacatgatgtgcctatcaaagaatttgcatatagaagtaccagattctatctaacttctgaaggttttggctgtgtacatccgaaatagatgtagaggccatgttctttccattatctaaaaaaaaatatcttctgtagcttttggcacgatccaaaagaacaatacgggtgtgtttgtttgctcgtatccatctagcctggctcatctctcccatcctggcttagtttgatctggttgaggggatacatatgtagctgtttggttgttatagattggaggtatggatacctcctttctttgagggtaagattaccgtctataactaatggatgaaattttctatcatctcaaagctgatcgttttacagtatatgatatcgatttttaacaaatgcgaaatatgcataggattgtattagtcagtgtatcactgtatataaaatcaagtcattggatttcttacactgacgaataaaatagtatatgaaccacatcgggtgctacagtattgcatcaactttgttatgttcaattaattcatccaagtggtgagaaaaaacagcaaataaataaaaggaaaaagaaggcaggtgactgtggcctcgtcgccgagacagccaactacgccgcggtggcagggcgtagatccggcaatagcgggatcctgacgattttcgccgccatcagtacgtccggatccggcaaccagaagcctgaggccaccagatcgagctcctgggctctggatctgacggaagaagggagaggaagagggcccgatgcagcagctatagacgaaggcggtggcgatggtggcggtgacagcggcgactaggaggaagatccgggcgtcagcagtgacaaccctctctcgtcgtcacatctggattcggatgaagaagagcaagtggcatctttggtaggagccggattcgacttcgacggcttcaagcggggctggatttggcggcggcggcggcttcgaggggaggggctctagcggttctggttgaggaagcttcgatggctttgtcgaatatggcacgatgatggagatgacggcgacggtgcggcgatggagacgggaggcaccgagcgacaaatgagatgggaaggtgagcagaagctggaacccctctcgcctcctgcacctgcgcgtccccgagcttgcacccacgcgtcccccgcctgcacgcgctcagcccggatgaggagcgaagctcagatcgaccgtttctctcggacctggctcggaagcccgatttgcacgcgtggagccaggctcgggtggccgtgcaggcaaccaaacaccaaaggcctgcacccgtggatgcgagccaggtgcgatgcagagaaccaaacacaccctaagtcaatccagtggtatgaatgtctggctttgcctggcgatggtgattttcatatcaccatttgttcctgatcatgtctgccctcttctctataacagccaggtgactgatttacggcaagacctcttgacatctacatcacagaacatctcagggagaggacatcaagacaagattcattgtgctgattctgcatgtacagtgagcttctgaaaaatcaacttcaattcagcatccagatcgcccttgccaatcttgtgcaaatctttgataactctagtgtaagcagaatggtcaggcaagagtgcctccttgtgaattatttttcgagcagaaatttcgcctgtgaatgtgatttcctaccacattacacttcaacacagattcactattctaatcagtgatggaaaaggaaaacagtgtcacacaaatgttcacctgtccttaaccatctacaggctgaatgtaatggcagtatggaacacaagtaattttcctatcaaagaatttgcatattcaagtacttgttccactcatcttcatttgtactgcaatcctgtagataagtaatgtccctatcaaagaatttgcacatagaagtaccaaattctgtctaccttcagtaggaaaaaactaccgaaactggagttaaaatccaaggaagcaatgtggcaatccagtggtacgattgtttggctttgcctagtgactgtctttttttttctgcaggaaatcacatggtcctctctctacatgacaacagcttgcaccatttgtgcatgattcatgtctgctctcctctttatcagccaggtgactctgatttacatcaagtccttctgacatccacatcatagagagaggacagaaatgacgcaagacaagactcatcacttgctccaagactacttgaaatttcatcccgctgattctgcatgtacactgagcttctgcaaaatcaagttcaattcagcagccagatctcccttgccaatcttgtgcaaatctttgatcactctaatgtaagcagaatggtcaggcaagagtgcctccttctccatcaattcatacagaattcttcctgcatcaacgatcatccctgccttacacagtagcttggctagcaggctgtagttcctgttcactgagcgcctgtccctggtgctcatagcactgacatatctgcaagcatcatctattcttccagcgtataagtaccccttgatgaaggctgtgtgaatcgtaatcctcggtgtcaatttctccaagaacatctgatcaagaatccgcatggctgaatccatcctccccgctttgcacgcatggtatgctagaatctcgtaggtcagcgagttcgggatgtcgttgtgttcagacctctccatggcctcaacaagctcacaagcttctgcaaccctgccgttcttcagcaggcacccgaggaggtagttccaggagttagaattcgggccgaagcccgacctcctcatttcgtcgaacacctcgcgggcgccatggaagtccccagttttgcacttcacggcgatgagggcgttgtagtaacgtgcccccctcgccgtctcctggatcacagacatcgccgcgtcgaactcaccgatcgaagctagcgccttgacgagcgagaacacgccggacgcacggcaagggcccccgacttcatccagcgtcgctagaatcgctatcgccgtatccctggcgctgccctgggacgtgttcaagaaggcgaacgcccgttcggtcaggggaacccgccgcgtagacatgctctccatggcgcgggacatggcccgatagtccgcgaggctgccggcattctcgacgagcaggttgtgggcgtgggcgctcggggagaagcccctgcggagcgcgagccagtcgaagaagcgggccgcggggaggccgcggtcggtgagcgcgcggagggtggccgacacgatggggtgggagagggcggggtcgaggcggtcaaggtcggcctcgaggctcctgccgccggccgcgacgaggcgaacgatcgcatctgagaccgcggcggcggcgggggcggcggcggaggcaacgctgctggtgcggggattggcgggtttggaggagaaggttgcgcggggagaggcgaggcggaggcggaggaagacggcggcggcgcggtggagcggcgggaggcggaacatagagaaggagagtggagagtggacacgaacgcagctctaccgccgcgcacgagaaatagcgaaggtcacgcgcatgagctgagccctctcgcatgtcagtgtcacaaaggtgtgtactccctccgttaaaaaaaaactaaaattcaatttgacacattttacttactactatatgattatagggtcaaaacctcgccttagttacgtgattaaattttttttgcaaggtatgatcaaattgtggtaaattttgctacaggacattgttattctatggttttagtcgtaggacactgcccaaactcacttttagagaaaaacacggtaattagatattttccgtagtttggcacactatgcttatataacagccatgcgaaaatagcttcgctaggaatttgggaatttcgcttcgcccgtagagtagtaagaacaggaaacagtcgcaaggtcaacgttttacatgcaatccgaaaaaaagaacattttggagccataggtaatttgaacttcgaaaaaatcattctctaagttaataaaatggttgttcattctacgtatcaaaatattaacgatcaaaagaaatacatcaacaaaatctaataggataatataatcagttgtattagcaaacatgaaaagctaactccacaactaaagctacaaaacaacagtagcaatcacaattagaagcactaagatcaatacaacaatgtggccaacaggatacatccacgactccccgtccatgaaatatatacatcctactgctaagagagaacaacagtgattgtaaagctccacgatctgaatggagatgcttagatggatgggagcagctacagtcatactcccgcatttggattgttgccagcaagaatgagagagatctccaaacctctgctgaaagcctggttaaatagaagtcgggtctggaaggtggatatgaaaggaaaccaggaaaagatggctatcgggacaaaaatgatcattcctgtgccagcatcgtacaggcgagctagagagcgcactgttttccatagacctagtttcttcacaataggtttccacgccacagcgatctgtattatatataaaaaaaagcatgggcacgaatattaatgatagaaaacaaatacaaaaaggaacatgaagtactactccatcccaaaaagaatccaaccggattgggtttttttttgggacggagggggtaggtgttaggtgcttcaaacaaagaaaatagtacaaaatttaaacttaaaataccacttgtataaagagaagtaaaaaggacaattggcattgggtaaataactactccctccggttaacagtatagaaaaatataggaagctcgactttatttttactgtcttcgaggcgagtttataaaatctaaaatatgagattatgcgtagtttccaagacaaatctatactaccaattttatgttttcaaaccaagcacttcacgatttattgatactcaaagcttccaaagtttatctggaaaacatcaaacgctagggatttgaccagagaaagcagctttaatagtgcaaggagtaaggccaaaagaaatttgggaggttgagtacttctgtgaaatactttaggagaatagtgaacttcatgaaacatattatctgctacgcaggaacaattttcaaaactgagttcacttttgcaccatcctgtctcagatggacattgatgtttctatagaaactcaccgaaagaactccccagccagttggcacaaatgctaagatggcagcaaacacatctttgacactaaggcttgtaaacacaactgccacaaccaagcccgccaaaaccatcagtagcgcaatgcttttgataagtcggaggaacaactggaaatgcaccatcgccttgggattcaaaccgaatacctgcagattaatacaataaagaaaacaagttaatatccagatatgtgatattactcagatacctcatacagtaataaggaattcacataccagtaagaggacaaaaaggccaccaagcacagcccatgatatccaatatatctacaaatcaaattaaatgttccattatattgtctccattaactagaccaataagtgaagatcaaaatatataatcaaatagtatgttaccaaatttctgattacaaaaatatatcagttctttgtgttcaatatcagagtattaatagcacattcaaataaaaaaaatactttcagaaagtaaaaaaaaaaaaactgaaacatatttggtcaacgaatttcatgccaacaagcaaatcaaatggatgctgaaaacataccaatagtgctttacttgattcgcttgcatccatatggtaaacaactccatactggaagatgaaaaatcttaaactcagtacagtttccagtatcctcccaccaacattgtgaatatgtgcctgaaaaagaaatgttctgatattaactatcattcaatgacttcaagcttggtaaaagcatccattttggagctcatcattactttcgtcaattcagtcatatgctaagagtagaaatagaagccaatataagtgccagtaactgcagaagaggaatcaacgaaaagaataacaaaagtggcctcaagaccttacaacaaatgtgacagtagattctcatgatactgtcaagctgcaataagattactccctccgtccacgaatataagcatttctaagctgtttagtagatattaaggttgaggagaaaagactttggtggccctccttaaatgagggatggatggagatgggaggatggttgggggtaagatgggaataaatttgagtgagaggtgatttatgtgacaagtagcactctggaatgcttacatttgtggacatatgaactagtgaaaagaactagtttttccattgtatggaacaaaatattagacacaattaaaaatgctaatcatatacaggcaaaattcagttaccagttcttcatcccaccaggcttcccaactttcttctcccttaaccccaataccacctcggtaaaacagccaattcgtccagtctctgaaatcctcaacgaccctgagagaggtattttaatcctgataattcgaatttcaaatataattacgcagagtaacacatgcatagaatgcttagcagcttacttctgccattcaaatccagatggattgaatatgtatggagcaaaaagccaagaaactgccataaaccagctacttatggaaagcaaaatgtagccaactgctccaccattgttaaaaccatacgctaaaaagatcactaacaaaagagcaacctccaacctgtgaaaaacaaaagcaatcatcacagactgtagttgcacacaattttgagagcaaaatcaggtgataacaaaccctttcacaaaatggctcctggaataaagacggtagttttcagcaaatttgatatgtcgtaccacaaaacccctaccggttgctctatactggtaatccagaagaaacacatcagatcaatacagagtaaaaatcagaagtagataagcatcacttaaaaacaaaggaccctacctttgcaccaccatgtagtattgtgcggccaaaatagtgggtccttgtacccagggagaaagtaaaaaatacagagcaaagttggaactgcatcgtgatgaagctgacaaaagcctgtgtcacacattcaaatgtaaaaatgcatttctccaggcaaaatatattagacaataaaaaacaacataggcaaatagagctaacaaatgcagaaaaatctatacgagattagaaaggtaagctccactcaacaacaaccaactttattacaacagccaataggtgaagactctttatgttgcagtgaagcacattgaattcaaaaacacaagattgaataaatgaagactttgttgataccagaagaaaaatgacttgagttatatcaaatactgtgttgcattaagaagatgttgaaaacatttcttaggaaaataattccatggaagataattgaccatgagtgctcagatggaacagcttaggttatttgttggcaagataaaaggaataccgtcaagacaccaaattccaggatgaaacccagaatcataggaatagcagtaaatacaccaatctggaaaagaaactgtgtgttcagagctgcattcaaggctgtgttctgcaatatatccaccctattctgaattgattctccaactccagacaaagcctacgaaacaaatatagaaggaatatgtcaactagtacaatataatatcctggtcagatatggcagaaaaaaaatgtcacaaactgaacccaagaaactggaacgtaaggtaacgaaagtgcaaaatcgtgaaagggtagaacataaaaggaacacactgagtgaacatttataacaggattttctagaaggtactagcaagaaagttaacgtgcgttataacatctattagctttacaggtgcaaaagtagaatatagaaggcacacagcatgcaagcgttgcaccacccaataaaacagtgcttatgcctccagcacattttacttaaaaaatatattgtcttgcgtggttaggaatgtttccaacttaatatacaaaagataaaataaagaacatagcagacatagaacaatgcaagcaagatgcgttaattaccaaaaaaaaatcttaataacaaacttcatacaattgacagcatagagcaatctgagtgaagtcattacaaaaggtggacaataagcaagtaaagtgacatgttattatagagagatgttaatatcaaagaaagtagaactgattttctgccttaccagataggttttcccatagagaaatatgtacacggtccaaacagttagctgcaaaagagcaaacaacttaagatcagaatttattttagaataatagaatcatgattgcagattcagggggatagcacctacaacaagatcaatatgtagcatcaataatctatttttgtacaaatttaattttatgcatgtacttaataatataataaaaatggtaccgttcaaaatcctatgcatatattaattgttttaggtcaagctgctgtattgtgggcaatctgaagtcaaggaataatgcatgttttaattcatatgttctaaatcacccaattgagctgattagattcatatgtttttagatttcctcctggtcaatactgaagatgtcgcaagaaagggcagaaaagctacgttggggcatcatgctactaatcaaggtagcagatgaggtctaattatcaagatttggatggagaccaggggctagatggctggaatgatggatggagcccgaaggcagagaggtaaaaattagaaattactgaaagatgctgctgtttgtctgcctgggaagtagttgctgggcttattgttcctttggttgtctagttgaatttcaaatcttttttagctgggttggccgaagaacaggccaacctaatagattaagattgtgggagaaaatttaaagaggacaaacagtaagctgtcgagagagaaattacaaggcagtgcccaggtcagcaccagcacccccacagcctcaagcagcaagattagtcattttctaaagtgaaaagacctgcttctctccagactaaaatatcatctgcgatctcagccacaggttgattcgctgttttgtacttcaggttgaagatatgtgcatttctttctttccaaattaaccaatagatcatcaggcacaaggtatcgaaggccttgagatatttagttgcccaggataatcatgtgatcaaccaccagtcccccagaattacttctggtttgctttcagatcgtcccaggttgtgtttgtagcaactttattgagttttcttagtcttgttggcatcaatagttgtgacagggatcggatggcatcacaattgtgacaagctgctggcattttggttttgtttttcctcttgagctgtaacctgatggccgttaccagttctactgaaatggagatcagacctctctatttcaaaagaaaaaaaaaagagaatctactgacttcaattttgcattatactccattttttatatgatgtttagcatcattgaactaatcaacaccattacgccatataaaaaatggaggtagccaaacttttaaaagttcaactaaagacattctaaagtgacatctattcgtgaatgagggaataacaagcaaggaaaatctaattaccatggtgcagaagtagaacccaatagttgtcacatagaaggacaacatcctgaaaaagtcaaaaagctgtccaagtctgtatatatcccggntgagcacttgctcaccatttcctccagcaacttttccttcgaacagtgcaatctgattaagaccaacgtctcttccctttccaacctacagaattatgtttggaacatcaatataatgctcgcaagacagcaagagtgttggcaacagttatataatgctagagtagatggtgcagcgaacaagtttgtttcacattggtagcaggagagcctgtgaaacaatatcagcatagaactcctggtgtacatacagaatagaaggttgcaggtaataaaacattttgaaccaggtgaacaaggcttttcccaccaattctctccctaatcaccagcaacaattagttcgggaaaaaaatcaccacgaacaataattagtatttgtggtaacgccacgaacaattttggatagcaaatcaacagtgcgatgttggaatcgccaacaaatcaagggcaaatcgatgtagtcttgagtttactgagaatattaactcccaaatgtaagaaaccccagaatttgtccaattacagagaactctggcattgtgaattttcctcagatactgatagcgatagctagctgtcaccaaatggaagataatacttcttcacattactggatgacctcagatcaagagttttaactatctcattttacatgaacatcaatgatgtatgacatacttcttccaaaggtaaatgagtcaattcacttttgctattaaatcaatcctctgttatgttacttttaaataccaaaacatcctccccccccccaaaaaaaaaaaaaaagtaaacagattatgagaccaattgacaaataggcgataacaaatggaatttcctttttaagatttttctggcctaccattcagagattaaggtattcttgactgataagctagatgttagcgcagaaaattcaaaacacgaatgaagaaaattcagacctgaatatattcatgatgagttatgttccctaagcgcagagttgagttgaaccctggagttcatagatgcatcagtaaaaagatacaataccatgaatgtaactaaattacagctaactgttgtggtctgcaatttgtaaatggtaggcagaaacaggaagattattgagcatatatggacaaagtgatatggttataaccaaacaaaaatatgcattgacagaacctgagagagagaccccctacaactaaaacaatataagaatatgcacagcattaacaacacagagaactacaggtaaaaatatgatagtttacaatgcgcaagcagcttatactcattttttagtctctaggttaccaaatagcctcatttacagaaacacacgctgagcattagaataatactacatcgaattcactagcgagaagagaggtataaagtcatttttgccctactaactagcacacaggctgtccacacagcaaatgccaatttcacagaatgtaatgggctattattaataatgcaacctgaaatagactaaacatgcagggctgcaggaatt

SEQ ID NO: 42996 - DNA, 4198 bp, Oryza sativa
  unsure (1)..(4198): unsure at all n locations
tatgtaaaagcacttacttcagtggattggccagaacacgctgtcccaatgtgacaaaactagtttcctgattggacataaacgaggccagcgaagaaacactacaaaagagagattgtaagtttgaactgagatgactactgaagtaaagccacaacaaaacgactgaacaaaaatctagtgaacaacaccttcccgtgaacacgtgttctctaacaccaagaattgaaggcttgtgcttgccatgattctgatagaattcctcaagcaggtttctcattttgagtgcctcctcaaaatagttatccttcaataggacaaccaaaagaaaaactcaaaactgatggaacaaagaagtcaggagctatttcagaaacaaaaatggtatcttggcaatagtaagaagaggtgcggtataggagctatttcaataacattttttcccataactatagcctttttagaaataaaaaaaatatgcgcataataaaaacttcaaaaaatgtgaaaaacattgtattgatatatattgagtcaccttagatctgtaccattcaataaaagaggctaaacatatagtaagggattacaaagaaatgagctgagcaagtgcttttatttaaatattggggaaaaccaaggaaggtccatcaaataaatataatatacataatatttgctcctatatgtataaggaccaaacttcgtacgagagctcgtcaataatcaaaatataaagacaacagcatacctgattcatatcaatggtttgcactgcatttccacgggtgaatattatggcatgattttggttttctggcttcccctcacccagcttaaaattgccaggcaatttaatggaataaatttcctgcagccaagttatttggtgcatagaagaattaatacgttactcaaataaccaaacatgatataaactactttagctgatgatatttacttaacaagggaaagaatggtatactactataggagagcataaataaacaattttatggatatcaagtgtcaagttggatacaatgaaaacagtatgaaaaacaatgcacagaaggcattaaaactaacttaagcagcagaatacattgttagcagtaagagtgtacaaaggcaaaataacgtctgaaacctaataaaacaattaatagtgttaatggagaaggttctttcaatagataagataagggtaaacaacaattaggcggagaaaacaaacttaaaattaatttatactgaccttgtcctttccatgaatgtcagctttaacaagctttgagtaatactcggtgctaggctntccattcttaacgctctcaacaatatcaacgtaagcaactctgagtgcttcatttctgagaaagataataataaacaaattcttatacgcactgtagtactatgaaacacgcacaaaataaaaggagagcaaagagctccccagattctacaaagtggaggaaagtttcatttagcatgaaagcaagtaaagagtgcaaatatgtctaacatataaagtgaagagtacctttgcattagtagagctatgtctgcagcttctggtttcctctctgccttctgtaccccatatatttggcaagtaaccacatatgtaaatttcaaatcagcctgagcacgtgcctcaggagacagctcaaaatgtatatcagccagaccaagaccagttgtagcaactgcagattcaatatctagcaaaggaaaacaacacagcaggttatttattacttcataaacaacattaatgtttcttacagggcagtagtagaaataccttcagattgcaacttctccaaataactttgcagcataagggctttcctatagtacatcatcccacgaactgcaggattaacatagttcaaaaacagtgacattttgaagaacttgtagaaccaaaaggttttctttcatcagataaaagaacagtaaatgaatgtatcttcaaatcaccacaattaatatttttaaaaagtatataatggacacaattttcacggtttaacaagtgtgaacctttggggtggcaaatcatcaaaaaatcatgctagtaagaaataaataccatggaaacgaaacactagcaaaatagtatatggcatgaccatataggtttcgaaagataacaaaccagttcgtgctaaggtctgtccacggtaagaagcccacagacgtagttccatcatgtcattagggctactaaaaagttcggagtcagttgtgttttcatccctgttaatgcgagcaaggaagttcttccattcatctgtttacataagccaacttcattagactgtgcaaccataataaggaagaggtaattacattgcattgcatccttcaagcacaaatcacagatagcagcaggcacttgcactaacttttaggcattggcagtagatgccacaatttttccttctagagcaaactgtaggaaagccatcttacaagagaaatccaaacaatgctttcaatagtaacagtggagggagagtgaacaaacctggataaatcttctgtagataaaatagtgtacttataccatcttcatttctcttctggagttcatctttactataaagaacagtctcggagtagtatggagtaaatacgctgcaaaacgaagtggtgcatatcataggcacagaaaacaggagcaactgaaccaagaaaaatagacacacaaaaaggaatgctcggcaaataatagaaattttaacatcaagattcacgagatttagtcatctcaacatggctttgaacaaaaaaataatttgtatatagaataatatcaggaattcatatctatatggcgttccttcctaaatttcatcagcaaaaaattttagcagagttgcacgatgagcccccatatcgccataccggcacaccgtgccactaccacatgcatcatcatgccctacctccaaaaacatcgcttatgaccttaggcaccctatagtgtgccataccacccacctctttgaccacaactacccttcaaagtcatactcagtctcagaatatgttggtggacgctaaaatcgcatacgcaccaacgttgccacaggatgagacaaaaaggcgccaagggcatcaagttggtaaggtgggcaaggtcagactaggcgtcaaggcaacgaaggttgcccatgatggccagcagactcaagaatgcaaggtctgaagcgacttgtggtcaactttgaacacattactaaccaggtttatcattattctttgattccagcaattaaacacatgagtgagtactagtctaagaaaaagaaaataaattaaggggaggctggttataggctgtttctacagactatcggcacatttctgtaggatgagacactgaacagaagcaactctgaactgatagaacaagcagaaaactgtagagaagtctcacctgaaagaaagcatttctgaaacaggtcttgcaacaggcatttgcatgaacagagagtttgtaaagaactccaatctccgtctagcttccaggtttttaggaacatttgcagctgactccttgatggtcagaagagagtacaatcgtttgatcaagtccttctaaattccatgaaaccaacacagattaaattaatggttataaagattcacaagcagataatgtaagaacattaaaatttaacaagaaaaaccagtgttaagacaaaataccaatccagagtcagttggccacttgagattattgaagagacggccttcagctcttgcttgcttaatctgttcccattcatcaatattgccactagaattcataaacaaaagaattaggaatgaaatattataaacagaacacagctttgaaatattataaacagaacattagaacaggataaattgtaaaaaaaaacagacctcatatcaacagacagcacttcatgatgaacaacttcatatagatcttgaatagcattaattgcccctttcctcagatcagcagactcggtttctttctaaaaagcagcatcttaacattaacaaatactagaggagcctggataaaattttcaagcctaaaaaggcataaaacagaaaataacttttacaaacttctaaaatatttaagattcatatcatcccctacagtacttccaaaaagactgggtcccctgagctttaaaccagg

SEQ ID NO: 42997 - DNA, 1475 bp, Oryza sativa
tacaaagaaaaatcgtcaatgatggagggaacttcagagatgcaatgcaagagatgtggtttggttgctttacatgagatcgtgagttggtgtgcgatggtgtttgtttggatcatcaggaatgtaggaaacactagttaacgtaagaagatatctatttagtattaaataattaataaaatttaatacccttgttttccaacttaatataaaataataacccttactgtgcactaagcatgtcatatattgtcttaacctggcatctcactgtactggccccagaaaaaggaaatttatctgtgatttttctgggctaggccatgtgggaaactattcaccatgtggatccccaaaccaggcaatcaaacccacaggggtatatcccgtaggtattcaatcacgcatgcccttagtaactataacaaacttttttataaatatgtatctctgaagtacaggactttggtccagcccagccgcagacaaaaataattcaaggttcagaacaaaaaaggcatgctagtgttgataactcatgtctatacgatgaaccacaaaaaaacttcaaggttattagagttccagcagacaacaaataaacaacataaatatatcatatttcacactggaaggctggcaaacagtataaaaatggcagatggaagcctcaagttttttaacattatactcactccagcctccatttttcttctatgttttagaatctttacagtcaacctttttatatttcaaccttgctaggtcatacaagaactttattacgatttgtagctatagggggggtagtaattaccaaaattcctgctacagcaactaacttggcaatgacattgggcaatctgctgaaatgaagatcactctgaatgttcctcttggaaatgctttctcggataccaacataaatcctctccaccctaaaaaaaataaaatcatcaccaacacatccctcccacggataaaaaaacatctgttgaactagatgaaaagaagtaaggaacaggatgaacataaataaaatcccttaccagagacgtccttctttatctagtatagatgtcagaatataataaatgctgtgatagcactctacaacagcatattgcatgtattcatcctttgatatccttagccatagttcctcttgtgagtctttacaatcaattgcaatatctttggctaagaaaacctgcaatgaaaatggaagtggtcgccaaagtgacaaaacgaacataagatgcggaaatcatcaaatcatgcagggagagctttttaaaagctaaaataagttttgacttttgaccttgctagcaagcaaaaagagaggcactgcacaattggaagagatccattattcttaggcatcaagagtaaatccagttcactgtaaggatgaaagatcagaaaaaactcatatctaattaagacgtttgaaagaacagtaacatagtatt

SEQ ID NO: 42998 - DNA, 7436 bp, Oryza sativa
attcctgcagcccttcctatgttcactgcaaattcagcagcttcctgtagcacaaataagcgtaagaaatacgagtaagtgtgggataagcaaagcggatgaaatgttaaacaactagaatgtgaacttgcccagtttgattttttacttctgattgtgttgaatagtgtatcggcaagttgtttcctatttatttgttagctacattagatttaactaagtataagtatctctctcatgttggatgttaaagaacaaaacttataaatatatttgccatcctttcaggttcagcacactggagttatgcgctgctttggcatgttgtcatttactccctctgtttcatatttgcacgacgttttgacttttttctagacaaacttctttagtgttgaccaagtttatagaaaaatctagcaatatctacaacatcatattagtttcattaaacgtaacattagatatattttgataatatgttcgttttgtgttagaaatgtttttatatttttctacaaacttagtcaaacttaaaaaaaatgactaggaaaaaagtcaaagcgacttataatatgaaatggagggagtagatattattactgctccagaattagattatttactcaatgcaaggacatgatgaccctgaactcactacagttgagagagaacaagataaggggatgggacatagtataaatgtataggacaaagttaggagcaaaaaaggttacttactgataccactggagcccataaagaaagaatagttagagcattatggttatctgtaagcattaagaaaagtttcaaatattagtacattaaagtgcatcattacacatgaaggaacctatggaaacaaggtagacaactagaagtagatttcatgctttgcccacaaacatctaggacagttgcaacttaaaagaacatactaagaaaattatttaaaacatgaatattagaaagagataagactcaaacaactattttcagctacacaagaatatggaatatttaggtatcaagttgtatgaggatgtgatattcttactcttcgaaacaaagtcatgccaagcatactctaagcgtttgaaattgattatttccattgttggtttaacaagaggttcgatctgcataagaaacactattttgaaatgcaagttgatctggaaaaaacagaggggaactagataaactaaaactttcctggagaaaataagtgaatgaaaattttgcgccaagaattgcaagccagaaagcaacatatctgcatggtaaataaagttagcactagtctgaattcaactttggaagaaaaaaatcacaacactgtgattcaaagtcccaaaggattacttgatgtagtcagaaggtctttcatgcatgcctctcccaacataattgttctccttcaatataaaccaaatgtcagaaaatattagcaaaagatattggattacaatgacttaacaaaagacagcttttagttagtcaaaatgcagcagcaagcaagacctgatgcatccactttccaaggcgtacaacagaccagcggtagcaataatcggtcaaaccgtggcagcaaggaacactcataagcaggccgataattattttggcgcccacgtatgcaccaattacaaagacatatatcttgaatgtagccgaatttgtcccatcttgaaatgctttgctgagaaacaatcaagcaaccaaaaattccaaattagtggtatacacataaaggagttaggtatcatcccctggaatttggtgcgccagcccctgaattctgaaatcaatgttggggacgtctagcaattcactagggcaaagaccccatgtattctttttcatagttgaacaaaaaaaaaagcttttcggaaatttttttggcaattatccctctggtctcagatatgaaaagaaaacatacatatataggtaacaaataaccaatgaagccgcggtgaaccaacagaatcgccaaagaactcgggtaattgcagatctacgagatgttgaataggcgccatacatcatcagaatgtccaatatgccttccacagaaaaaaaaaagggaaaaagaaacaagaaaaattagtcacttagaagagaaattgtgcagatgatcataatacagtaactaaataagaagttctgtgactgactctcaataaatttcatgatgacataggttggacccaggctgaggagtgtcaatactgtttttttgtcaaatttacgatccttaaaagcaatgatcattaatccctgaatgaacacaaaaacacttagtttaacattgagcaactaatcatccaaggaaatatcataccaaataagaataataaaaggttcaactctccttaaaaacatcagctttaagctaccatttgcagcatcttttcactataaaagttgtacatgaacgaaacaccagatggttgttgattaacatggtggttagtctcagtaaaatatatgccatgtaaaatgtgacatacaaaaaacattaagcacttgttcggacaaaagttaagattctgtcacatgtctccagaaaaactgaacacacgggaaggcaggtccccccttattatttcccattccaaaataaatagacaaaagacaaccctttattttgcatctagcacctcagttgctcaagaaaatgaaaacaactttcaggcacacggttaaatgtgagtatgtgatgccaaatgtcaagcaagatagtgagaccagttgtgaacaaaaatttatacctgaaacatcataactaaaaaaatccaaaggcgatgaaagctatggtaaagatgaagaaaagttctgtgctccacaaaagatgtctttccataatgatgattcctacccaccaagccctgcaaaagaaccatctgtttggtaaggggggaaagggttgtcttcaccacctcatcccacaaaagcacatgtagaaaaatgaaaattgggccatcccactaaaatcttgaatggatggatgatctaatctctcaatccaaatagcctatatatgcaagataattttaggtggttctgtagaacttccatggacaaaactacagtgcaatatccatgatactcatgttgtgtaattaatgcttcatatgtaattgagatcatcaacctagtaatttttttggggtcacttttctgcacctagtaagactttccccagtataccatattctcaataggtagtgcactcggttcctcaacacgaataaccctgtgttccaagtaactacgtgatgtttaagatgtgcacaacaaaaataacaaaaaaaaaagatatcctgagatgtccaagtattagcttggtagttccgccaaaatacaaacaattaagtatatgatcagcagaaagaaaccttctctttcctactaggtttagagaaaaatggattgctgatcttccatggccaaccaagctgaaaacacttcggagacctgaaaaggacagtgtggatctttatggaaaaaaatgaaaataacaacaaattaatggaactcaatagctcaattgatctaccaaccagaagagctcattgaaatcatcatagtttctccacgcagaatgtggcgctcgcccattgtcattgtgggctgcttcctgtagagtacccagcattcaaaccactcaatagaagtacaaccaaatgtagcaagctaaagtagctccaagcagataccccacttacagctgcgatgatttcatacataggagaaatgacttggtcaagaaatgatacgccaccatttgaaatgcagctttcagcaggctctgcagtctgtctccgtataatctcctccagttctcttgctagctgtaagaaatataggagcatgaatttcaacaataaaagttatattccctccatccaaaaatatagtaacttctagcattcaaattttgttccgaaatatagcaacttctccgcctactgatggataagtctttggtccttggtcctgatttcttctttttgcttttgggtagtttcaccttttcaggacagcatctactcctttagcatattttcagttgctaggacagctgcggttagtaggacagcagcaattagcatctcctttatgcctcctttatgctttattcagtttggatgccctctaggacagcatcccattcaaatttcgaatttttagactaggagggtgcagcaataggcttgcagccagctatggttatatatatgtatccaacctccctcgggaaggtatggctttgtgttttgtgaatgaagaaaaccagaaaattgccccatctcgagtgccatccccttctcaatgagagtaaccattgaagttctaacacctacattctcttctcaactaatcacaaccttcccccatttaatttctccacctacttccttttctcatccaatcacaatcttaccctatttaattccacctacttctttaatgcctgtgtccaagcccttttttttttatattttcagaggtagtatttgatatcttatacaaattaagttagtcaaaggtgattagttattcaatatcaattggatatgtcacactaacaaccattccctacatcacaaatatttgtcattttggacatctgaatggcctcataagtattattttgaacagtatttctattgttatacgctataaaaacatattgaaattatattgtctctaaacagacaaatctacacatgactttcatattccaattcaaaatatttaaaggaaactgatagtcaatctttgaaaagtttggccagaagtgtttcgagtatcggtgactacagagagagaagaattgaagaccatcagaatgaacagaattttgcagatttctttacttagaagaagacatgatcactttagaaactgaaaatgaagaatatgctaatgattaggggaaaacaattcaaattccaagcatagacaacagtgcgctaatttggcaacaaagtagtagatcagggagggaagaaccaaagaagaatatttttgtatgttaaactggcataggcatgttcgtagaaaaacaggcgcagatcgacctaaagcttctttgggtgcaatactacacgattgtaaacatttgcaataatcaattaagcatgcacaaaaaatagtacagagcagaatcttctgcaaacttacatgatgaaatatatagcataaaccttctggaagaaatcgtacgttagcagcctctccccaaataaggtagtataagcacacatatagcaacttcttttctttcgtcaatgactcggtgctaagagaaaatcaggtaaatctcttggtgataaataagatatagacaggaataagaaattaaatatgttgatcaacatgacaaatcatacttgttccagacagggggaagcggcaaataattacaccatttgatgtagttatcaagggacttggagaaaacaacatgcacagctccctcgtcgattttctgccaacaaataacaacaatgctaacgaactaaggatgaaaatattaacaacataaagcaacatgcaattgagtactctttgcaccaggcctggtattaaacggtgcaatatttcagtggtattaaaaagtacccagaacttttgccagtaaatatctagaatagggatcactctatgccatggaaccaattctacccccaaaaaaaatattgtacgacataaaaaattagggtgcaaagtatgcataccggttcatccctggtagtttccccagtcgggactgttcatttgccaacaggtgaacaacatgctcccgttgattagtcacattgtctttctgcaaccaattgtgacatttcagttccatgaaggcaacaagattctgaaatactgcagcatgtatcaagaatgacccaggaagttgtaactgcagatccacactaaaaggttgtctcccatgacgcatttccttcttaaatattttcagaataacacaggctgcatctattgtctttttcccctcattttcaaccgtctgtaatattaatcataatttttaactagatgctgtttacatccatggatctttattacttcttagcatttctgaccatatagaacgctctacattatgttttctttttatatcaaaattaaatgcttgctggaatgtattgtccaagtcagagaacaaaataaaagaaaaatatcaagatcaaggaaattacggcaaatgttctttctttttccttttcccctcatcttcaacagtctaataaaatcttggtcataatcttgaactaaatgtgagtttacatccatggatgtttattagctcttagcatttctgaccatatagaatggcatgctcagaaaccacattctacaacagtctggtttattgaaacttacattatgttttctatcacattataatattggttgacagaatgtaatatccaagatcagggagcaaaataaagaagaaactacaggtaggaaattagttgaaatgtacagtttcaactatctcaaatgtatatgctgcacatttctacataaatttcatggttactgttgtaacataaaacaacagatgggtacatgtatccttggacttaggggaaagaacagagccaagtcatgtggaaagtgagagagtgtcccattctagggttcgaccatcctatattcatagagaggttggcataaggggaaatcccttctgccccttgatacacagcccaagcaaggataatttcgtatatcgtacgaaatacagggcatgctccatcggtatatcctccaagtatactctttggacatttcccattgggtttctagcctactcccaacactctaggtctaggggataggggtacctatgctccaacagttagtcagagcatccaaatataaaactactacctccatttcaggttataagactttctagcattgcccacattcatatagatgttaatgaatctaggcacacatatatgtctagattcattaacatatatatgaatgtggacaatgctagaaagtcttataatatgaaacggaggaagtactttgcaaatggcaaaactcaattacaaaaaaagagagaacctgcacttcctcaatcatattgaacagcatatttacaattaaaacaaactgaatcatgcatgatagtaagtcagtaacagcataacatacagtagtgattactaatactaacagaaactttttcacttaagtttgtgattaaaacatatcttctgttagcagtatcatcaatggactcactaagttataagcctacaatatgattgtggttatggttgaaaccacaatccatatagtttactacagtaggtgcgtcataaaggtacagacctgaaaaccaaatacacagtgcaagagatccagcatatcgg

SEQ ID NO: 42999 - DNA, 16304 bp, Oryza sativa
tctagaggaataatattataagccacaacatcctctgttctttctgcatctttttgcatgactcttttcatctgaatataacagaaagggatgttatttatgcacaaaaaaatatatgaaacattttattgatctcaaaatgggttaaaaaaggagcaaaacgaattcattcaacagtgctgtttgaactcactgttaactggtaacaaaacattcgagaaaaggtactactgcctgcggacctgaggttatttgcattcaacacatcatactagcaacaaaatgtcagaaagaataatattccttgccagacagaaattattactttttactgttcagagaccagaagatacaactttgaccaacaaacaacattatgtccataagggttgtgttattaaagaatgttctataaatagcatggacagtaaatatactaacgtgttgaattccgattgtcagagcaattgtcttgttaattttacttatttgcaactagaacaatactacaatagtcttctagtaaaagctactacctgcgtcccagtatataaggatttttagggttgaacacaattattaagaaagtaggtataattaaatgggggaaggttgtgattagatgagaagtggaggtcggagagaaaattgaatgatggagggttgtgattggttgggaagagaatgttgcagaagttgttacattttgggacaaattctaaaggctaaaagatgttatattttgggacggaggagactatctatgatgacaaaaaatctatacatatgcgaaagtggctatagcctagcggttacagtgctcaagtagcacttctggtcctgggttcggctccccaagagagcgaatttcaggcttgaataaagaaaaaaataccatgggggcctccctcactgtttccattcaaaagaaaatctatatacacataaaagtacatcacttcactcttataattttagtgaatacattgatacactaacactttaccagtatcttactgcagaccagtagttaaaacccattccatactaaccactcaaccataataccaaaatacatggcatggagagcagacctatttttgtttcctttttttttaacataattgaaatttagtaggaaaaaaatagcatgaactatatattatcaaggtgagcaacaaaaacctcttcagatatcaacttttctgcatcctcaggtgaaatttcccttgttatttcctctataactgaccataagaccttcaaagtagcaaggactttcttgcgcttcagagttttgcgttccaacctactcaaacaatcagggtggttaaatcacatactatgggtgacatttaatgttcaacaattgtgcttgaaaaacaagcatcttgaaaaaaaattaaactaccaattcagcattttagctaagtgacagacataatttcatagagaaatacatactctccaaggttaccgctgaacacagcagattctctcaacttcatttcatcttcacacaattcatcaactttatgcttttctctgtatagcttataaaattcctgcagtttagcaacatcctgacttcgatctatagcaccaccttccctttttgctagcttttgctgaaaaattgagatagaaataatcacttttagaaaaataaaatttaaatgtcaaacccatctgcttaatttgtataattcaacaagccatggttccggagatgtgacgtgttgtaaatgaggaggactcacaaggcgatattgtatgttaaaacactagagcgctggccatatgaaataaacattgtaaatccatcacaagaacagttcaaaatgatatacttttgtagcgctggtagagcataagattgtggcggttgacaccataggtccatactatcattctacttcttaaaaaacaaagatgtgaaatcacttatttgtattgtattctctatgtatggcttttaccgacatggtttgactgtatatatgaaactcaataaggttctatcttggaggttgtgccagatgtacaaaataacatgtgattatgaaaaataataataaatcatatagaacagtatgaacataccctgataactgacattaaacctgttttgaactgcagtacacctctcccttcgctatttggatccagattttgggctagtgtgtatgcatgctcacatactgcacattgaagtataaacacaagaaattgtcaccgaactgcatttaaacttcatatgggaaagtgaattcagttgctaaaagctgactcaattcatatcgttgatatacccttcgattttgtggagcaaaagccataaaaaaattcattgccagattagtggctgaaaacaggaaaaaaccttaagcaaccaagcacagttcaccgataaaacaaccttaagctaacatcggtttttacctaaacagggataaatactaactaatctcctttgagttagtaaaagtttactattaataactgactggagaaattgccaaaagcataggcagtagtatcccagtacagagatttcagaacatagctggactaattatgggttgtttgcagcagattcagtaagttgactgattttcaatttagcttaatgaaaagaactaaagactgacaggtgatgcagattgctaattgcagaatgccggattgtaaggcactagcatacattggtcagtgtacatccaatcagagcaaatcaagtttgaaaagtcactttaaccatgtcaacgagttgattgatagcaaactcaggcgagtaggagcacgaaaccagtaaagcattagtccgactgtaacaactaaggccatgtttctttcagcttaagattattatgatctagattattgagtcagattactataagctagattgttataatctgtagtagaataagcggttagttgtttctttcctaaattattagagcatagattattgggtttgcaagtctaaagagggagcggggtggcatggtgggtaatttttcacccaataatctggaaaaagctcacctaaatgagcttatcagattataataagctggactccagattataataagctacttcaataagttgtctgtttctttcaacttgctcccaataatctggattataataatcccaagctgaaagaaacagggcctaaatacggtagatggtactaagcctgatcataacggttgacgaaatttagtagtacaaaaggctgtaacaagcaaaaaaaaaagcaaaagtactcctaatggactagcataatcaattcgtgtagccgatgctaactgcagaaaataccaggaaaaacaccactaagtgaacactactaataactgtataggtagggcaattctgagccgcggcgacccatacagctcacaagcctaacggagcgagaaatggtaacgaaacttacgaatcctggcgacggtagggtcctcatcctggatctcgtcggcggcgcgaagcacctcgtcgatgtggacgttgtttccgagagacgacggcacattcccggcgatgccggtgacgggcaccccgaaggcgcctgccaaccgctctccccgcagcgccgcccgcaccaggcgctcccagttcgccgccgccctcgccatcacgaggccctcagatctaaccacacgctcgctcgcacactcagaggccactcgtcatagcccctgctcaccaagctgcttgcgatcgacctccgcgtcgaagcggatgggagatcggagattcggagctagggttttccgctctcggcgcgcagggaagggaggtggccgtgtttcaggggctcaaacgaagaggaggaagaaagcgtggggaactggggatatgccgagactacttttttttctcctttttttttgagagtgcccttttcgcgtttggcgagaccgcgagacggtttgaaaccttttgatgcgactgcgatctggaacggggggcgtgtcagcatgtgatgccgcatcgcgcgtcgcacagggcagcccgctcccactgtcaactgtccccacacgagaatgggtctagggcgcaagagttttgcggaatttttatatggttaattaatgtaatgtaatcttcacaggttctttataaacagtatactagtagaattatcgttgattacctagacgcgtgacgattagagcagtacaataagctgacacagcaggctgcaaaaatttccacgtcatgctattcttacatggagaagagaaaaacgaaggagagagaataaagcgagcgacatatctgcagcccggcgatagcacaagttcccatgcggaaagctcgcgtgcagtcgatctcacggattaaaaacacatattgtgggcctcatcaccaccccttttgatcccatgcgccagattcatgccatggcgcggcactggtacttattttcaggcgacaacacaactacctacatagacagagttcactcttgatcatacgcaagtatgtgcatgcttaattaattcccggattatgaaactgtaattagcatagtatagccattctattgtataggttggctctattattaactgtaaaatgacatggatgtaattagagccaactactggctatactattgaccttgctcttagagcaggtacaatagcagactattagccagctataagcatattttaatgagataaaagataagagagaagagcagcgggctacagatctgtagccagctgcagcacggactccaagacacagtgtgtgtatgacatgtgggaccatatattaatagtatagtaagcaactattgtataaattagctattagattgactatagataaattggagttagtaatgggctatactattaaacttgctcttagaggtggtgtatctgtgccagtgccacctatgacgcgtgtcttgtggacttgtggtgtttccgcgactagtgtacgaaataattggcacgcaataaagacgtgaccaaagctacgcggattttgagtgcgtaaaagtcgtgtggtggatgggatcatgggaacacgagacagttcgttcgtcaaggctttcctcccggtgggctggcgaccgggaaaagctaggggaataagtctatttgtactccctcaacttttgtctttggttgaatcacgtccctcaaccgaaataccatgtataatacctccttcagctttgaaaccagggcaaatcacctcccttggtggtttagagggcgatttcatatgtcgtggcagctgacttcgatgactagctgagtcagcttgtgagtcccatctaccagcctcttcctctattctcttttccatccctcgtggcggcagcgagacaagcgccgaatgccggatggaggacgccaaagctcggggaggttgcggcggcggtgttccggctccgtccgcgtcggaacagtgatgcgcagtccactaccgcatccgcgcgctgggcgaggtaaggtggcgacactaccggtcgctgctcgtcgcggcggaggcacgccggatgagggagaaggaggcggaggcctcgaatgcggtgtgacgtggctacggacgaaggcgcttgcctaatcggtccaccgcggcggcgctccacacgcagctccagcaagtggcggtcgcggcacaagcgagaggcaaggcggtggaggacgacaacaacaacatcggcgcggcgaacaatgctgagtcagggttcatcgacccagatagagtataggaggtgaccccaccgccgtcgtcgaggctatgttggacatgttggtgtggcagtctctatcgggatgccggtttgtgcgcaggagaaggcgatgacgtgaatgaggtggcggaggagaggcgtgagaagggaggcggcggtggcagggagggagaagaagaggccacggcgatgccgaggaggcgaggatggggatgaggtggcgaggcttcttcacctctgctctctctctctctctccgctcatgccaagctcttgccgctccgctgagctcccgccgtcccgccgctcccgccgagctcccgtcgccccgccgctccactatcctgctgctcccgccgagctcctgctactccaggtcccgccgctccatcgcttctgccgccgagcttgcgcaactctctccatctcgctcgccgctagggataaagagggaggagaaaggtgactgacagatgggcccaaaatttattttattattttactcactgacatgtggttcccattcaggtttgtttttattttaataccatgtcgatgccacatgggatgaagactaagtcaacccgccacataagggccacgtaggacgaaactgccgagagagtcgatttgcaacggttttggaaattaagggatgggttataacctgttttgcggttgaggggtgcgattcaaccaggcgcaagagttgagggagacaaagtagacttattccaaatgttgaccagtcttatcgttagaccttcagataagtaggaacacatcctatgcaaagttttgggtgcacaattcatctacaccaataaaaataatcataacaaattctaagaaaaattgtagtacatatcgttatcattgtagggaaaaaattgggtaggttccatttggtgtgtggcattcggagagtttcaagatctccgatcaccaactgtaatctaattgaaacttggcggttaaaaatgaccggatgtagaacatgaagcccttacgctcttagccgtaatttttcacctccttggctgccagtgatgccgaagacatcgacggtagttggttgtggatcatcctgtaatgggcttgaaattgtccttcgagtttcttcaaacgttttcatgggatggagaaattagggttttgggaacaaaaaattcttaccgtacgagagatcatcactcatacatgggacttttggaattaatgaatgggccttagcccacttgaaaattaattctttggaaaatcacaaaagcccacctcgtaggatgacatgcatgtggagtttagtaccaccttacttattctaggataggggaacctccttaaaagggaggatgccctcctagccacttgaagcatgtgtggtggagagaagagggggaacacacgcgcgcgctcgctcacctcgcagggcaggcggcgcgcgtgcacgacgtaagcgtcgaatggtccgccaaaattggtccctcaccttgcgcagatgcagcctccttttgcagttttgttttgctgcaaattcggattcgtttttgtttttggaaacgttccgaaaaaatccggtgcgtacaaacggcgtggagtccggataagttacgcgtgacttatccggttcggttacgcgcagtggagatcgtgcgggctccctgatcaagcgacccttctctatataaaccgacccgccgtcttcacgcaacacacgcgaaatcaatctagggtttgcctcctactctgtgctgcgccatcgctcgtagattactccatcctgctcgccggcgtgcacctgcgattgggagagcaggtctccggaacctctgccttcgacgtcctgcaccgagagaaggcggcaataaggtttttgggaagcgctttgcgcgactgctccctgttcgtccgtgacggctcgtcttcctcttcgctcgcgtgctgcgtgccttcgtagacgcctgcgaaaagtttcgaccgaacagccggtctttccgccacctcggtacgtgttcaatatgttgcgcatatttgatctgttcatgttatattgtgtagtttacatgtgtagatctaataatgcgttcatgctagttttcgtctgtaatgtcatgatttatttatggaatatattaaatcattatatgcctataatctcaacagggacagtactcttatatgcgttagtgggacttggggccgggggtgtccaagaagaaagggaaaacaccttcgatcatagcgtctctctccagcacacacactctttctctctctttcacgtagacgaaggttggctactattagccagtttgtacccgctcatcttatggttgagtagcaaacgtatggtacagccattttcatggttacagactacggctcccatcggataccctattcagttaaaggaaaagtcaaattttgaattttaaacttaattttgatattaattttaatatatttttaacattattttttatcattaatttttaagttatcatgaacacttatataaaagttttacctataaaattatttttgttttctaataagccattttaacttattactagaaaatatgagcaaacaatgggactctactcgtttatgcgttggattcaaaccccacattgtgacgtataatgacatgacagtatgacacactctccttctcggacaccaattaagctgtacagacagttgaccgcttgattgtgtccaaagaataattattcagttactgtcagacaactgtttaccggtgcagtcttattggcttaacctgcacgagtgcagcaagcttagagcagtggtgttgtaatgctacagccccaagtcgtattatcgtatatacatcaaagtatcgaacaccctgaaaggatatgcacaataatctcgacgatggtcacttcagaaagaaaattacactggcccttacccaataataacccaaacaaacactcatgctccatagctaaaggactactctctccgtccaaaaaaacccaatccagattcaaatacaggattgagttatttttgagacgaagggagtacactatgtccagattcaaactcaggattgagtttttttttcaggacggagagagtaggagagttgcaaagatagtttctgcaagtcccacacccctactcaactcagtcactttgctagctagtactattgctctgtagtactccgtattgtactactgccaactgtgacgcgaaaatgtgatcagttatgagagcagtgacatcaaatgtatatttcttctgatgaatcgccataatgctggcgaaggcgactctgtctgtctgtcttctccccttgcatatcgttccgctatgcagtgggcctcttgcactataagcatcaatcgacggagctgatcatgattcatgagtagtagctgatgctggacgacaatggcgttgtttggacagatagtagcttaaagttcgtagtaggagtattaattgctttttttgtctgaatcatagcgattcattcctcaaaaaactgaaagttaacacagcttttcaggtggcgaaagcaactacagaaccgcatggataaacgcaacgctcgtcgtcagcagcatcccctttattcttcatcatgactgacacgatacaacttacaaacagtaaatcgtaatttacctctggtaccaggagaagtgctccaagctgtttttttttcccgaaaatgaactccaagttacttttagtgtaacaaccgaacatgttacctcttgaggcacggtaaatttctgtgcaattatattgcacggcttgatcgattcggggcatgcatatgaagatatgcacatccaaagcagaggcacgcatgcatagaaaaagaagtcgcaaccaaacaagcagatgcatggctagccagctgcattggcgtttggcagtgtaggcagccttccattcccgtctttgatgaccgagcaacccccgctgaattggaatggtttttcgtagacagacgttatttgtcgtatgggcgtctccatctgacggctgttccaggacaggatgggcatgcaagatcgatgctcgtgaaagcgacaagcagctctcgccgcgcaagagatgaagacgggagaaatggaaatgctggatttttttaaaatatattttgctctctttaaaaaattattttacaaatgtattcataaaaaacttattttaggaatagatatttttcttgccgccagtgatcctggcaccgagatctaacgtctgagcatcaacgatattagtgacgacactctcatccccataagccgagatacagaagggttagctcctaagaaattagcgcttaggacctatttgtaattttttttaaaaaaaagactacaatctaattttttattacaaacatgtcatcgacgttaaagttttgtaagattttttttacattttaatccttttttaaataataataataaatctttaacgtcgatccccttcacatcaacagtttggctattagggggatgactagacgagggtgtcgtcgcttagacattgaagcttgacactgagaaaaatggtccatttataacataatttttttacagtgatctatttataaactaaagctttcaaaaagtatgaaaaagtaaggccgtgtttggccctgttcactttgttgtcaaaaaaaccttaccaaattttggcatagttatcaaaattttggcaactgacaggattttttatatagttaccaaaatttagtagcaaactaaatgtagccacttttttgacaactttactaaaatttggtaaggttgaaaacggcatcaaagtgaacaggcccttagtttcccccctattcccaactttccatcacatcatatcacattaaaaactttcctacacacataaacttttaattttctttaaactttaaacttttttcagaaactaaacacaccctaaaacaaaaattctagaacggaaatgagtgatgaatggtgccctgcagctgcagaggataggagtatgggtggcctgaggtccaaatcagcagagggccgggacggacgacgtgtaaacgtccatccaggcgtccatatgattccgggcgggcaggcatgcaggccattgaatccgagtctgcgtcagcgcaatgatatctgctcctactacgcctctgcctgactgcctgcatgcgcatgtctgagttggacatgaacatgacctccatcgcatcgattgcaatcaataatcgctggccaggacgtactcgtacagtacgtgtcattggtctcctgtaccaccccaacgtagtacgccgcattcactgatccagcgcacgcacgaatgcacgatgtgatcaagatcaatcgatcgagccacagttttttttttttggccctttccccttgcgtcacccccggccgtacgcgcggccgtgcatccctgcgctgtgtttcactgtgtggcgtccatccatccaacaacgcgcggcgcgcgcggccccggcgttttgcacgcccttcgtccatccggcgctggaattttgtctggttgatcatcggtcgccttctcccccgaatgattggatttcgtatacggccggggaatcgcgacggattctggggtggggggtggtcctcgcggcggctctggcacggctcgatcggattcaagcaatgcaagctgtttggattgtgtgtatagcatcctcaatagcctggacctctctcaactctcatctgaaatgagatcgaccagttggcaccatcgagtggctactggctaggcagtttggtacgccgttctccgcgtacattttttttttggactgttccttgtacgttactactacctacgtatcttcggcacgggcaccggcccatctctgacgctgcactgcatacctcataatctcgacctgttacttgagtttgtgttgacagtttttgaccacccggattgaaatagtttaggaagtttttcagtcggataacacatgcaagctggcacagctgatatatatatatatatatatgcaatgacggcatttcttatcattaatcgatcgtgttattccaactccgctaattacaatcatcatccaaatgaatagtattaattagtttggttgattattaaacaaattagacacattattgccttattggactgaagaatttattctgctgatcactttggacccgcgagtagactgcaagtcttttgaggggactcctacgagcaagtttaatagtatagccaaatactaactctaattcatttatagtcaatctaatagttcattcatacaatagttacatactacattattaatacttggtaccacttgtcatacacacactgtatcttggagtctgtgctacagctggctacaaatttgtagcccgctgctcttctctctccttattatcttcttaaaatatgtttgctattgtacctgctctactaaactcatcatcatggtagcaatgtactgtcaattgtcctgctgcgaggttaggagaagctactactaattgtctagccctttaaaactttaggttaggcagacgtagcactcgccgggcttgcatgattaagggggtgtttggaagagaaggccaaactttagggggtgtttaggaactagggactaaactttagcctctctcacaaaagtataagtctctcccctagggacttatgtttttgagagaggggctaaggtagtgtttggttggagggactaaagtggggctaaactttagcccctctcacaaaaacataagtccctaccatagggacttatacttttgtgagggggactaaatttagtccctagttcccaaacaccccctaaggtggtgtttggttggagggactaaagtggggctgacttatgtttttcaaaaacataagtccctaccatagggacttatacttttgtaagagggactaaatttagtctctagttctcaaacaccccctaaggtggtgtttggttggagggactaaagtggggctgactcatgtttttgtgagagggactaaatttagtccctagtttccaaacaccccagtctctcccaaacacccccttagtccctctcataaaaatataagttcctagacttatatttttgtgagagagactaaagtttagtccctaatttccaaacatccctaagcttagctgcatcgacgttaacaatttctattcccttccatttgggcacctgccgtgtcaggtaggacatcttgaaccgggagggcttatctgcagggaactcatggcccatggggtgcccattcttcccaatcgtgtgcccgaataagaggtgcgaaagcgaaatggccatgcaaaagtaaagtgatgacgatgaactagccagagaatataatatccaaagactgatcattagctctaacactgacaacttaacaaaacaatatactccatctctatctcattagcacagacagctgcctttatttattccagataagattgtgttagagctgactagatatgtcgaaaaccacgttttagtttaggcgtcctgtgtatgcaaattgcgtgctgtgccgttgtgctgtgcatggtactactactgtagaaatatgaagtctggtcagacgagacggccgcatgcaagccagctgcagttgcaaatgcaagcagactgcaagctgcagttgcagcctgcctgcaggttttgcccttggctgtacctggcatggaggatcaaagtcagctggcggatataaatatggccgcaagcagcaagcaagcgtgcgacctggcttaccagtaccaaccacagctggtgcaggcagtatcagcagctcatctccctggagtatctatccagtatatctacgcatgtgttggtacgccatgggcaacgtgttggttgaattcgcgataagccctcacgttgactagtttaatccgtcaggctagctcctctcgcgcattccattcctaggggcttcgaccgcacatcgcagtggaggagccaaccgagggagtgcgtgcgtgcgtgtgtgtggactgctctgttgtgtgcgccgaggcaatttctttatcttacgggagacgaggaaaaggtgggcggcgcggcgagctactagcagaaaagatggcgagagagcggaaaaaagcctctccggccgccgtgccgtctgttcgttccattattccagccacgtacgcgtatatgacaatacggtgcactcgatgtgggggtagatagatggtagatgttccgatcatatagtataatccatcggcggacatcatgaactgcaatcatgtattgcatggatacattgagagcgaacaatcatgagcgagttagatgcaccaattattgctgtagaactaatttggccgatttgtcaaaaaatggaacccagggaactctgctacacacaaccgagtatatggagggcggatgaagatctatctgtttaagcttaatcgaaccaaatctaacatatcttcactgagctcaaaacaagtctcctatacagctctatctccccggtacacgaagagatgtctctttccggttacagggacacatcggaattctcttttccacgtcgagctgtgggagcattgttcgataaggcaggctcctgtaagagcacccgtaatgttaaatataaaacatatacatctcagcaacaaactagattagtattaaaccatctcaatagtatgtctacattggtatctatagctctctaatccattgcctcgtttttctttatagattatctctaaattagtagatagttttgctctctctccatttaattttttccaagtagaaaaatatgctgacatagatctcttgtagagagtctatagataaccattgcgggtgtcctaatccaaaaacaatcgtaatcgaagaaagaaagtactccctccgtcccaaaataagtgcagttttgcactattcacgtttaacgtttaaccgttcgtcttatttgaaatttttttatgattagtatttttattgctactagatgataaaatatgaataatactttatatgtgattaaatattttcaattttttaaataagacgaacggtcaaacgttggacacggatatctactactgcacttattatgggacggatgtattaaagtctgaactcggcgaccaataaataatcctctagcatatcagcacgatcgaattgtatatttgtttattcgcgcactgtcattctccccacgcaaagcgacaagcagcggctcggaaaacggcttcgtggctcggacatctgtcgacaaaagcgacaccccgctggagtcaaagaatgattgaccctcgtctcatggtctcatccactgcttcttcttcccctcatctccctgccccgaggcctctgggcccatgagctagaccatcattagccctgtcgttgacaggtgggcccaatgtcccttggtccctgtgggccccactggcaggcaaaagaggggaggcaatggactggtactgaacgttctaaaaagacgccgccgagtcgctcccgtccacggcgtccagctagcgttttgccgcagtggccaacaaacggccagcgatccacgggagcgacgcggattcgaatcatcggcattgccgcccctgcacttccactggagctagttaccgcccagcattggctctgtggctcagtggcgcgcatacagctcgctccactgacgtctgcttcacaagtcactgccatagccgcggaggtcacacttttcttctcgtgtcaaattaaagatgatgtgactgaaaaattgtgtgtgtatgacaggttgatgtgatggaaaaggaatgaagtttggatcaaaactttgaatctaaacacaatctacttttgagtaaaattgatcccatcagtgaggaatgatttattagcagcaaaaagaaccgttgcttgctgcacatttaaaacttgtggcaatgctaagctagtaagctcatactagcccgtaaaatacgagtatcttggagtgcaaatgtgcaatgacactattcaaccgagctatacgccgaccacgccattccatatcttcgaagcagaagttacccctaccttaactggtgcagttacgggtaagtgtcgcttcagatatgatttctcggaaggaaatcgtggggagtccatacgacatccatggacttcaccggaaagtaactccacctccagctccaagcccgggcttcttctagaggaaaggccatgaacccatcgttttctgatccaacggtcaccctgctcaccgggagcagtttgcagcaaattcaaattcaactgggtgaccccccctgcattgccattgcctctctctcctctcctcctttcgttcgtcctgcttctgctctccagctcaccgccagtgccgcccatcactcacgcctcccacccactgcccctgtccctccctcccctacataaacccccgcactccccctccttgttgcacgccactcccccctccccaccaccattgttcaaatcatatcacctccagtttttactcacaa

SEQ ID NO: 43000 - DNA, 36770 bp, Oryza sativa
  unsure (1)..(36770): unsure at all n locations
ttactcacaagtcgcaagtgagagccactgagccagcatccaaccagtgtacatcatgaggactcaacgaatcctcctcgccgtagtagtgtccatggttgtttcctcagcgatgctggccgttgtctcctgcgcgcgggagaggaagaactacgtggttcatctcgacccgagggaggacggcggcgtcgccgactcggtcgagctgtggcaccgctcgttcttgccggaggccacgccggaggcggcgggggatgatggcccgaggatcatttactcgtacagccacgtgctgtccgggttcgccgcgcagctcaccgacgacgaggctgaggcgatgaggaagaaggaggggtgcatcagactgtaccccgaggagttcttgccgttggcgaccacccattcgccggggttccttgggcttcacctcggcaatgatgggttctggagccgctccgggttcggccggggcgtggtgattgggctcctggacaccggtattttgcccagccacccgtcgttcggcgacgccgggatgccgccgccgcccaagaagtggaagggcacctgcgagttcaaggccatctccggcggcggatgcaacaacaagatcatcggcgcgcgcgccttcggcagcgccgcggtcaatgcgacggcgccgccggtggacgacgcggggcacggcacgcatacggcgagcacggccgcgggcaacttcgtcgagaatgccgacgtccgcggcaacgcccatggcacggcgtccgggatggcgccgcacgcgcacctggccatatacaaggtgtgcaccaggagccggtgctccatcatggacatcatcgccgggctggacgccgccgtcaaggacggcgtcgacgtgctctcgttctccatcggcgcgtcccccggtgcgccgttcaactacgacctcgtcgccatcgccacgttcaaggccatggagcatggcatctttgtcagctccgccgctggcaatgatggcccagtcgccgccaccgtgggcaacggcgcgccatggatgctcacggtcgcggccggcaccatggaccgggcgatacgcaccacggtgacgctcggcaacggccaggtgttcgacggcgagtccctgtaccagccgcggaacaacaccgccgggcgccagctcccgctggtgttcccgggcctgaacggcgactccgactcacgagactgcagcacgctggtcgaagaggaggtgagcggcaaggtggtgctctgcgagagccgcagcattgtcgagcacgtcgagcagggacagaccgtgtccgcgtacggcggcgccggcatgatcctgatgaacaagccggtcgaaggatacaccacattcgccgacgcgcacgtgctgccggcgtcgcatgtgagctacgccgccgggtcaaagatcctgtcctacatcaagtccactcccaagccgacggcgagcgtcacattcaaggggacggtgatggggtcgtcgccggcgccgtccgtcgcgttcttctcgtcccgggggccgaacaaggccagcccgggcgttctgaagcctgacatcaccgggcccggcatgaacatcctcgccgcgtgggcccctggcgagatgcacaccgagttcgccgacggcgtcagcctctccttcttcatggagtccggcacgtcgatgtccaccccgcacctgagcggcatcgccgccatcatcaagagccttcacccgacatggtccccggcggcgatcaagtcggcgatcatgacgtcgtccgacgtcgccgaccacgacggcgtgccgatcaaggacgagcagtaccgcagcgcgagcttctacaccatgggcgccggctacgtcaacccgtcccgcgccgtcgacccgggcctcgtctacgacctccacaccaacgactacatcgcctacctctgcggcctcggcatcggcgacgacggcgtgaaggagataacccaccgccgcgtctcctgcgccaagctcaaggccatcaccgaggcggagctcaactacccgtcgctggtggtgaagctgctgtcccagccgatcaccgtccaccgcatcgtgaccaacgtcgggaaggccaactccgtgtacaccgccgtggtggacatgcccaagaacgtcgcggtcaccgtgcacccgccattgctgcgcttctccagggcgtacgagaagcagagcttcacggtgaccgtgcggtgggcagggcagccggccgtcgccggcgtcgaggggaacctcaagtgggtctccgacgagcacgtcgtgaggagcccgatcgtgataccgccagcgaaggccgtcgtgtagtggatcgaattgagcagcaaaatcagcagcttctctgctcgtgttcgacgagagtagaatgcactcagagtacgtgtccggtgtacgtaacgtatggcgacgtaggcgtattacggatcgatttgttgtatagggctaccgatcgttgtaacggcagcaagctcagctgcaacggagttgtgtaaatactggaaaaataatggatttttagtctgtaagatgactcgatcgatccggcatttcaatcattccgtttaattgaatctagtactggtacagatcataaaatcaattggactagtactcctactccctccgtctaaaaaaaaagacaaaccctggtttccgtgcccaacgtttgactgtccgttttatttgaaaaaattatgaaaaaaattaaaaagacaagtcacatacaaaaatattaatcatgttttatcatctaacaacaatgaaaatacgaattataaaaaatttttatataagaccgacagtcaaaattggacacataaattttttttctttttgtctttttttcccgatttgtctttttttttttgacggagggagggagtacgctttaagatgtgcactgagaattccaacgcgtttggagatcggagatggagcactaaaaccaccgcctttttttgcttgagatttttcctttgggttgctcgatcgagtttgaaggccgtgaactgatgatggccagctgcagctgctgtaaaattatggagccgctgctttgctcgatccgtatggaccgtatgccaaccagaaaacgtcacaggagtaataacgagagacagagatgcatagcaatagcatagctagcccgggtttcgccattactgaagacgcgttctgtcatacgcgcacagggatcataactctcggtcgtttttatggcgttcctacccccacattcactttcagacggcaacatcaatttttccagcctgtaactttcattcgctgcgacaccgtacacgcatgagagctgagctgagctagcgagatgagcaattctgtactgttccgaccttgtggacttgtactgtctcatgcgtgttgctgcattttctgaagctgttctcgtttctcggttaacaacaaatactcctacacaccgaacagttgctaggtacaccatggcaccaacaaatgcctgttcaggtctaaagaaaaagatgtactgtttcagatttagtttcgtagtggtagtagtagcatattaactagccacactttggtgggtaggatctaattaacttcctggtttgtaaacctcaaagtttgttactacaagccttgctcatgctgttgctgcattgagattggaaagctgctaatagggagcaaacattaaacatggtgtacttaaaaacgaaaaaccgaggcatgtgctaccttcatggaccgctaatttcgtctagagagaaaagtgcctttcgatcgccttgtactaatcgaacattttagcatctgggaggaaagaaccagctgggttgtctgtcactatcttctactactcctatgtgctcgtagagaggaacgagatcaccaacaagaagggagaggtatcaaatacagtacgtagtacaagcaactttgcttggagttgtgctttcctccggcgcgcatgaatataacccatgatggtttcagataaaaacagaactggatctgcatgaaaaggcatcacattttctcaggagaggtacaacatccctaattccctcattttgtacactcttttgctggtggcagctgcctgccagcctgccaaaaggttagccacgcttaaacaggaggtggagccgaagttttggtggtgtttgctcgcgtgatccgccgggttatgaccaggcatctcgctcaagccctccacgttcatgctgggcacctaccattccggcattccctcctccctatcagcaaaacgttccaaaaagtcgatcggaatacaccaaaaatggctatatattcaggcccgttgattgaacttctcagcacagagtttggaacagaaagagcagtagcagctcacgagatgcgcatcatctgcacagtacatcatcagagagcagcagaaagagaggatacagatcgatcgatcaaagcctgatgagaagacttgagagcattggagccgaggagtacatacgctgacactgttggtgcgcgtgtgcgtctcccagaatcttgttgatctcctcacacttgaggcatgagctcgcatcgagtcgcaggcgcccaaagccagcaacagcggtgcattcacagaccgaccgtactgacctgcaaaaaggcacccccatggcgtcagggagaggaccaaaagagatgaaaatcaaatcaaatgcacacggatgccagcggtgaatgtgacgatatatatggtccagggggtacacactgtgtttgtgttggatattttttgagtagcgtcctttccaagcacacggggcagtcaggcccatgtgattatatgggccaaccctgagccgctgacgtggcgcaatattgtgggccccaggtatcattttttgagcccaacaagcgcacgcgcaagtgatgtcccgattcagagcttacacctgatcgtacggctgatctggcacagcattacaaacttgtcgcggtgcaatgcaatacggcaagtgggccctggagagtacatacagatcagacggcatttgtccatgggcccacggcccattcattctcccctccatttcaggggaagcagcgatcaaccgggaggagaggaggacatgcgacgtacacgaggcacatgcaacgagatcatcgatcgatcaaggtaaaacagcacgaacagttgacgcgaaatcgtcgaattggagcgggatggatgtggtgtggccgcacgggcacggcgtctggggctcgtcgtcggcgtcgcggcggtcggcgatgctccacggcagccttgacatatggatccacgaggcgcggaacctcccaaacatggacatcgtctccaagaccgtcgtcgacatcctcgggacgaagaagaagaagaaggcggccaacggcgccatgaccagcgacccctacgtcactgtgcagctcgcgtccgccaccgtcgcgcgcacctacgtcgtcaacgacgacgagaaccccgtgtgggcgcagcacttcctcatccccgtcgcgcacgaggcgcccgccgtccacttcctcgtcaaggacagcgacgtcttcggcgccgagctcatcggcgaggtcgtcgtccccgccgagcagctcgaggccggggagcacgtcgagggcgtctacccggtcctcgatcccgccgccggcaagccgtgcgcccccggcgccgtgctgcggctgtcggtgcagtacatccccgtggcgaggctaaccatgtaccaccacggcgtcaccccgggcccggacttcgccggcgtccccaacacctacttcccgctgcgccgcggcggccgggtgacgctgtaccaggacgcgcatgtgccggagggctcgctgccggagatcaggctgggcaatggcgcgctctaccggcaaggccaatgctggcacgatgtctacgacgcgatatcgcaggcgaggaggctcatctatatcaccgggtggtcggtgttccacaccattcagcttgtgcgggacggcggcgccggcgtctcgctgggcgatctgctgaagaggaagtcgcaggagggggtgagggtgctgctcctcgtctgggacgatccaacgtcaaggaacgtccttggtatccagatggtatgcacaatgcaacatgcaatcacaaaattaattttcggctatttgtttcttgtatcaaactgatggtcacaccacttatttggcttctggtccaaatttcattgctttgtctaatggtagttggggttgatggagtgacacattgatctctgaaaacctgtgaataatatattcatgcaaatacagcttgacttgttgtcagagttttctctataggaaggttacatgggcacacgggatgaggagacccgtagatttttcaagcattcttcagttcagatactgctctgcccgcgttctgctgggaaaaggcacagctgggttaagcagcaggttgtttatttacaatttgttttcttcagtaagctttgtctcctctgaatgccataatttgcttcatatagacacatgtcaccagctaacatctttttagtcaaaatagctgttcttgtggaccatgtaatgatgttaacagttgaaaattgaaccaggagaccggaaccatttttacacatcatcagaaaacagtgattctggatgctgatgccggcaaccataaaaggaaaatagttgcttttgttggaggccttgatttatgcggtggacgatatgatacacctactcatcctctttttcggtctctccagacattgcacaaggacgactattataacccaaactttgcggtgagattactttgtcctattgttcatgtgcctgtatcactgtatgtggtttatacacatgaaaatagttcctgtaattgacgcatcttgtatttgcaggtacttgatgcccaagggccaagagaaccatggcatgatttgcattctaagattgatggcccagcggcatatgatgtcttgacaaactttgaggagcgctggttaaaggcatccaagcgcagcggggttaaaaaattgtcaaaggcaaataatgacacattgctatggattggaaggatacctgatattgcaagcattgacgatgaagtgtattcaagtgacaatgatccagagcgatgggatgttcaggtaagatccttcaaaggttttcacagctacagataaacaaagtatgtgaccaaacagcactgaacagtattaacttggaagcagatattccggtcaattgattcaaattctgtcaagggttttcccaaaaatccaagagaagcaaccagtaaggtaactaagatataaatttcacccaattatgctatgtttggttattctttgtatttacctgacacagacttttcctttggttgacagaatctcgtttgtgggaaaaacgtactaattgatatgagcgtacaaaccgcttatgtgaatgcaatccgaggagctcaacacttcatctatattgaaaatcagtatttccttggttcttcatttaattgggattcacataaagatgtaggtaagcatgagctttgtttgcttcaaatcttgttgttcaactcaatgtattctggccttttatggcacgttccaattgcgttctctaatagtaacttcatttaaaatttgctgctttatgttggagaataattcaaaatttcttgacccttatcatgacgtaaataaatacgacaagtacttatggttgcccctaatttcaggacttaaaatttgttctgctgcaggtgctaataacttaataccgattgaaatagctctcaaaattgccaacaagatttatgccaatgagaggttttcagcgtacatagtaattccaatgtggcctgaaggtaatcctactggtgctcctacacagagaatactttactggcaggttagagcgtctctctagcattgtcttctagtctgctcaactgtgtactatctgctactacattctacagagctaacttctctcagtatagcaatgtaacttatttgttgtcattgttgttgtcattgtagaaaaaaacaatgcaaatgatgtatgaggtaattcacaaggcattgaaagaagtagggctggataacacatatgagccacaggattacctgaacttcttctgtcttggcaatcgtgaagcaggcggcagtcctagcacttgcagaggatcaagttcagccaacaatccccaggtgagactgcagtacttctgcttctctcgcagcatactcaaattgtatgccatccgtacattcagagttcagatttgtcttgctgcgacctgtacattcaggatcaagctaagaagaaccggaggttcatggtgtatgtgcactcgaaagggatgatcgtggatgatgaatacgtgataattggatcggctaacattaaccagagatccatggaaggaaccagagacaccgagatcgccatgggagcgtaccagccccagtacacatgggcaaacatgctttctgctcctcgtggacaggtaaatgatcccttgatcacccaaaattccacagatttcacagttgcgctgatggattggttttggtgagctcgaagatctacgggtacaggatgtcactgtgggcagagcacattggagcggtggaggaaagcttcagttgcccagagagcctggagtgcacgaggcaggttcggcacatcggggagcagaactggaggcagttcgcctccagcgaggtgagcgagatgagagggcacctcgtcaagtaccccgtcagcgtcgcccgcgacggcaaggtgaagcccctgccgggatgcgccgcgttcccggacctcggcggcaacatctgcggcacgttcctgcccatccaagaaaacctcaccatatgaaacaggataaagatgttttcgtttgcgattcttgagaagggattcttgtgaaagcagccctggacgcgttgcattcgttgtagatgtgcagatttttctcttttcttcgttacgatttggaggatgtgaaattttgggttgggatcaacacagatttcttagatttcgccgcgagattgtttcttatcttggtctccagcagcggcagggtatacaccgcttctcgccggcgatctcaggcagcggcgcacggtctccagccgctcccgggctgccgcgaagatcgaaccctgtgagggattagggttctccgccggcgatgcctcccgcatacaattccgccgctcgccggagctccaccggctcccgtcgcgtgaggccggacgctcgccgacacgaactcgtgattcgtacaccgttcgatcctgattgaacggtcatgatttataagttctatttgcataagagcccttcctacgtgttagattatcaacttcacccccttccagattggaatcctggatcatatctgccgaaattttgataaaatagctctttttcaaaacttatttcaacaatacaccacgctaaaagctatttaaaaatagatcgtgacctaggggccatcctcgttgatataacatctcaatgttattaacatttgcgctgatatattatctaacgtgacacgattaatcctgatctaacaaattatgtcacatactcacatcggtcaatatgttcatgtcaaatataatggtgctaaaaacattatacctcatgtctaggtcgcgatctatctctcaaaataatttttgccgcggttttattattgaaataagttttatagaaggttcaatttgtcaagattgcggtcaaatctgacccagcaatcaactcctacggtccagattcaatgtcaggaagggagaatcttctgaatccaacggtgatgaggggattaccagccgcgtagccaagtcgctgcacagcttgatgccaccgaagcggaagagggctgcagccatggagacggcgggaggggacgccgcgccgccgccgcagcagcagcgtcggaacaaatcctcggcggccaacaaggggaagaagggcggcgcttccggcggcggaggcggcgggaggtggccaccggtcaagccgaagaaggatctccaggtcaatcgcctcaagggcacccacctcctcaccgtaagcctaccttccccttttgaccccaaccatgtctgaattctgatgtctgcatctagtatactgctgctcgaattagtgcttctagaaggcgattagagactagatgcttgatttccgcgaaccaccaggagcgccaattttgatttgagtgttagggaatcatctgggttggctctacttgtgttgtgcggttgattctaaatgcagtaatcaaatagatttcctgaatacaaagtgatgaagcgtatgctaggatgaaatgctatttgatgcacaaggagaaaatgctaagagaccgttcagttggcatagcaatattttggctgagttgataattgtttttagatcaggggcagtgcgcccagctttactaagaaagcataacagggttcattacagagttgataattgtttccctattatttatggacaattgccttacttgaaactgaaataggtgccaaacttcttcacttccgctgaggcgaaggcctttgtcgacattgctgagaatattggcttcacgcaccagggcagcctcggacccctgaagggtgaagcttatagagataatgaccggatatctgtgacagatcctttgcttgctcagaccatttgggaatctgggataaacaaaatatttgaggacatcagcatctctggcaaagtagcaaccagcttgaatccaaatatcaggttctacaggtatgtgtgctatcaaaagttgaacaaagatgatgcactagcaccacactgttggacaaattgccactgttcttgattgctgcttgttgctcatcctcataggtacactgaaggtcagcgattcggtaggcatattgatgagagtgtcgaccttggagatggttcaagaacattgtatactttgctaatatacctctctggcaaaggaagtgcaaaggaatcatcagggcaagctcttgttggaggggagactgttttttatgatcatcgtggaggagttgtcgctgaggtattttctgattctgaaattgcaatatgttttataagatcaactgtttgctagaccatttcatatgttttttgtttggttctatggaaaattgggtctggtatcaagctatatattgtatgtttagtctgtcattcatctggaagttaaccttgaaattaatgtgcacacatgttctttctagctaagtcagaaagaggttgagatgcatatatgatcatgaaactgaaaggatcatacataaagaataaataagacgaaattcaccctccctctacatatttaatttcttatgctatacaaaaactagcaagatctactccattggcaattccatcaatgacacccttgtcgaaaaactacgttgctctgacgaaaagagattgcccacttgaagtttggtgatccatatggggttgatgatatcacctttattatgctggcatgagtctaccctgcatcacaatttataatgctgccattaccgtcgaagctggtcctaacccctaacctgaggttacttctgttgtaggttgctccagtgcaaggactggctctactccatcttcatggtgccaaatgcatgctgcatgaagcacgggttgtgaaaaagaatatcaagtatgtgcttcgttctgatgttgtatttgcttagctggagaattctccatgcttgtgttgaagtactatagacctgagcatgctatagacgaacggctaacttttccattttacaaacctttgtactaaagcatgtaactgatccaacatgaacttggaaggtgatgacatcaaatttgtgttttatcttctgttactgcattggctgtgatatgctgcagctccgccgacgtataagaaacaggacggctgaaagccaaacatgggaatcatgctttgcttaaagcgattacagtggaaatctgacagccacagtgaaagctaaatacccaaaggctatcaaagaataccaggatcaacatattagccaccaaataacagcacacgccgaggattaaaaaacggacgcctatgataagagtggatctagaaacatctcatcacatcactgttttgatgcaacgtaaaaaaccattagcattcatttctccaagaaagtatctgaatcccggtggttcaaatgctcgccatcaatattaacatgactaacattaatgaaaaaaagcaacacctatcttcccgggggtgcagaaggcagcggcaatattagtttgcttccgttaatgagaggaacgtcggtacgtgagtctgatctcccttttcttttcacctcaaacatgaaggatcaaaatggaaagtctgcacaacaaaatatgctgtcaggcaacgcaatgcaacatttgacataccaaggttacacaaacaccagtctttcagcaactttagaagccagaagatactaaaatgtttgcatgcaagccaaatttcttcatatgaaaatttgaacatacatctcagttatgaatcaagcacatagttgccaatcacaagataatatatgcacaaatttaaataacagaactataagtgagatttgaaatactacaaaactagatgtgggaccaaccatatatcaaaaaccatcataggattacaagatgacaagaaaatgcagatacagttgatgtatacatgtaattaagtttaacttctggtccgagatacttacatcatcagttattaaccagtttcggatgtcctgtttccttgtctatctccactcttagacctatgtcagcaatctctggagttataacagcttcttgcatcttaagtccagatacctccttctggttttcctcatttccttcaagcaagttcttcacagcaaaaagaccccactccctcaagtatgggttttcttcatcaacaacacactgctgcaagagtaaaataatcccatccaggtgcctcacctcatcctgcacttttttgcttctatgcaagcaattagcaatcacagcgactacatctctcctgtaaccaatgtatgggcagacttttgcagttcctaaggctggttgatgatctccttgtccccttgccatagattttctgatcatacttgggggttctagctcacgtaagtacgttagaagatgctttacaagaccagtctgcatcagtgagtcaacaggagcctgtgtgtctgacggaggggattcccaagcacatatatccttcaagagcaccaatgaatatccaagtacatcaattgcagggtgaccagttggaagaggagagttaactcggcaagtaaaatccacaatctcagcagcatgcttctgtgcattgaaaatatcaagtgcaaaactgatcgatacactgacttctttaggtcggttagccaaacattttgacaatttacccaaaagatatgcatgcttagcattaaactcagttttgcattcatcaccatcactgtgctcagcatcattgcgtgagcataaagctacaaacaatgtttcaaacttttgctcctcaacacagattttgaagagaagccattctaaccattcttcatcatgccccactgcattttatacctcggattagactcatatcaaagtaaccataaattaaaaatgtaaacaaataaaacaacctgagagcaaaatgtgaacttcaacaacagcctaaggagtccctatgaagtaaagttacataataaagaaaaaaaatatgactgtattatttctcaagttatagttacgtgaaatcctgccctcaatatgtgaggaaacacagatccagcactttagacatgatgcaggcaactatgtgaagatatacatgatcacagctccaatcactgatatatatttttttacttcaatgtaacatatgaaacctgtgatagtgtggtccgaactccttttacttaaaacaacacagtggcgatatatttccacacatgaagtaggtgaacaggcattatctgccaaaatgtcaatctaaaaatttcaacaatgccatatcacaaaccaccctcttaagttactaaattccgtttcctctatccacactcaacatactagcaggagagcatctgatacccaattggacccaaaggcccagatattacattaccaattcctgtccatactaatgaacaagttacttccccaaacttttccagcacattaccacttcctgtcatactaatgaacaactaacagttcgcaaacttttctattgctgaagtctacagaatgcacatcttacttactccttatgatgtgatttacagtgtacatacacacatcctactcatgttgatttacattagtttcacagaaacaaacagctaaacaattcgtgctcccacgatcatacaatagcaagtgtgacctgtgtaaagcttgcaggacatctaccagatgaatttactgaataaaaaaaaaaggcatcaactaattgcggcgcacgcaccttgccaggcagtagtgacgatttccacaagtatgggcagccctaactcctcgtggcagagctcctcgagcctcccgcggccgccttcgccggagcagcaggtgtcgatcaccatgcacagtgggtcgaggactcccttctccctgacccgcgcgagctccagcagcgagccagggaagagcgcatcccagacggcggcgcggtggtgctccccggcgagcgcggcgttgcccagcgcctggaggcccgcgcgcgcgacgtcgggggagtcggagggggaggagagggcggaggagacgaccgcggcggggccggagaggaggacgaaggtgccctggttgaggtcgtcgccggcgaggaggttgcggaggaggcggaggcggaggagcaggaggcggtgggtggaggccggcaggaggtggagggtgtcggcgagggcgtcggagagcgcggcccggccctgggcgcttcgggaagcttctagaagcgcctctagagtttcctcgtcctcgatctcctcggcttcccacattttctcctctgcgccgttgcggtttcgccggcggcggagagagaaggagacagctgttgctggaatggttatggaatggggataccgtgcaggcgtgcagcggcggcctcgggccacggcggcgtatcatatccccttttcatcaacgcagtcatgatcctgaccgttcgatcaagcaatcgacggcacagatcagcatattagggctgagacttgccggccattttggctatttctgtcagtagtactcgatggttaaatattctaggctgttcagcaatagtaattttcttaaggaatttcttaccattctctcgatggttaaatttcgaattataaattgtttagatttctcttcagaatggttcaggtcgagtgtccgatctagccaaaaaataaacgggcgcactagctacttcctccgcatattcttcgttctcatatgcatgttgctagtatttctctcccaccccttttctcttcttccgtgtaaattaaccatattccattgttaagctttaaattattttcttctcttaaattattaatccggtttacaattcgagtacatcgttgtattctttttttttcgcgaacgcgcaaaaaaattgcacatcaatatattagaagaaaagagtgtttgtttacacaacgcaaccagcccagaccagcttatgccaagggaagagagaaaagaccaaaaaaaacaaggaaaaaagggagagactaatacgacggcaggtttgtaacgtggaatacactgttttattcgttacaattaaatcttcataacaagatgtcatgtgattatattcgaatgaaaggaaatcatgtgtttcaaccgttaaattttaatgttgcatgatagcaaaaccgttgtaaatctttataacaagatgttatgtgattgcattccggtgaaagaaaaacatgtgttttaattgttaaaatttaatgttgcacgcgtgatagcgaaatgtttcaacatgtatttcactgtgtttcacattattcttaaacatttcaaatgggattatgtttttttcaccatgtacaaattaatgtttttttgttggtggtcaactgaaatatttgacataaaatagatagctcgatttcaaaatcaatgcatcagaaatgcttatatcgtcgcaccaattttttttagttctaatattttgtaaagggatctgtaggcgatatactggaaacatagagcttagaatcaacatgacatgatccggtgtgttctttttctcctgaagatgaagattaagttttttacacaaaacgatgtgatattaacgtatgattgattgagttttaattattacaaacttgaaaaatagattaatatgatattttagaacaactttcatataaaaagttttcgcataaaacgcactgtttagcagtttgaaaagcgtgccacgaaaatcttaatcttcatcctactcttgtgggagagaaaagaacgggacggcagattattaagaattcttacagctcgctaccgtgtgttccactgaagaacattaacgaagtggagataccatttcaccaagtaagccttactagcgaatagcgaaccaactaatccaacagctctaacctagcaccctttacaagctttcatcagaaaacttggtacacccacgccctgaaccctctatgccgttggcttattgcagcttcaggttgaatgaaccacacatcacaacacaattttttcaatggccattggacacttcggtgacggcttgacctttgacggcgtagaacctcctgtacatggagtcgacgtgggtgaggtagtaggtgcctggagcgagcaggctcgtgtcctggctcgtcgtgaaatccttggcgccgtaccggtgctccatcagcttcagcgccgccacgaacttctccggcgcaacctgcggcccaaagcatttgttgatcaggaattcaggttcatccgttcatgtcaagctactagtttcaggttttcagtcaacaagatgaagcagtggtcagcagctgcacttaccacatgcctggactccagtttcttggagacatccagtatgcctgcaatgtttgataggatgaatggatgctggccttcattgatcttgaaagagaacattgttgatgtcaagccactgccgtatgagaacatgacaatcctttggcctgcctggacatgtcaaaaggggagggtgagaagtggtaatcttatcacatgaaaatataatgaagacaaggctaagtgttcttttccttttttaccagagtttcatttttgttatgcatcactgatgccaaagcagcatatagagacgctgtgtacatattcccgacttgtttcgggattaatgtaattggttgaacctttgaatcatagaggtgcttcgcaacttgctgagaagcctgcatattgaaagttagtatcagaaccacgcagcttattaaaagtccagaaccagatggtatgaccaagcagaaatattcgcaccttttcaagttctctactctggtagctttcctcggatgacaaacctgaataaggctccagtttttctcttgatccatcttccaccgtgctaattaacaggcataaaaaatcgttatagttagttctagttaactactaaaaactgaacaatattactccagtcaactgtcttcctatatcctaatatgctaagcatgaccgaccaacctgcattttctcagaaaatcgttgtagtataggcgtgcaaagctcttctgcacaagctgcagaaaacaatgaaaaaggaaaaaaataagttctgaaaattacatcaacatatcaaaagggcaaggtaagttatgcgagcatgcgactcctaaccaagatcgaagtgcagactggtaagatcagcatatccatgtcatgtgacagtatgcaatcaagaatcagtctaaatatgcatatattctactcactactcatgtcgggaacctcgagttctatttatttgaaaagttttttaaataagatgccctatttctttcagtgaataagatgccttaaataagtgtgaatatcaagtgtctgcacaattgtggctgtaatccactataccaccaagatgctactaaggtacatgatatgagatttttatggtaccttgttgtatggggagtgaaatacaaaatagtctgcatcatgaatagaaaattgctttccctcaagcttttcatacctgaaagatgaaaaccagtgggttctgattcaatcaacaggctcagcttgactaatgtgttaaagcaatatggaatacagcttactttttgcagaagacattgtagcaggaatctaatgccatgagatagcatgtctgtgatagctttccatcgaccacctgaacaaattgcagatgccataaataaatcaattccagtttatttcaagctagttctctatgtgctaatccgaacttgggtttgaggtgtaagaattgtgtgggccagaggcagaccgggtattcactagcaagatcaggcttgtaaaagtcatagacatgtgccatatgagatcctctatacttgctttcgaaagaaactggagcatttggtccaatcaacattgcaatagcagctgcaccaccggttggacgagccggaccttcagcgtaaacctaaagagacaaatgtcagctatagaattaatattggatgcaaaatgtaagcatgagaaccatagtagcaaacctatattatgcttgccttcagtacttaaggaaaaacacttgtggatttgtggtggtggtcaataacagaaactaagaaaaaaaatgagaaaaacaaggacgtgatatatatgaatacatgtactcatatagccatcatcagtaacccaggaaaagaaatggagttgtacactggtaatctgtacagtacgaaattgagtacatgaaaggaaaagtattcccaattaacactggagttgtacataccgcgctgtctgtgcaaacaacaagcccataacgtccatcccatgagttgctctcgacccaattaacacaattaaataaagcagctgttccaccgtagcatgcatttgaggagtcaactccttcaatgtcagtattaccgcattcctgcatttaaacaaagttgtcataagccttatgaaagcacataaaccataatatgtactcctatgttctgctgaaaggtccaaacctcaaatatttgcatcagccatgtttttatagacttgctcttgtctattactgtttcactgccaacttccaaacgtccaatacattttggatcaatcttatagttttccaggagtgacttcactactgtcaagctgcgttaaactctcgatcaattaaatgcataaaaaagggataaatgaataatggagattaatgtctttattcctgaaattaaaatttcaacataaaatccttggctaaggatctagcatagtttatcactgtttgactttatagggcacggataggacacttgagggtcacatttgtcttcagaatcacaaatactatgttgcacatgttctctgaaaatgcataggaataggatttgagcctggtaggacacacaactctaccacaccaatggtgcttttctacataggaacaggcatacctcatggaaataacatcttccacttcagtgcaaaaggccatgctatcctgtccaagcccaatggtgtacttccctttgctcacgccatcatgattctccagctcgtcctgtagcaaacatcacatgcatttgcagtctaatactaggtgaaacacgaaataaagattattaatatcgacatgatgtacagcattgagatattgccaacacacaaccactctgtacaagttatatcactgacagaactactaccataaagaaaaggtcccgacatatcccggtcgtcggcagaagaacataaaccattttatcagcacccaattcaatgtacacatgtgcatagtaagccgccatgtcttggaagccatcaccatctagttctagtgatttgatcgattgtcaacacaatcttaaacgagtcaaggccctactgattctgtgccaagctgtttcaattggcatcttccacagcaaattctcccgcggaacagcattttaattaatttctctcaactcaagcagaagcaggtgcaaacattccacacgtaagcggtcagcaattaatcacgcctccctgaaaacggcagctttaatctcccctgtactatactcctaaatggtaacgtaagctacaacgagtagcacgattagtactcactacagcaatcatatatttgctgacttaattttaaagttgattttgatatatatttttttccatcgcggtttatatttgatattttagcattggcttttaaaccactgagaccaaagttataaaagttttactggtaaattattttttagttgcttctttctttttttttttcacggatagtccagccatggagtaaacttggaatcgcaactctgaactcttctttgctctctgctccagttcaccgaatgcgcggaggtggcccaggcgcacgtggctggttctccccgctgcgatgctggcgaagaagggggtggaaagctggaaaatcttcaccggaaaccggtagtaaagtaaacctctcaccaaccgtgattccaccacagttacgcagagaaagtcacgcaaagggtgtgtgtgtttttttactcgatctcccgaacaaacgagaaaacggaaagggttatccaaaggcaaaagatctgactagattgcgattgcactctgtttgagtgataagaggtgtgtggttttaactcgagataatgtgttcaattctcaatacgctcatgttttcttctaaaaatatttgaaggattcctcttcctccaaatcttgttttgattgcactcgtgtttgcaagttatgaaaagttgaaaacatgggactaaatttgtaaaagaaaaacacggattgtagtgggagaaatatgatacgatcgacgaggttgatcagtagggaagaatcgggagatgagatcgattggtggctgacctggagcacgcaggtgggcgggaagtagatgtccatggcgagaatgcccacgtccttcctctccgccgccatctccctcaccgccgccgccgccgccgccgccgaaacaacaagattgggaggaaggcgtaggcgagagaaagaattggagtagtacgagtacctacaggagcggatcgagcgaggaggaggtggatgtgatgcgggttctcctctcgcaccggtcggttttatatacgcctcctactgtgcatgccgcctcctccttcagtccgtttatttatcacggtgtgttttttttttgtgtgtggttattcttttcttaactttagtgtctatagtcaatctaatagccaattcataccatagttatttactgtactattaatatatagtcccacctgtcatacacacattacgttttggagttcatgctgcagctggctacagatatgtattctgctgcgcttttctcttatcttttatctcattaaaattaaaatatatttgtagctgactaatagtctacctgttcttatttggtaattactgaggtgacagctgacatccctcggtggtatcgccttcgattcgctggttgccctcggatcctaacacgtggacagaatctggatctatggcgccatcttcccctgcgtcgaccggccggagctggatgatgagtctgggactccatgctgccatgcaagcaagcaccctgcagatgaacagactgatggcgtcacggtaaagacccttgagtggtagtagtacaagtattctgtctcatgattctatactggaatcggatcccccgtcttgcagctatgggtctgtttggtactaaatttagctttagaagttgggttaggagtgaagttgtgtagctgctaaacccagctccataactctagtttattttgtgaaagccccatcggttggctttttttctaataaaccaaaacggtttattagggaataaaaataaatttatagataaaacttttatatatgtgttctttgtaacttaaaagccaatgttgaaaaaaaactatgttgaaaatatctcgaaatcaatctcaaaattaagtttgaaaattcaaaatttggcttattctttggcttattgggccatccgatgggagctgagctccacctacagaaggggtggagctggagctgaagctgtgctaaacaggccctaagattcagttgcgtcgtagctagtgtgtatttagttcacgctaaaattacaagtttggttgaaatttgaacgatgtgacggaaaagttagaagtttgtgtgtgtagaaaagttttgatgtgatggaaaagttagaagtttgaataaaaattttagaactaaactcggcctagtagtaaaattttagactttgaagtttatttaatcacgtttagtttttaatattagtctttagattacgaaacaccaacataaaaagtttcttatcagccgtgggccaaacgattaaattgatttcgattagaaaggcggaattggaatcgacgatttcacgatttcgtggagtctcgctacgacaacggcacactatgctctgctctcaagtctcaaatgttcgccttccctcacgggtggtgtagattgtagcatcttcattcatgcggggttccacacgctcacagtacttcctttcctcctccttctcagcaacagttctagtactccctccgtcccaaaataagtgcagttttagcactattcatgttcaacgtttgaccgttcgtcttatttgaaaaaagattatgattagtatttttattgttattagatgataaaatatgaatagtactttatgtgtaactaatttttttaatatttttcatagatttttcaaataagacggatggtcaaagcgctaaatacggatatttatggctgcacttattttgggacggaggtagtactaatttcaaactgcatatcacgacccatacgattgaccacaatcaatgacgacaaacaaggggagatgcatagtactagtagtactattttcttcgcggtctgtagcagcatttttcacaaggagtgttaaggatcggggtgggtaggtgccaggtagtaggtggtgctcgtctgcttgtgctaaagctacgaggaggaaactgcaggctgaggcgcagggccatgggatgggagaggagatcgatacaatggagttggttggcagttgccacactgagtgggtcgagtatatacgtgtatgccgacgtgaacgcgcgccggaactcaattcagttcttgttgggagcttgagattgggaatcgggatcgattgatcattgatccatccacaccacgacgaatcatgggagattgaaagctttgtctgatcttatgtatagcagttgtatagggcctgtttggtttggttctaatttattaccctaccaaaattttggtaacttaaatagtagcaagtatatatttggtttgctaccaaattctacccacaatagtttaagttgaatactacttaatttggtagtgccaaaatttaccaatgttttggcactaccaagattttggttggataaaaattggctccaaaccaaacaagcccataatttactcgcctacatttgtgattattcggtgccgactcgccgtcggagaagttcaaggagcttatcaaagcttccttgtgttttctacactcgttgcatttccagtgaattgtagtttgaattatcgctatagtttcacttttgatcactttttatttaatatatttactttggactaatcagcttttgttttgttctactttaaactaacccagccctattcttttagccatatctaatctctactctgacaaaggtatggcatattggcatttggcagcgtagggaagttcgccaatgtgtttgagctttgctgatgtgccgaagaagtagcttgggtagtccaaattacgatctatactttactataaaatacaatagtggtggtggccactagctcaccaccactaattttgcttatcctataaattagttcatgacattttttatatcatataatagtctaatgtttatttaaattaagtgaataacatatatttaaataagcacgtacattttatccatggtaaagtaatgagcattttattagtaagatgaaaatatatattccaaagtgaaaatactggataatagtgatatatacgccttgtttagttcgtgaaaagaaaattttgggtgtcacatcgaatgtttaactggatgtcgacaggggttttttcggacacgaataaaaaaaactaatttcataactcgcctggaaaccgcgagacgaatcttttgagcctaattaagccgtcattagcacatgtgggttactatagcacttatggctaatcatggactaattaggctcaaaagattcgtctcgcgattttcatgcaaattgtgcaattagtttttgtttttatctatatttaatgctgcatgtatacatccaaagtttcgatgtaatgtttttggaaaaaaagattttgggacctaaacaaggcctagtgaaactttggtaaaaaaaaaaggtccaaagtgctctttcatttcattttgtgcagattaggtgatttctaaggcccatgggccgttgctgctgtcgcataaatgaatgggcccacctgggcaagtgtacctctgaagcttatagatgtacagttcaatacatggattcctacctgaaaatattcgatttcgctagaaatctgtcgggtgatttgtttccagcgatttcacggatatttcggccacacgatgtgtgcaccaagccaacaagatttgtgcacatgttgataaggtcgtggttcgatgctccgacccctttttttttttcacggtacggattttctatttgcacgcctgcctgtttctttcttctctctctcgcaaactccgcccggaatcactcttcatttctcgtacgttctcctctctaactaaaattacggtcctatttaactaaaattagatatgtaaatttagttgacataacatgtaagtgcactgtaattttaataaaaatgatgtgtaagtaaatatgtactccctccatattttaatgtatgacgccgttgactttttaaccaacgtttgatcactcgtcttattcaaaaattttatgcaaatataaaaatacttatgtcatgcttaaagaacatttaatgataaatcaagtcataataaaataaattataactacataaatttttttgaataagacgaaaggtcaaacgtttgtcaaaaagtcaacggcatcgcacattaaaatacgaaaggagtatttgttattttaattaaaatataaaattacagtcctatataactaaaattacatttgtaaattccgtcgatatgacatgtaagtgcactgtaattttgataaaaaatattgtgtaagtaaatatgtatttgttattttctttaaaatataaaattacagtcctatatagctaaaattacatttataaattcagttgatatgatatgtaagtacactgtaattttgataaaaataccgtgtaagtaaatatatatttgttattttcttttttagctcgttggatgtaaatctaagggtagaaaaaatttgggtgatttttttgctagaaattacccgacaaatggataggcaatcccgaaaatatttgacgcagagttgcaaacacatatccaccaaaatactaattgaatgttggatgtgtggtcatgtctaaataacgctatcaaacaatgcagaaaacatgcaagctagactgcaagtacatatggatcacaggatcagatcctagtccacaatcagactattatcaatctctatcaaagaagaaagaaatatctgggtctctcaaagctaccaactacacgaagaaattatcgtacgccaccgtgaataagatcaagcagaagtgatcagaagagctaactaatgtgtctcgtcgttcctcgtccacctctccttctgaatcttcagccccatatacctgtgtgcgcaatgcatgttcgactgaatttcatccaagcaagcgccaaaccaaacaaaatttagctgaaaatgaaggcatgcacttgggttaaattacctgccgagcatcatgacggtggcctgcgggttggtgccgggcgagtacttgaaggttgagctgtcgacgacgcggaggccacgtacgccgagcacccggtagtcctggtccacgacggcgccgacatggcagccgccgtggtagtgccagatggtcatcaccgtctccctgcaatactgctgcagcggccgcgtgtcggtggcgcggcgaggcagcaggttgacggggaggtggccggcgcggcggccaagcacggcggcctccatggcggtgacgttggcgtaggtgaaccgcgcgaaggcccgcgaccgcaccacccgctcgatcgtctcgatgccgcgcacgcaccgctccacgtcgcgcgggtcccggaagtagttgaacgtcacggccgggttcgcgtcggggtcggctgatcggagcgcgacgtgccccgtcgacatgggccccaggatcttctccaggatgaacccgccgcggaacgcgcgcctgtccagccgccgcatcgcctccgccgcccgccgcatcgcctccggcgtccgctccttcggcggcaccgtccccagctgccccgtctgcctcgtaatgaaacatccattaattagtttgcacgctgcatgcagctagctagcctaacgtaccatgggggagaacatgccgaagctgcgggcgcggcgggaggcggcgcggccgtggagcgggatgccgaactgcgagccgctgacgccctcgatgaaggtgccgaagcgggagacgccgacgatctggacgagggagagcgcgacgggcaccggggaggggacgaacaccgagttcatggggttgtccgccacgccctgcccgaccctgggctggtccagcacggggaggatgccgtgcttctccagctccccgcgcggcccgacgccgctcagcatcagcagctgcgggctccccagcgtccccgccgtcacgatcacctcgctcttggcgccgccacgcaggtacacgtggtgccgcacgcccgccgggtccgtgaacaccaccccgtacgccaccggcgtcgccgtgccctctgcaaacacttgtcgtgtcagttttagagctaaaaaatggttgcgcaaaccatgcaagttgacgattacgtgccggtgcgtcggaagaggatctgcgacacggtggcgcggaggaacacggtgagccgcctcgggtgggctcgccggaggaagtcggcggcggtgtggcggcggccggcgcggtcgaagatggtgccgccgatcttggtgccctggacgtgttcgagcgtgtagccgttgtccggcgtgacgccggcctggaggaggccctcgcgcagcgcgcactgccaccgcggcacgtcggggcggaacaccagctcgcgctccacccaccggtacgacgcgttgacgaggcgggggtcccagccggcggcgcgcacgtagccgctgctggcgcgggtgtagaagccggcgttgaggcagctgccgccgccgagcacgcgcgcccgggcgttcacgacgccgtcctcggagacgaaccgctgggccggggacctcggcgacgtgtcggccagcgcgtcggcgaagtggtactcgctggacacgttgcggttgccgtaggggaggccgccgcgctccaggaggagcacgcgcgaccgctccgacagcgtcgccgccagcgggcacccggccgtgccgccgccgacgacgatgtagttgtaatatgacaccagcggcgcgtcccgcgcgtgcctcgcgaaccgaaaattgtaccctttttgcgctgccacgacacacgcacgaccacattgtcaaagttctataaaaaaaacacaacacatgagcaacacgtacgtgatttctcatgtaccttcgggtgaagcggtgaggctaaggcagagggagccaagcacagtggctactagtaggagtaacaccactggtggcactgagccgtgcctatgaccaggcgccattttggcagagtaatcttgagatttgaagataaaggaggaggtgtggagttaatttatacatgacgagttgcgattcgattagatgaggagtagataccaattagggtgcagcagatgtcaaagatggacaccgaggaatacgggcaatggtggtcgaaatatttgagatcagcgtcgatcagagcctttgcatgcgttcccatcaagcaacgagttcaccaacgtggagactatttttctgcgtactctgcagagtacttactagttcctggactgggccaaatcactcaattattgggcccaaatctactattcctcgaaggctcgaaaggccgcagccatggcgtcgagctcaacgtcggcagcggccagcaaaaccctccgtggactgcttcccggaggagtccgacctccaccgccgctaacttcccttcgtgcttgccgtcgcccgtcggcgtctagtagcagcaggaatcagcgccgccttttcgctccgaccactccggcgtcctccgtgagtccaccgcgacggcaagcggctccccgcgcggtacctcgtcctactcccgcatctccgccgcgccgccgccttctgcactgcaatccagccgccgcgccgctgcctaccggctacctccacgccagatcggtcgccacaatcagaccgatggtttagaccgaaccatcggtctttggttttctatcttaaagaatttcggtttcttggcggtcgcgattgcttcgtgaagaactgaagagtgaagacggtgaccccggttgatcagtcatcacattttggctacggtaagcaactctcctgtacagactagagactgcgtcaccttgttgatgattgcctttgtgcatatgtgatatacgggtaacatctagtttttttttttaacaatgtagagtttagtaacatctatctctccaccaaaaatcatgtttaaattcgacctatacattgaggggaaaaagaacaatagtaccactattattcatacgctgaatttgtcttcttttttatatgtcttaatgcgcgagttgagtttagacctaagatttcgtggagtggtatatgtatgctgtatgaatggcgcaaattggtttaaaggttactcataactattttgatgggttttacaaacaaggggacatcacttcatctcaagggatcaaaacagttccctatcaacgcaccatgcattgttataaacattttgcgtcagcatcacccaggaccaaacatagttccttacagctagagttcccttatgttctgtgatggaactcatatgcttgaggccttgagtcaattcaaccactcatttattaattggctcaattttggtgacaatggttatcaccatggttgctttcccgaatattgctgacatgtgtttggtttccaccttgaacttgcagcaagattgtgtatcttgggtaacatctgcataaaaaaattcagtcatgtttggtggagccattcttcgcatctttcttgtcccatagtcttgtaatacctgctggctttcttactgttttgcattatccttaccatgaatatccatagcttgtatttctcttgatatgtgggatgaaaattcctaccagcattctaataaaatcctacaagaacttctccagaccataaatcaagttctgcaaaagatagaatttttcttcagtgaaaatgcattatatcatctgcacaacagaaagtttggcgccagttaccttcaagcgtatcaccttccgtattgccagaattaatcctggcattaggcattgaacatttgtcacatcatgtcttaaggtgtaaatctggatatgttggtgattggtcaattcaatagttaaaaataggtggtcaattcagcgacatttcaagcaaaaatattattaatacctctccagggcccgagaaatggatcgatgtactggaagcaaggcctggtagaaccatactgtggacacgcaccccatcttctccaagtatctgaccccttgccttttccaaaacatttgtccattagttttgtgaaacaatattgtgcagctgtaagctgttatagaggtgaaaactgattccagtttgtactttcactgttttagaatgaactgaacagattgcaatgcccgtttctgtatcattagataaatagcaatgcaaaatatttttctcacacttactggattatcggagtccatatcttccctgttgtatatctgaccaagatctgttatattatttgcaatctgtattgcatcttgcgatggcaaatcctgtcaatttcaaacattagtctatcagcctttgcacacctgagcacttgtctagtatgtaactaagtattgacaagagttcttctaatgctgatagatgatgttgtgccttttcctttggcatttgattgattgttagaatatacaatgtttattgcacatgatgttctgtatctggtggttttagaaggcatatttatatggtgaattaagagttacatggaaaagcctattaccgatgggttaggtcttgattccactatctcgacgttgttgtagtggaacgaggcctggatagcagcttgctgtaggagcactgagccaattgataatgttggtgtgaccaagcaaccctgataatgaaatcagcacaagatatatgataaatgcaaccctgataataaccaatgttgttaaagcggtacatatatgataaatgcaataatgatatgtagtgttaccatgcttgccttctcgcagaatgctgacagctcagttactgtatctaactcaatttttggaacgtacaccacactgtttaaaccaaatgccgctgcctgtttatgaaccatgtacagaattagatttcagaggattgtacagaatctgaatggcattatacttctttatcagtgttgggcagtgtgcttattgaattagagtgcactcctgtggtcctggtcactggtactggatagctcattctatgtgaactgttacatttttctgttatttggttatgaagcaaataattctttggctcatataaaacaaataattctttggctcatatatactcatgaatcgataataatgtaactttctagattaataaggttatactttggacaagattcagttatattgccatgatgcttcccgttgaatggatcacattggtgcgtactttgtatagtccggtatttcacaatctcactttacaatgtaacttacttttttccccatcttgtaggtggattgcttacctgtttgacattatcataaacagttgaaggttcactaaaatcaaccaccactccagttgctctggtctgaaagaacataagtttcaaatagcaaacccgtgaagtgtataacagtacaactgtacaagtggatataagcattttatagtacaatgaagaggccaatacttgtgcaattgagcccagaaccattgtgagatcattgagcaccggaatttccagggcttcttccatgccacttatctagaagaacaatgccggcatttataaactgtaagagacaaagaacaagcagctattgcagcagggagacagcctaattacaagggaaatggcgcattgagtgaatggtgaatacctctcctgcatctaggcctatacactgagaatctatggcccctgcaagctccattccccttgctttacttactgccgctattgccgttcttccaatctcttttgtcgccccaatgataacaaccttttcaatataccaccagattttgccttcagaggaagttgcagtgctattagagaagaacattcataatgtcataacccacagtaccttgattgtgctctgagatggcggcatctgcgttgagcagaggacctttgctgcatttctcctgccaatctttccgaatgttctggtatgagcagagtggcataaagtagccatgattttgttctgaagactgagcttacatgaaagggaggttcaggtagttatgttctctctatttctgttcgcctgaccttgagctatcttatcctgttatgaacgcagctagcgtgtggcttgaaatcgccttggttgcacgcgtaccggccaggttaccataccgtttggctgtttgttagtttagagggattgattggaatatctccacgctacaatagatgtggaattaattcgttctaaatcccccttaattctcttgttagagagattaacggaatcacagtagggattgtctgccgtactgctgatgcagtagcagacgctaatgtgggggtccgggtccacatgtcagccactgctattgcagcagcagtactgtagaggatgtgcatccactgaatagggccttctgtcactagcttcccatggtatcatgaatacagcgcaaataaccccgtgaaattagcgttcaaaaaattggaattcaatatttttaagccggcggtggtttcactgttttggaacgtttaccttatggtccagagcagtttggtttattttttttttaaaaaaaaaaaagcagtacgtagaaaatttagggcgaaaattataagaatatatataggagacatttagaacatgtagaactgacctattgatgtaatataggaaaattcggcatgacctttgctatgttttttttgcattcaacaattgaattaagaatcccatttattcttttgtcattttaagtcattaccagtttggctatgttaactttctcttttgtacaaaagaattcttcaccaaatagtattacaatttaagtactacttacaggattatattctgaattttctcttcattttgaaaaattaaatccggatgaaatttgacaaaccgcaccgccggttactcctacgggcacgtttgggtcgaggacgcggggccctcgtctggcaagtggcaactgaaggggccgggtctccactgtcactggagcctctctccaacggtacaaagggagtagctggaatcttccttccattggtttcacctgtttagatacaggcaagagcctgcatacgacagcacgtgtactgctccggtacacccaacctcagatcagatcaactcaactgtagcacagcacatgtaaggacaagctaacgaaacggctaaggacgacgtacgtagccgttggtcttacgtgccaccaccccatccgctgcgtgtccctctctccgcggtcaccgccgccttgtcatgcgagaaacagatgccgaaggaaacaagagtttcctttggagtttggaccaaaacaacagaggaagctactcatagaattgcactaggatcgcgtgtatattcacatatcagaactgatgttccttgccagttacatttgcagagatacatcgatcgaatccagatcgcgcgttttgatgcatcgatccattccaggcctgcgcgatgctctcggacgaacacttgtgtgtttcatacacgttgaccagttcatccctcgagtggcgatggagtccatatcccgtgtcgatgtgatttgtggtaatctacctgggcttggacggcgtgatcttgatgacgaggccggggaagacgtcgtcggggtcgtggacgtgcgggttctgctccaggatgtacgggtcgccgcacttgtcgctgatgctgtgcagcgtctccccctccgccaccacgtagatctcctcgcacgcccgcgccgacagcgccgcgccgcgcaacaccgccgccacaccaccccgctgctcgccgccggcggcgccaccgggcccgagcgagcacaccagcagcagcgccaccagcgacagcgccaggcaccacgacgccgcgtccgccgccgccgccacccgcgacgtccacgaccacgaacccttgtgctgctgccgcctgctgctcgccatgactgtgctaagcttgcgttggcgtctcggcctcttgcttgttcactagagttcgctctgctttgacgagtgcgagttgttgccttgttgccgctgcgctgggtggagggtttatatagcgggaatgagttggggttggatggtggggatgcgggtgtctgacaaggcgattagctttgttcaagtatccgttggaagataagctccacgcgagagagtgcgggaccaagagggatggacgagatacccgccctctattgccgtgcagagatggcaagcattttctgtgaaataattagcagaaatcttggatagcctaaacaattagtggctgaatcaattttgtagtgtatgatagtacaaattcagaacatgatgattcaaaattcggtatgaatttcctaggaaagatactgtaactgaaaaagatttaccctctagctaactgaatttgcaaatacaattgtaatcttcaataaatgattttatttactcacattgcaaacgtgcagcctcgaaacgaagttttcatagggttcgttgagaacttgtgacgagctgagagcctgaaatggtggccggctaggcgcctacaattgcgcagtgcagcagtggacccaatgacggtccaagtggcgtttccctgtccatgacaagcccctttcggtgcccccgcggctgctgctggctcactccactcacccaccccagtagccgactcgctactcctgccctttcagagtgcaccactttaaccgacgtgaaacgacttccatcactaggcggcgacgacgactccttcccatgctgccatcaggcatggtatggtatgcagctggaaacctcaagttgtggttcgattcgagtatggcatggcgtggcgtggcgtgaccgcataataatctcattagctgccgtctaatttatggccacatcactcacacatcaagcatggaatagaggggccaaccagtgcaaaatttgttattctcattctcgtggaatccttcgcatctgctacagattttgctccgcacgtttcggcttttggaagctctttatttttcttttccgtttggtagtggaatcctttgtcagtgcatgttcatgatcagtcgttgtggcactctggtctgatgatgtcgaacgcatgcaacaagacgagaaaggatcttgctgagcaccaatgatgcgtgtcccccagttgaccccagtcccagtggaacaccagaaaggtgtgtgtaacagcaacgaagggctatttggatctgaataggttcaatggaaactgaaaggcagcattggaagatatttactctgaacaaatagagaccaagacggtgatctatttagcgttcctgaatacatatcaaacacacaagatttgaaatatccagctgaatgacaaaaatgcccaaacgaagggcacagcgttcacagaaggaatgaaatgaggagcccagcccatacatatgccaatccaatgtaaagccatagcagggtcattgtaccatctcaaggtccttgaagtattcatgctcaagagcctgtctagctgtgatccttttgtttggctcgtaccgaagcattttctgacagtgaaacgagacaaggatgggatactttttttttggggtatattatgacatgctaatgaacaaaggtgagtggtgttcgacttacagagagaaggtccaaaccagcagggtcaagagtagggacaatagttgcaagatcctgggatgaagatttcagtcaaggaatattagtggcacagtatatggatgcagttcacccgcctaataaaatctttatgctgttttgtcatacctgtgcttgccacttggggaaagcagacttgtagtcaggtaatgagctaactcctggccaactttgttcatttggagttcctagtacccttcaaaagtaaccagaacacaacacataaatcatagagttggcaaaaacacaattaacagaacaaaaaaaggtaatctcagtacaataatagaacctgaatatcttaaataattcatcaatctcagaatcaccagggaacagtggtttctggttcaccatttctgcaaagatacaaccaactgaccacatatcaactggtgtagaatactgccttgatccaagaaggatctctggagctctataccacaaggttacaacctgaaaaatacttcccatagacatccattgtgagttaatgtgctagtgtatagaaaaggtaaatgaaaaatgaactttatgacgaaaaaaaatgtactttatgaagaaaacaaaatgttgaacacaaatctatagtacctcgtgagtaaacgtgcggacaggaattccaaatgccctggctaaaccaaagtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43001 - DNA, 4073 bp, Oryza sativa
tgaattgtagaaatacaattattatggtagaaagagataagtgagcctacgagtctacgactaccaattccatcggacttatcaaatactcggtttaaaaagaattatgtgcatatatttgcctcaaaaagtagcataatagcaaaatttactagatttcataaacttattattgaaaaatataatagtatgttttatataatgtcacaactatattaaaaaaatatgtgaaattaaatgggaaatggttatgattggttgagacgagagaataagtgaagaaattgaacatgcgatgattgcgattgcttgaaaggatgaagtagatgtaaaaattgatatataaaaattggcgaccctaaattcaaaagtttactgaaggagtaataattacgaatttaaatatacaagttattgacttttggtcatgatgttactattcatctttttttaaaaaaatgagtacaagttatttattttgttgtggtttgttttatagttaaaggtacttcatgcctgaactattttttcccatattaatgaaaaacattatatccaaaatttaagtcacttggcaaccatcaggccatggcgccaagcacgccatcctatatcctaccacctccattttggtttcaagaaaaccaccttcattttgaaacataaatatttcttgactattactttttgatcttaaaatgaacaaatatattactgtttacgacagactaaacctattcggttgtatagcaaaagaattttcataggtgtattttgggatgaaggtatagctagctgtgagcaactgactgaacatttatcaaatggaattgtacataagttgaaaaaaaaaaagaatggtagagccacatttctcctgcacgactgcctggcccatgccctctctgctataatctgcaccctgtcttccatttcctcatcaaaaaaacacaacaaaacagaacagaagcagaccaggtagcagacaaagccaagagtttctcacactcctcccatcgcttctcttctcttctcttctctcctctcctgtctgctcagtttggtgggttctgctcaccagtctccccccgcagtacaaaacctccattcctcgccgcctcctcttccactcggaaacgggtagtagaaaagaacacaccgcggtcacacacactctcttcagcaacaaacgatgaggaccatcatggcgaggagccctcacgagtcatccttctccttctccaggaggcacttcaagtggccagttcttggcaagagcagcagccatggcgccagcaatgcaggggaggacgacttcatcaaggcagaggacgacgaggaggccaccatggccttctcctccacctgcccgtcgttccactccgaggacttcgtgtcccctccgccctgcaagccgctcaagcagcagcagcagcagcagccgcagcagcagcgcaggaagggacgcacggccgtgtcccgcctgcgcacggcgctggccgcggccctcgccggccggcaccgccaggtcgggctcggcgcccggctcaccggcacgctctacgggcaccgccgcggccacgtccacctcgcgttccaggtggacccgcgcgcgtgccccgcgctgctcctggagctggccgcgcccacggcgtcgctggtgcgcgagatggcctcgggcctcgtgcgcatcgcgctcgagtgcgagcgcgccaagggcggcggcgcctgcgcgttccccaccgccgccgcggccccctcctcctcctcctcctcctcctcctcctccagcgccggcggcaggaagctggtggaggagacggtgtggcgcgcgtactgcaacggcaggagctgcgggtacgcggtgcggcgcgagtgcggcgccgcggactggcgcgtgctgcgcgcgctggagcccgtgtccatgggcgcgggtgtcataccggcggcgtgcggcggcggggagggcgacgtcatgtacatgcgcgcgcggttcgagcgcgtcgttggctcccgcgactccgaggcgttctacatgatgaacccggactgcggcggcagcggcagcaacaacaatggcggcccggagctcagcgtctacctccttagagtttgatcactcgagcgtctcccattctcacgttttcttgtatcgtgtcagttcttgcatgctttgttgtttcctgttgtaggctagtagtactttagtaggtagtgtgacggtatgagtggttctggaataatatgcatatggaaactgggattgaaatggaattattttttctttcttttatgtttttttgggcactttgtttggtgcctaggagttattggactgaggtgttcgatcatgtgagtttagtgtcactgacgtatgggtctatagcaaagaggattcacatatcagtaactgaaagtcgtataatttaagtcgaacgagcttaatctaaagatatcactcctatatacagagaaagtatggtaagttctttagtaaacagtactcaagaaggtctaggacgtcattttctaatccagtgatgggtgatctcaattggtattgtactagcgaaagatgattaagatcttttaacttaagttatgtgattttgagttactaacatataagttatgtgattttgagttactaacatataggttctttttgctacaaacctagagtcagtgaacctagagtcaggtgacttagaggcagatggtccttctcctccaggctccagtgaaagaagggagatccagatatcaggaaggagcagggatgaccggtgaacagtgttgtattatccagaaagattatgtgatagtaatgattattatcgaactgcatcaattgtctttgttctcatgcatttgtctctgccataatgtgggaccgacagaatgccggactgccggagtacatctgttttccgaagttgtttttctaatcactttatttatttattatgtaaatcactttatttattcgtaagcttaattttcctgtattttactgtcaaaattgggggtataaatatgaaacccgtggagtgttaaaacaagatagagcaaggaaagactagattcataaagaaacacttagctatatgttccattttaaatgagtgcaccaaacagctcaattacacccagtcaatgaaaaattatgtttatgaatctgaatatgggtctgtctatataggtatatacctagtaaatattgagagctactatacatacgatatgtcacatacgaagctagtacgatgttgtccagctgtttcctagcgatgcaacaagtaaggttcaccatccgttagtaatcgtacgagaatcgtacataacaatcgtaatcgtacgagaatcgtgcataacaatcgtatgcacagctagcattttcacaacttaagtttgtttaatttgtgttttgttgagttgtgatcagtgaccgcttgagattgcggcgcaggtagctagccaatggccgcgaatgcccaatgctaatgtacaagttaatgaatagaacttttataataaaatcatagtacatattattttttttctattttgttgatttttaacatgacatttaataattcatgttattacaaatttagtgcaaatatgaaggaatataggtcatgttcaaaatatctttaataattaataaaaacacatcacaataaaacaaatggttattagtatttattgtatttttaaataatatgagtggttaagtgtcatgtgtaaaagttaacaatgttatatatttaaaaatatattgtaatcatctaagtttggtatcttctttattttgtgatagtagctagtcaaattggtccacattgtttagtggtatgttttgatcataatactcagggttaagaggaagcaccggtaacgatggactcatgcagtcatgcttacactggtggagaaatgctttttagtcccggttcgtaacccccctgtagtcccggtttttcaaccgggactacgaatccgggactaaagatcgctatctttagtcccggttcaaataaccgggactaaaaatcaatctttagtcccgg

SEQ ID NO: 43002 - DNA, 6375 bp, Oryza sativa
taaagatcttcctcttattaaccgggactaaaaatcatttttagtcccggtttttaatggaaccgggactattgtggatatggatcgaccgaccaaagatggtttctctaccagtgttacatgactccatatacttaggatatatatttgaaatatattaataccgaaaatttgacacccaaaaaaaaaactagtataatacacccccaactatcgatgttggacacttaaccatctttgagttgttttgctatggttttttacacgtgggatgccacgttagcccttcgcaacattgaatgaaatataataatacattaatagtttaatacagcgtgtaggcctgccttctctctcacaccgtcacatgcattctctctctctctctccctgtttatggttctgtaaagtggacaaggagatgacacacggcaatgacggtagggttctcgccgccggcataggtggtgcctgagaccggcgcagctgaaaggaggcctccctgttctaccaacttacctaagctcttacgcatgttaggtatttccatgttgattattcacactatgaaatccatcttgccacctttctaccacactcgcatataacagctagagaataatcaaatgtcccctctctgtatcgaattggaggtggcttgcttctaccttgtctggagaactacgatgcagatcgtaaagtccttcccgtgctgccatttccaaagctggtcatgtccctcgatctacttgttccgtcgttcacggattccacctacttgcccttgtttcctccctgtgtggagattcttgttatgtgctcagccctctctattagcgaccgcatacagctgcttcggtggcgaccgtgcgcaacgtcttggatctgctccttccccatgacacctcctccgccgactaccgccacaacctgttggagatgctccttccccgccgccgtgcaccgtttccagtaggcctcctgctatcccctacgttcatagcgctgatgccttcgaagctccacgccgccgttatcgctgcttgtgaaaaagctaggtcaaaacgaaccaaccaagcaatatgggcttggcctatattttcctatgcgctaacgtgatgaagggtgacgcagcatcccacgtgtacaaaaaccacggtaaaacaactcgagtagaaataagtattcaacattgaaagttgagaggtgtattatgcctgggtttgtagttggggagtgtatttttgacaaatataagaatttaggggtgcaaaatgtactttgctcacattctataactacaaaatctatgggttgttcagatcgatgtcatctcaaaccataccatcctttggtaaagttaccaaaattgtgcatccatttagttcctttttttgacaatttagtccttttagaaaacttattttgaaactaaccctcgccaaaaactttaacaaaaaataggccgtgggctcagcgctagtgcctttggcgttgaacccttgcccacatggatccacagatggcgtggggtcagcgccaatgcatttggcgttgactcccgtatacctgttaagtacgtgaagtatattttgatatcatgtagtgcagtggtgaagcccatcccttgacttggtgacctgggttcgaaccttgagcttgcacctttttttttcacttttctatgggtaacagagaaaaaccaaaaaaagcggttaaaccgctgcactatgaagaaatcatgacaaagaatagcacaatgtctaattattacgtacatggggttagcgccaaacacttaagcgctgacccatgccacgtccacaaccaactatgctagcgtggcaaattttagtgctgtactatttggtgctgagacgttggaccttagcaccaacaggattggtgttgagtccacggtctatttttagttgaagtttttggcgagggttagttttgaaataagttttttaaaaggaccaaattattaaaaaaaggcatttagtttcttaccaaactcttgtaaacacataagaaatccagccaaaacttagcaatattgttaaatttggtcaggtttatttggctacaatccgaacaaggctgaatatctggtgagaaatctggaagctgcgtggctagaaccagggtttacgattccgacgaaatccgatcggatttcgcgaaattttgacatttcgacgagactcgaaagtagaaaccatctgagatttcgaggaatttcatccaaatttaaatttgaattgataaaaaaatcttataaatactatgatattcatagaacctattgagatataaattttcgaaaaaaaaatgatgtattgtgtgtatttactaaaagctacatcaggaaagaaaagaataaagaattaaaaaaaagaaacaaattaccgatcggaatttcgatgatttcgatcggaatttcgccaaaaccgaccggttttcgagaacttgtcagcaaactcaaggatttgtattcaaattttattcaaattttggtttataaaatttgttcgaaatttaccggttttccaccggatttcgtgaaattccgaatttcgccggtgcccgaaacggaaggtcatgtcagaatcctaaaccctggctagaactagaggccccttaaaccattgatgcaatacctgtagtgcatattggagcatggaacagtcggaaggggtgtgacttgtgagaggtgaccggggtcgtcgtctccgaaggatcctgcttctctgctctggtaagacccgatgggtcgaatcatggcgcatggaaggacagctctctttaaaacctgattggtactccgtactctggtgtgacctgcttgtgcttggagagatatctttttcctcggcctcctcccctttctgcctctcgcaaggtgattgatgtcttcatgaatgtcagatggtggattcggcacaagcgactccacagatatggattcccttctcgtttaccgggccggtacttcgtgctgtatatcatcagatcctcactgtttacctcttctctccacgtacgttggcttatccttctcttttcactgtaatcacgttttgttccgacgggtcatgcaaagcagttttacacaacaaagcaagacgcttgatttcagaatgcatctcaattctcaagctcccatctactgctcccagaatcgttgcagttgcagagctgccgctaaactcaacttctgaactcatatggttcaaaacagcaacactcactaacagtttggaacttctgacagtatatacagtggttttctattcttctctgtcagtctaacagggcgcagtgcctacttcttcctcgcgtggattcgtgctaaagctagtaagctcttggtcttttcggctaggtaagacaaggcgacattccctgcagcttatacccactaaaagcgattaagcctctattaactaagcacgcaagtgatgatggcctcatgctatcattcgatgggggctcgcccaggacagcatgcggcgcctacccatgaactcctgcccggctcggctcgacagactgcatctcaatccattcaatcagcacaaagctgagaggaatattatcagataggacagagctaattagcgccttttcaacggaaaagctcgggggggcttgttcgcacgaaacagcagcagtaatcatgtaaagagcaccacgccaactctagtattagcactgcgtggctcacacgtgctgaatgtacgagagtctgaattgaattgtgcgccgatgaacctggtgctctgattacaggccgggcaacgaattggaaagggagaaacgatgtaggcaaagctcattgcaagctttatacggtgttcacgagttgatccccacctcaatgcactcgaatcattggcacattgggcctgaacctactcgtcaatggcatgagaagaaaaaaagggtattgcataatagtatctgatctgaaagatgctacaactttgaatcatgaaatggtccagtaccaatgctttacgatcaaaatttgacatttttttagcagaaagtgattaattcatatttgacacgagcattatatcaattaaatgcaatcactcaccatcttttctagataattcaagttggcgaattcagacaaaaatcaacacatacatgaaagacaaataaattgatgcatcgtgcttacaacatcaagtgaagtgccgactaggcaagtaggacccagcacctaccgatcgaccaccaccaatatcaagatgttacttgcccttgctttctcttgataaatcagcagctgcatgagcagccgcgctagcactagtattgctagatgcacatgcactagcctgagcttccagatccaaaatccatgatagcacttgactacttgtagtaagaaaataagaaaagaaaataagaaaaaaaattacagatcaagcatgggaacttggaaagccaagccagaagaggagatttggctcacaggggaacgaagagaagtatactcgtgcttccgtggtgccaccggcggcggcagcagcggaggcggcggccaaacggcctccgcctggcgttggcgcatgcaatcttccgctgcgcatagctgcgatgctgttgctttcgcgtgtggcgatgacgacggcaccgggaccgtgcttttactcctgatgactgtagtaaaaatttctacggcagccatggagtggagctgtgctgtctgtcacttgcttttttgggggacggagatgcagaaattgatggacccgtcatgattatagtattattattgcagtcacttgtgtcctgtgagtcgagccgtcgagcggcacgattgatgtgatggccaatgtacacatgactactcctgctcgcctctctttcggtcttttgttcgtcgggccggagaggagaggagaaaagatacgagatctactcttctgtgtactctagtattcaatccgcgtcaaaataaactaattttaagaatatagagtactatattttagtattaaaaatctagatatatgtatatctaacatatccccaaatttataatagaagtttattttattttgggatggatgaagtactccttaatgacgcgaggcacaagcatcgtgtgaggttttatcgccgtaagagcaagttcaatagtatagccaactactagctccaattcatctatagccaatctaatagcttatttatacaatagttacatactacactattaatacctggtcccatctgacatacacacactgcgtcttggagtccgtgctatagctggctacaaatctgtagcccgctgctcttctctctcctcatttaattccttaaaatgtatttgcagctggcttatagcctggtattgaacctgctctaacaaggaaaagatatgggggcactaatccatttcctcgctggattttcgggaataacccagatccgacaaatggcactctgctcagcagatggatgggtggtgtaagtttttgtgtaatggtatagttatatcgtacgcactgctgcagtgctactgttcatacgatgaaaaaacagctcggtagcacagccacaaatgatgctcttagttgtaggctaacctatacccgtggccggacgaaaccgagcagcaatgcggagtaacgtcgggcaacggcccacaaactactatcgtcgcagaggcatacgagccgaaatattggggaggcgctgtattcacgtaaggaaaaagtacaccaaaggtccccagcttgtcatcgagttccaaaatcgtaaaacctgatacaacacatctccaaacttagaaaaaccagtacaaactatgtccctcgacggttttgactttgattttgtccgacgcggcagccaactcagcgtgggccccacacgtcagcctcttcttcccctccccctctccacctctcttactctctcctctcctcttctctccacaggcagccggcgggggagtggctctgcgtgggcgcggccggccagcggcaaagcagctccttcccccgcccccgcgcccaactgctccttgcccctcgcgcgccgctccttcctcgccgcccagcccagctgctccccgccgcccgccgctcgcatgcatctaaggcgttctacacgccaagaacacccacgtcgcccgctaccgccatgcagctcctctcccggccgcccacgcctagttgctctctgccgagtgccacccatggagaggggaggagagaggaagagaggtggagaggggaggggaagaagaggcgcggcaggggaacacgggggctgggaagggccttttggtggcgacaacgatgcaggagcagggtaccgagctcgaattcgccctatagtagt

SEQ ID NO: 43003 - DNA, 9138 bp, Oryza sativa
catgacacgactgcttcagaaagatgtgaagtacaagtggtcgaaagaatgtgaacagagttttcaagagttgaaaagtcgcttaatatcagctcctattttgattttgcctgatccaaagaagggtttccaggtgtattgcgatgcatccaaacttgggttagggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggagaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattctattcgcttatcaattagagtaatatttgtactctattatcaatttgttattgtgtgcctcggctgattcctggacgagggttcacacacatgtaagcgtttggaattttggatagaaattccgggcgtgacaagttggtatcagagcctctttgaccttaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtgttattagtactgtacatctattactgtactaatggctcatttaccagcaaaagttttacaatactgttttatttaatcttgctgcaataaaataaatttagtatgttgattttataactttcttttgaaacctgttgttaaaaagtacaaaatttgtgaccttgtttccaactatttcaaattatctcgcaaagcttggtttactttatttacttcccttctactttgatttctaaaccttattcaaattaatccaaaaacttgtgctattaattggatagatgtcttaactccctcctttcacttgtctttagatgccgtgttacaagcctgagtacctgtttggtgttgagggttttgtccaggagttgcgtacgatgtcctttgtcattggatttgggactgcccctttttatgcccagattcgtcatgatcgtcatgaagagaagtgccgagtcaaagtcaccatgaacagtaatagtgaagatatcccctcagcgatgttcgaagctggaggaagaaactacatccatgcatgtcaggaagtggcaaggatcgccataggagagctccgtgatagctacagtgatcaattggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcattataagtagtgatgaagaagaagaacccaagcgcaacaattccaagtttgagtgggtagctatcaaagatgaggaagatgagccgaacgagcctttaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttcttgctcaacagactcagttaatgcacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctactgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaggaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccggcaatatcctgatgtgttcccagatgatttacctggtatgccgcctaaaagggatatagagttagaatagatttggtacctggaacaactccgatccataagagacctatcgaatggcagccaatgagttggcagaagttaagaggcaagtagatgatttgcttcagaaaggatacatcagaccgagttcatcaccatggggagctccggttatttttgtggaaaagaaagatcatacccagaggatgtgtgtggactatcgtgcactaaacgatgtgacaatcaagaataagtatccgctgcccagaattgatgatttgtttgatcagcttaaaggagccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagtttcctaggccttgcaggatattatcggaggtttatagagaatttttccaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaggtgt

SEQ ID NO: 43004 - DNA, 13830 bp, Oryza sativa
agaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctttgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaaatataatattcacaaacaaatgtagaaccaacctcaaatccctcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtgctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacacagtaatatttgttctaacagtttaactctgaactattttgtactagtgttgaatatgggaagacaaataatggtctcaataaacttggcattctatacaatcaatctcctatttacaagtactttgataaatctactgtcctttgaactccagatttaatgaaaaatgcaatataagaacttatgctccggttctatctagaaaaactgcaaatgcttttcttcaattctctgctctgtatatccacatttaggcttgtaatagccaagatgtaaaaagacttcatattcatgatatgctacatttaagcttctaatagacaacactggaaaaggatggagagtataagggaagaattggggcattagagatgttaggcatgctacatcttggtttacgccttcatcaatccagctttttttcaacttagattggcattgcttcctaaattcaagtgaaactggacttagtaaataaaatttcctttagtaacacctgcatgtcatgccataaaaaaaatggagggtagataggtataggtgaagcgtgcatttgctcgagtttgtcttgtgtcatcttaaatggacatctgcagaaggcataagaagaaacctggcagatgatggtattgaataatcttcagttccatgcataagaacaatgggaggcagaagagctattgtctgggaacttgactgcttgacaacaatttccggagaataacgtgacaatgactcctctccttccattatgctgaaacagttattcaaaaattttccttaactgctgtttaaacaaaacaaaccactttccaagcatagacatattactacctgaaaaatattgaacgattaagaccacgttcatgaaaatggtcaaccaaactatgcatgttgtatctgctccccaaaaaaaaaatgttgttagtgcttccaaattccaatgtatgcttagtattctatcagaataatccgaaagagaaaagaaaacaattgaatattggaggctggtgcttattcgtaatatggtgataacaatcatcataattcatcttcaggagataacttttgaagtgtctatcaaactccacagcacattgagaaatgatttatttgtttgactaggagaaacaatttactccattagagatttatatgtaatcacattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattggcacacatggaagcaccagcaaatgaagagaatggaacaaagaataacttgggggagaattcatagggtttctatttacatgttagtaacaaatacaactaacccagatgatgtgaaatgatgaagactattaatttatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcaatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaataggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggca

SEQ ID NO: 43005 - DNA, 10594 bp, Oryza sativa
tgtattaattagtactactaagcactactaatactgaccttacgattcacggaaggcgggttgcttccgtcaggacctccatgcggttccctccgcggcgccgcgacgacggcgcagtcgacatcctcgatcaacaatatggacctgttcttcatccggatcagcagcttccgcagctcggtgttggagcggacgccgccgagctcgaggtcgtagacgtcgaagcggaggtggttggagatcgcggcgaccaggctggacttgccggtgccgggggggccgtggatgaggtaccccctcttccacgccctccccgtccgctcgtagtactccttcctgcccaggaacctgtccaggtcgtccaccaccgcctcccgcagcgcggcgtccatggccagcgtcgcgaacgtcgaggcgttgcggagcctcacgggccgccacttgccccactcgttgctgaacagcttcgcctgcctctgcccctgggacatggccgcgacgcgggccatgacggccgggaggtacgcgccgagcaccatgtccttgtgccgcccgtcgaagctcagcttgaacacctcccgcgcgtcgtccccgccccgccgcctgccgccgccgccgccgccgtggctgctcaggcgccacgtcagctccgccccgtcgaacacgtccacgaccgccgtgccggggcgcatggcgagcgtgatctgctccgcgccggcgccgcgcggcaggctcgccttcatcagcggcacgggcgccgcggcgaggagggtggagacgtacgccttggccgcgaggaagacgcggttgtagaaggcgccgtcgaactcctcgatgaccacgcagtggcggcgggacgagggtggcggcaggaggagcagcgcgcccagggccgtgtccgggaggacgtcggcgacgatccggcgcagcagcatggcagcgcccacgacggaggaggccgccgtgatggcgttcttgtaccgttccagagcttcgctgttcggagacgccatggctgtcctcgctgcagctgcagtgggaggctctgattaaggttttcgatctaatcaagtgtttgagtggtttcagtaacagagattagcattcagcaggtgaggagagcttttggagtggttgccgaaagggaataccttattataaacattgtaaaggtcggtttaattggttggtgtttgatcactctgtcatgtaattaaccaccgtatactaatgtttgttgtgtaggttgtgattaatgtttgcttaggaaggagattagtgggtgctgactagctaacagttcggtctaccgtgtaaagcacttcagtcagtcaacaggtgccctctgagtttgccaaggaaaacactcggaaatttcgaacgtacatttcaaaaactgcgatttaattggttgtgcggcttggggtctttctttaacgtttggtaatcactctgaaatagccttttgtccacatagtacattgatttatatgtgaaatttcaaataaatgtatcttataccccctctaaattacttgtgttggcagttttcatactgtaactaacactccatgttacactttacacccataaaaactatccatatcggtcaaattatggcttgtttagttttcaaaaaaatttttctaaaaacatcgaattaaatctttggacacatgtatagagcattaaatatagataaatagaaaaactaattgcacagtttgtatggaaatagtgagacaaatcttttgagcctaattaatccatgattagccataagtgctacagtaactcacatgtgctaatgatggattaattaggcttaataaattcatctcgctgtttccagacaagttatgaaattagtttttttattcatatccgaaaacccttttcgatatccggaattaggtttaataaattcatctcgctgtttccagacaagttatgaaattagtttttttattcatgtccaaaaaccctttttgatatccggtcaaacgtcgaatgtgacacctaaaattttctttccgcgaactaaacatggcttatattaccccctcctagactagcaaaagttgatccagctagtggcttgaccaccacatcacttttcattgcacataggtattgccagtcagtccaatcaacaacaaagacgcaccacaaatccacgatcgttctcgcctcgtttctctgtttttgtctctacctccagtgtcggcaatgttgagccgtcctgaccggtggcacaataatcttctgaccagtagagcccacccactagaaccctaacacatggaggcaaatggagcagagctgtatcgtagaaccctaacacatggaggcctagtttcaaactttttcttcaaacttttaacttttctattatattaaaacttttctacacacaaactttcaacattttcatcacattattctaattttaatcaaaattttaattttaatgtgaactaaaccacccctgagctcaaggaggggagtggcctagcatagcgggttacagactgacaggcatggtggcagtagaatgagaagatctctatagtgcacgttgaaaatgacacaaaagctgacagcagccagcaggcaaagttgatgtccatcacaacgcacatttttaagtgagccacgtttttccgtgctcaattttaataaatttaaaaatataagtcacgcataaagtaatattcatattttattgtctcataacaacaaaaatactaattactccattcgtctcattttaagtgcagtgatgattttttatgccaaaatttaatcgtctgtcttatttaaaaattttaatcgtcccgttttaaggagcattttgtgaatgtatagtccaagaatgatttgacgcggttagtaaaaccacattggcgtttttatgacttctgtatgaaattgatggcattaaagtaattgaatgaaaataagtggcaggtgtacgaacaattgaatcaaaataagtggcaggtgtacaaatataggtgaacattgtctggcaaactgcaagaagaatcactagagacatggtggtggaacaagtgaagacttggacacatcatcgcacttttcaaggcttaaatcccactatctacctccgtgctaatacaagtacagtctaggttttatctaacttttaaccttccgtcatatttaaaaaaattataaaaaaattaaaataaaataatcacacataaaatactattcatgttttatcatctaataacataaaaatagtaatcatatttttttaaataacatagatagtcaaacggaaaaactcacaactacacttatattgggacggaggtagtaatacttaccattatactcataaaaaaaatacatttacacttttaatggaattttggtggaaccagcacaccaaaatttaaatttagacttaacacggtacttgaatttacggttatttactctttcgatggtagatggtgtacatgtttacagcgaggcgtctgtggtgaataggggtcttcttaataggggtaagatgtgagtgtgtgcgtgttgtgaactcttgtgtttgtactgtattcttaaaaaaaggggcttgtttggttgtcactttgaactcaacacaaagctttatgtggaggtgagagaacttatataaacaaagagtgttgatttctatacaagagctagctccttatatacttcaagataaatacattaaatgtaccggtgaaaaaaatatgagaaaaaaatagagacaattttatagctcatctattatacatatcagctctaatacaaaattataactaatagctggctctactattatatttggttattgatcatagcctgaggatagattacattaaatgtcaccagtggctcccggctagtataggcagcttcacaggtttgccagtgaaaactccatttaattttaatattgatttgtgaattgttatgaaatttgtacagtaaatattagttacattgaagtttatctgggctcaaaaaaaatttttggttccgccacttagggctaatttgttggagcttctagttgctgcagcttctctcagaatcaaatgctcttctaagcataccagcttttggttaaattatttatagaatccagaaaataaactagaagttagaagttagaagctgaaaaacttaatttttctagattcccagctatttctcaaaacataaactttccaaacaggctcttaggccatgtttctttcagtttgggattattataatctagattattgagtcagattactataagctagattgttataatctgtagtagaataagcggttagtttgtttctttcctagattattgggtttgcaagtctaaagagggagtgggtggcatggtgggtaatttttcatccaataatctggaaaaagctcacctaaatgagcttatcaaattataaaaagctggcttcggattataaaaaactacttcaataaattgtctgtttctttcaatttactcttaataatctggattatataatcccaaactgaaagaaatagggtcttagagcaggtacaataagttaattaggttggctccaaaatttctcacaccaccttaatcctatattaagggggaagaattgaagcgagagaaacgagcgagcgcttaatctagcgtcgggcggtagcgcagcctcccacgccgtatagcctgcatgcagcccgtgaaggcgattaaaaacgcgttatatgggccccacaaggaacccgcctgatcccatcctccagctctcatcgcatctcatccaactgcccaaatcggcgtcgacgctcacgttcctcttcctcttccgcacctacgcgcgaaatcacctccagccttgggcgtgaaatcgccggcgatacttggtgttcctctccctcttccacccctacgtgcaaaatcccctccgtctgtgcatgcgaaatcgccggcgacgcctcctgttcttcctccacttccgctcatctgctcctggctcatccgctgatctgactggtggtcgcattggtgctcatatgtgaggttgctgctgctattatgtaatgtggattctcaagttgattagtatcgatcaactttcgtatacatacaacatacatagacatatttgctgaatattcttgcttggattgacttgcctgttggactaatccggcaagataagtgaatacaacaactaattacaaaggaacaaactgaatgatgtatctgttttgtttcaggaacatatgtgctcttttgtccactgaataatgatgcacttctttcacaaataaagtttttagtttcacaaataccttactgaaatcatgttgtgtgtatttgtggtgtaccaccaagacatcttatagctaacttatagctagcttgttgtatgagttggcttttaagttagctctacttaatatgacaaaattttggagctagctgccagctgcactattgaccttgctcttagtgcattgatggtaggtcatcagtcatcacgtattcacgtgggtaaacgtacttcgaagtaccgggaaccgggttatacaggagaacaaatatatctcttcaagtactccagttacttgctaagggcattcccaacccaagacactagccatagtttccataaactccacatcattaagaaactagtactagacactactcttccaatgcaaacactactattacatacttcaatttaatgatacttatctctcatgacgttttggatgttgtgtataaaccatgtctcatgcaagatatggtttccctctctttcctcatttattcacttgccacatcattttttatcctaagtggcagcttatttaatgctatggacaccatcatagtcattggattagaaatgccctaatagctcgtttcttgttttgctcgggggattaacacattaatcatgtttggattagatgcgattgctttcgtcgcctggagctcaggcgaccgtgggtccgctccatggcaccagcccaggcgagcagaagagcgcgtatcatgcaggtttggtggttgcttcaggtggtgtttggatcagggaattaactttagttcctatattttgatactaatttagtgtattaaatatagactacttacaaaactaattacataaataaaagctaattcgcgagacaagtttttcaagcttaattaatccataattagataatgtttaatgtagcatcacataggctaatcattaattaattaggctcaatagattcatctcgcgaattagtctaagattatgcatgggttttttattaatagtctacatttaatatttataattagtgtccaaacatccgatatgatagaaacttaaaagttttagtcccatctaaacagggtctcagattggtctccggccaggtgaatccatctttggaagccaacaaattactccatatgtccctaaatatctctaaatatatgataccgttgatttttttaatatatttgatcgttcgttttattaaaaaattttaaataattattaattttttcctatcatttgattcattgttaaatatacttatagttttacatatttcataaaagttttttaataagacgaatgattaaaaaaattaacagttatatagatttacatatttcacaaagtttttaacaagatgaacgatagaaaaatatcagcggtttagggacagagggactaccaaacagccccaaaaaatgctttgttgcacttgcaggctgcagcaggataggcgcggaggcgccatcgtcgtcaccagccgcggcgcacgaccacgaccgcgaccgcggtgggcggcgtaaccgcgctagctccgccgtgccgcctcacctcgccctccctcccaccccgccgtacgtcccgagcgcccacctccaacgcagctcctcctacctccgcttcgccgtacgcatttttaatgtcatcaccagcattaatttttcaccgcttaaataaattttcgagctcagacggcgccaccggccggctgcgtcgtcgccatagcccatgctctcgcatacctcgagatccgccgcggttgctttcgctctccctgatctgatcatcccccactcgaattctccccctccttttttttctcagccgcggaaaagaaaaaacagataaaaagaaagaaaaggggaatcttggagcccgcggcccgttttgcagcctcacccctcaactgtgcgtcgttaatcgcggggccctcccctccccgtcgctgctgtggttgctgtcgtgccgtgtgggcgtcacaacgaataatcaatggcctctcctgcatcaccaagaagagaagaggaaggaaaaaaaaaatcagagagagggagaggagtaaaaaaaaagaagaagaagaaaaggagaagggagacaggggagtcagtcttctccctctgcctccgtgcctgcgcctttgcttcggagtccgccaagtttagattcgaggaggagaagggaagagaagagaagagaagagctctcccctccctctgcggcgtgtcggagcaggcgattggctccgttccaacagtccaagacgaggattattttacaaaggttaggtcttgccgccgccccgctgccgcttgtctgtctctctcccttctcaagtgtgcctcatttgttgactttgctaatccccaaatctgatttggctcccccgcattgcgcgcggcggcaacctcttcctggtgcgcttgccacatcagcctggccatgaacaaagttttcgctttttttttatgcgggagagatggggatgattatgcttgaggggggatcttgagcgtgtgtataggatcgagggttttgaacctgatttctgaaagcgcctggtttgtgaggctcaagagtctctgctttttgccggtttgagcttttaacgaaagaggcgatgggctctgttctgctgaattagccacctcgaggatggggaggttgaaggattgaagctctcttttcctttcgcagaagtaatcgcctgtgttctggcctctctgtggatatgtttcagagcttacctgtagcgtcgagtttgtctgcaacgaaaattgctggtgaatgtttcagatgttatgtattccatccatttgagattctcaaaattggttttggctctgtttaggatgtttaatgcctcaagttcctagttggtccacctatttgattaactccacacatagaagagcagaagttggtacatccttgctgtgcattgttgaaactatttgcccgttctgtagtgatctgaaagatgtcacattctgcgtgcgatcccttctgtaatgaggtcagtggtcgttttgggaaagcaagcatttcagcaacagagtgggatatttgatatctacaggccttagtaatgctcattttacagacttttcagcacaataggttgtgtctgtttccttgcattgttaaagttagaaggttccctatatatatgaaaaaaatgcaatgcggaagaaaggaacagagtaacatatttgaatcgtaaacagtgagctgggtcaaataatttatagctatcaagaaattgtcttgtttgtctttcgggctttaaaacaatgtgtgaactcctcgttttggaagaaaaactctgacatgaaattactatactgttttctatgtacaccgttttccattgaaccgttgagtttgtttgttgtttacagaagctgccttttataatgcgattgttaaatgacttgatgtatagctttatattttctgtgtatctatttgtatttggatatgtgaacatggttggatatgaacttaggctctttcttgattgacttagggtgtaggatcctgattttgttcttgaggtatgtcctcaaccagttcttcacagccaccagcatcgtcagatagagaatctacaccagccagtgataatgcaacatctcctgattcagatggtaagcagcatatcattttcttatatgatctctcattctctctacatgactgcactacatacattattattccctttcttatcttccaatttatccttcatggattttgcaggcacgaattctgctggacccgcaagaagcagaattgcactgcagttggatcagcggtcattgcatttttctgttactgcttgggtaaatggattaagcacaacaactagaactttcagcaattattgcattgcacataattttctattctctgaaatcaattcaatgctgaagatcacgctcttgtctcaaaatcccattggtgtctatataagaatacttttttctagggcaccctcattggcctaaaaaaggtcagttttagaattcttcacaagtgagttaatgttcagaattcattagatatattatcacataatagactgatgagcatatattatatcagaataccagatgagattggtgtagccatttatttatttccctccttaatgattatttgctctttagttccataggaacaatatttagtatactttttaagtgctcgccagtacaaaatttcaactttagtttggggattaatttgtatgccttgttttagcttccatgtattaatcatgagcacaaatttacacagcttttagttaacatgtttaaattactttagctgattgtcagattatctttatcacacacacaacacatttgtttcctctgttttttataggttcttattgttgcattgattggaatccttccactgacaccacgacaactgcaatataagggatatcgtttgtcacttctcggcacaacctgcaccacaggctatgctttgtttgctttttatcgggttagtaacatgtcatctgttttattcttcccttcttagataccttgcacaacttttaccatttttccttttgttcagctaccaagagcaggaaacatgcatgctgctcagatctttcaccatgtagcttcgtcaaaggattttataccattcatgtactgtcttatgtttgtcatgtctaaactgcacttgaagcgtaagcatggcttgtttactgacataatgtattcttcatatttccacctaaacacctttcctagtacttgacacgataatattttttgacagttgttttggtaccagtgatttgctgggcacttgaacatgtggccagatttctacggcgccattttactaattcctctctatacaggtaaatgaactcaacagattataagcacaaaatcgatgaagagtatgtttgtcttgccttctatgcatatgctgttgtgctatcattcacatatttaggataaggcagttgaggcattatcttcccattcttggtttatgctgctatattgactaaacattttgattacatggcttttactacttcatctctctgggtgtgcaatacctgtaaaaccatcacaatgcaatgaagaaaacaatatggctgtacatgccctagtccatcagttgtaaatcaatatgtgcaggaaactgtcataaatgttgaatagtataggaagaagggaagatatactacgaatattggacattctatattg

SEQ ID NO: 43006 - DNA, 4243 bp, Oryza sativa
atttcttttgattttgtctctgttctcgtcagtagagtcctacccttcagttttaattcccccattcccattaaccattcatcttaatctcttattactttttacttctgttgtgtaggcgacaacgcaatcctatgcaaacgttcatgtactggcaggttagttttttacataaacactgattaatttctccaaatgacatatttctctttttttttgttgactacaatgctgcaacaagacttatctttcaggtttttctatgatatcatttgtcatcacaattaggaatttggagtgttctttttatatctagtataatatacttttatttttcttgcgtggatatcatcttatccactataaacaagtgcttgtttagttgtacatcaaacagaataagtaccaaatgacgcttaattttgcactgcacatgctggctaaaatgctggtgacgagctcgtccaaatgcggatagctatatttcaataatctcaggatgccagccaagggaaaaggtgctcccatggctgaacaaaattaccaattaagtgtatgcaatatttgcatttaaaagataatttgggcaattttagttacttctgctctcagttgtaaaccgcaaaccgcgcccctgcatttaaatgaatgcttgtcgggttgtagagaaaatttattatttattaatgttatagtcacagaaaatttctagcaaatcactatctcactctgtttacccgctattgcagttactgaagctcatgtatcactctcctttcactgccggttatcacagagctatctggcttaaaattggccgtacagttaatccctatatccatcgctacactccttttcttcatgacccgataaatgctggcatgagatggtggttcaggtagcatggatatggctcaattaatcatgtaaaggtgtttttggttacagttcacagttaacacatggaggatcttttcagtaagttgtagtttgcgagcgacatgtttagtaccttttctttttgcgatgttgcgctgatattacttttagttactgacaagtaattcttgtaactttaccttgactgtagaactagtgtagaccttagtaatatggccaataccatgaagtgaaaaatggaaaagcaatttattactatgatgcaactggattctgctcctgatttgtatcagaccacttcatgtaccatcccaaaatataagttttgggtaggatatgggcattaagaaggttacacacgaaattaaatggaaaaatgtatgtggataaattgtttatatcttaagataacttttaaatgctataagttattaaattctgggacgaagagatcagttggtttcaggccctgggccatgtagatgcatttggttgcaaggatggaatgggatgggatgggacgaacccacttttgaggttgtttggttgaggggtgagtgggatgagatggtccctggagaggaatatcctctcagatccgggaccaaccgatccggcaaattctggcggacgaactcgtcctagttgggacgagcgaacggcatgacccgctcaagcttgaggccagcccgcgcgctcgccctactcgccctcaggagcagcggtaaacaccggcgggctcggcgacggcgacggcgaccgcggctgcgggggctcggctcggcgaccgcgggggctcgacgacggcgaccgcggggggctcggctcggcgacggcgaccgcggggggctggacgacggcgaccggcgggggcttagcgatggcggccgacgggctcggcgacgacgaccgcggccacgggggctcggctcggcgaccgcggggggctcgacgacggcgaccgtggaggctcggcgacggcgaccgcgaggggcttgactcggcgacggcgaccgtggccgtggggtggctcggctcggtgaccgcgggggactggacgatggcgaccggcgggggcttagcgacggcgaccgcggggggctcagcgacggcgacggcggatctagtggtggggagggcggtggaggtggatccgcgtcctttgcctgctcgccgccggcctgctcctccaaccgcacccctgctcgcccgtccgtgctcctcctctgttcgtccgcctgctcgcaatattgcgccgctcctcctcgccgccagccatcgtcgcacctccgctcgctctcctctttctcgctgacggtgatagcaaacggcgcccatcccatctctagctcatcccttcaaccaaacaaaaaattaggattgtcccatcctacaaaccaaacacgtaaatggaatcatcccaaccccaaaatcagaaatggtttcatcccatcccacctagtcccgaaaccaaacacacgctaagatgactagtgcatattccaggggcaatttttgcaacagtacatgaaaatgcagtgccgcaatatttcaagaattgttgccaacactctattcgaagcaggactattaaaaaaaatcagtaaatcagtactattacaaagaaaattgaaatgcgataatatttatttcatgaaactcccaggctccaatgagagttcatgcgaaccatccctaggccctgagattaagtgtgaggtggagcacggatccggcctcgatattgtactcgtgggccgccttgtcgtcggtgaccagcacccctttgtagatgagctgccctatttgcctgtcctcctcctcgatgcgcgccctgatcatggccccggtgtccgtcggctcgatgcccaggccaaacacctttgccgctgagaggcttcaccttgatgttcatgctgcctggaaggaggcggagatagaggctcagcgtcgagccgtcctggatgttgtagccagccaccgtgcagccgttctccagcaacttgtggtcgaagaagagcagctgctggtccggcgggatcgggatgccctccttctcctggaccttctccttgacagatcgtgtcgctgctctccacctcgagcgtgatgagcttccccatctgggtctccacgacgatctgcatcttcgtgtctcgacggacgtcgatcgacgacggattcggctgctggtttgtggaagatttacgacgtacgacaaaaccgcggggctttgcttcgatgctgtgggcgtattggctttgcgtcgagacttgaatcgatcgatgtaggactggtgttgtgttatgcggctccggtcctgtggtttttattggtggtagaggcaagctttcgccgttcgggttggtttccagttccgatacggccgcgacgcccagcgttcgcgttgggctccatctccggttcggcggattatccaactcgggcctgtatctggactctgaagatacaaaagacgtactgttgccggttgggatttttccttgagatcatgtagtagttctcggaatgggactcgtcatcgtgtacgtttctacgactacgatgccggagtacacggctttgtcgggtacgattatacgatgtgccgaaaagatgcagcccgatctaactcaggactagtgtgattcttgtattgtaagcgacgaagtgcatcccagtcgggtacggtacgattttgatgtcgaaagggcgtaaaagttctgtcattgcggatacgagaaaaacactgagtccactctcacacggtaggagtacatgcattatttgaagctggccggcgtgccaggatgagacgaaaaaaaatttggtggagaccgggtataattctgtaaatcggctcccgtgcagccccgaccccgatgattgccgcatggacaatctcagaatcggacgtctagttcgttgcggcttcaggcccagcgcaaatatggcataggagcctcgctcgactcggctcccgggcccgtcgggtcgtgggctcatatccctctcgtatcggcctcattcgtccgcagcagccgccgccgccaccgtcggccagcggcgtctctctcatctactgtctctcgtccaccatcgctccctctctcggacatcgtccactcggcggtgatgacgagggcaaccggctcacaatcgccgacacccactgcggcaactccatgcatggttggtctttcggcaagaaatttaattaccggtaaggagattgaggttgagggtgatgacgcggaggttgtacacatcggtcttgtcactcattttcttgaactgcacattacgccatcagaaaatgttagtggcactatcagtattaggt

SEQ ID NO: 43007 - DNA, 5726 bp, Oryza sativa
tggagggttggatgggatcagccatgggttttggcgctgaccccttatgtagtgataaagtgggtttgtgttaattcttgtcactttctatgatgtgccttggtggtttaacttcctatgatcccaggttcgacccctcattgctcatttttttgcttgctttaatcacacgaaaagaaacaaaaaaaaagcaggacgtagggatcgaaccctagtcttctgcctgacagtggacacattcaccgttgtgctatacttcggttcataacagtattagccatgttttgcatgtaacatatatatggggtcagcgccaaaatgcatggcgctgacccctatcgcacctgccaatggctccgcgtttttgatctcagtgccaatcccaatgatgacgaggtcacggttcatttttaaaataagtttttggcatggtttactcttcaaataagttttctaaaagggttagattgtcaaaatttcggatatagatgcagattctcaattcatatagatgaagcccaagaaatgtagcgtgaatttggagcaaatttgttcagagacagaaaggtagtagataatgttagtaaagcactgttgttaaacaaaagtcgatctccccagaaaaaaaacaaaagtcgatctgccatttactatggccggaaaaccgtatgatatacatgttaatttgttcaactgaacttgacactcttttactgaaatatatgcactgaccaagtgaccatgaagaaatgaaatgcttaaatctccaaaatcttcagtatgtatcaaatctaaatggtaaaggaccaaaatgaatattagtactttatcaaatctaattagaatctgcaaacgttcagactacatacattgaaatgtagcaattaacaactatattaaagtttgaatgcagaagcccagatcaaactaactaatcaaatcaatcctgcaccatggtaagaaagaagcccgtgagctcgatcaagagatagcagctactgcccacgggaagatggagtacatctctgcgctagccgccggcaaacagggcgaactcgtcgttaacgttgcggtcgacgagagggatgggttgtgggggcgcggccactcgctatcgccgccccgccatgcagacgacggatgagataggctgcgtcggcggcagtggctgctgctgagaagagatgtcgatgatgcgatgtgagccggtgaggcggtgagccgatgggcccggagccatcgagcgagtcggctcctccgtcctgtttgcgctgcgcctggagccatacatagtgagacgttcgattctacggttgtccacgcggcaatcatcggggtcggggctgcacgggaaccggtttacacccggtctccaccaattttttttctggatgagactatcctgcttctctttgtccaatagggctcatcattctgtacgttcatacgactacggtgccggagaacacggctggtcaggtatgactactatgcaatggttcgaactgatttagatattattataaaaaatgatctttcatttatagaaacgcatagatcaatagtagctacagaccagcaaaatgtatgaatggtgcatacggttgatgatgaacgtaggcaaattaaatgtgacaaaggttatgattggttgagaatagaaagtaggtagagaaattaaatagtgtaagtttgtaattactcttattggttttattattcttaatgttttggataaggttgaaatcaaattttttataactttgcctttcagtaacttttaaaatattagtttaaaggcactagaacaacatatatagatttatcttataaagtaataaaaataaaaatatatttatttattgtacatattataatagaaaaatatagtcaaagatatattttgaagactgtcattgtataaaacatcaagaattatgaaagtagaggcagtagttgagaagagaatatgggtgataaaattgatatattttacaataacttttaaataacagaagttatattttaggatggagagaataactgactttaggttatgggtcaagtaccaacaatttccggttctataagtcaatatcaagcccaatcagatgctatatatactagtgcatattcaaagccaagtttcacaacattatagaaaaatgcattgctgcagtatatcaacaattgttgtcaatactccctcctaagcagggctattaaaaaccggcaaaataatatacttaaatgagcaatgttaaaaaaaaatcgaattgcaacaatatcatatcatgaaacccgcgggctctaacgagtcatctctagcccctgagagcaaggacgatcgtggaggagcacggatccggcctcgatatcgtactcgtgcactgtcttatcgtcggcaagttgcttcccgccgtagacgagcctgccctccctctcatcgatgcgctccttgatcctgcccatagtgtccgtcggctcgatgtccacgtcaatctccttgccagtgagcatcttaaccttgatgtcgttcatgccgcggcggaggcggagcacgaggtgcagcgtcgactccttctggatgttgtagtcggccagcgtgcggccgtcctccagctgcttgccggcgaagatgagccgctgctggtgcggcgggacgccctccctgtcgtggatcctcgccttgacgttctcgaccgagtcgcagctgtcgaccacgagcgtgatggtcctcccgttcagggtcttcacgaatatctgcatctttcttcgttgacggtcgtctcagctggtgatcgatgcctgcggcgatttgctgtgcgacggccggaaaactgggacaagagaagaccgcgcggcgacggcgaggtagtttgcttcgtttgcttctctcgtggacgttggtttgcgtggtgaagccttggggatcgataagcattgcagttgcagctctcatcgtgccgttttatcgtgcgatcggcgggcttgggtcgcgttcgaatcggcttcattttccgataccagcaggggcagaacatcgttgtccgatacgtattgcccggagtaaaccgtaccggaaggtccggaaccagcccgcacaaacaacacaggctggctcggacgcaccaagggccaaggcaggcagctaccatggccaacgaagtttggtgctgacgccactgctctctctccggccggagtcccggttgaggttggctagcatgattggggccgaccgccggatcgaattttttttacaaaaaacatgttaacactcacaatgcgtgtacattcatttctattaatacatacacatatactctacctctataagcaccttcgaaagattagaccaatatattttaagatagacaaagtcaccatggacacctcactgtcgacgaacatgtcgcctaccactaaaagaataaatagttgtaaatatgagcacacatatcaaatctaaaatttaaactcgggtaggtatcaattgagctacatcagaatgaaaatgaattttgtcaatgtaataaaacaaggaaaaaagttattagatttgaccgtctgacccagttttttaagaaaatgtaatttattttggcctttgcttatagaaacaaactacaaacaatttactacagaatttgcaattaagtcgacaatggttaatcacagcttaattgaaaataaaaaaaaaatccgaacatcagcctaaaaggagtgacatatctattactaaactttcatcgacgaaaatctatgtaaccattattttttactaggtttagaatttttacgttggttttatgggcaaaatagatccgatccttataatagtactctcaccttccataaaaattagacctattactccctccgtctcactcattactctcaccttccataaaaattagacctattactccctccgtcccactcattaagacgtggtcaaacttggcataatctttaagaataatctttgactttaaatttctcatagactataatatttgtagcaaaaaaaaaatcataatatatgaaactaaatttaagtgataatacaatgataatattttcatcaaataaaatttaatttataataaactattaattgatcaaatatttaaagagtttaatcttaaaatgtgtgtgtgcattaatgagtggaacggagggaatactttttatcaccaaaactaggagaaattaattcattttgcatataacaaagatcaacaagtatacgtacgcatgcaactaataaatattaagatgattaattaggttctcattaaacatttaatttacctatccaccatttaagtcttggatgtatagacactgtaaataacaataacttatttgaaaaaacagtaaaatatgaaataggtctttcttgtggttggagagagtacgttctacatatgttgatttatttgtctggtcactcggtagtagttattttcaccctcgatgacacgcaacttgacgttcgtatatgctttgcaaatttgtatgcatctttcacaagcacaaggatgaactcatcagttaaccgacattgtcactcatatgcttcttgaaaagaggaatcgatcgaaagggtagtcctcgctgcttgcgctgtggctggacctagacgagctccgcattgaggcgcggctttccactgttccagccaagatgacgcgggtagcctcatggtggtccacgtaggatttttttttaagctaaaggagagagaggagaagccggtgactaattagggcaagtgctatgatagatgtgactaccacatttaaatttatctatattattcactcactaactatgagacaaaccatacaatatatcacctctaatacacaaataccaatatttctaatactctcacattcttcttgaagtttgtgtggaggttgcctcttggtttaagggtgtctcatcatctctctcatcacttctctcctctacctcatcactcaatccaatgtggcacttttagggggcaacacatggagcattagagcaaggctaataatatagccagctgcttactgaatagatctttacaggctacctctcagccaactcatatagtggttagctcttaactattaatatatggtccacctgtatcgactctcacatattttcttagttcatgtgcctaagtcggctataagcctaccacccgctttccctctctctctctcctctcctctcttatccatctcagcatgtattcaaccttcttatagccttctattatacttgctcttatagtacttgcccttagccgtccggctgcacgctcggcccgaggtcgcggggaccaccaggagcgatgggttcgccatctgcgtccggtacgctgttgactgtgtccaccaccgttgccatcgctctccattgccgtcgtcgtctcgcgcttcaccgggtcgccgccctcgtccgtcgtcattgccagcgccgccaccatcagcagccttgtccgtcaccgcagccgttgcactccactgagtcgccgtccttgttcgtcgttgcggctgccagcggcctcgtccgtcaccaccatggccgccgatacactccactgagtcgccgaactcgtccatcgtcgtcgccgcagctggcctagtccaccatgcccgccatcgcactccactgggtcgccaccctcgtctgacaccaccgccgccaccgtccttggccac

SEQ ID NO: 43008 - DNA, 1454 bp, Oryza sativa
gtcctataaagataaaatatttgtattacagtatttcctattgtcatacattagctacaacatttattatagatgacatgattattttttaagccaacaatgggttgtattattgaccttgctctaaaggagtaagtggctccgtttactgtgactcataaatagattcgtgaattagccattatattttcagtggcagatccttctcaatcgacgctgaagtgctatgcccatgaacagtgatgcatgatgacaagggacgaagcgattggaaacagacaaccatgatctgtacatatgttgtggaggtcgggaggtaagagcaccatggaccatggtatgcctatagaaggtaagagtatatcggtgtagggatgacgaaaagagggtcaactttattttttttaaataggtaatttataaataatataattgagatttgagactgatcagtatttattaattttgaatcggcaaaaaaaaaaacgtctcaactaaaattattactccacaaaagaaacttcataaaatctctgtagatcgataatgcaaagaaacttcttaccaaaaaaaatactattagcttatattgttccaaaaataacctaaagccctagctagagtctagagtaactcgatgcctccatctactagttggagcgcgctcagaagttcccgcctcggagagcgaggacgaggtggaggacggagccagcctcgatcttgtagtcgtgcgccgtcttgtcgtcggcaagctgcttcccgccgtagatgagcctctgctgcacgggcgggatgccctccctctcctcgacgcgctccttgatcctgtccaccgtgtccgtcatctcgatgtcgatgtcgatctccttgccggtgagcgtcctcaccttgacgttcaggccgccgcggaggcggagcaccaggtgcagcgtcgactccttctggatgttgtagtcggccagcgtgcgcccgtcctccagctgcttgccggcgaagatgagccgctgctggtccggcgggatcccctccttgtcctgcaccttcgccttgacgttctggatcgtgtcgctgctctccacctccagcgtgatggtcttccccgtcagggtcttcacgaagatctgcatctcgacgattcggcttgcttgtggaaggtttaccacggctgccggaagctgagaagcacgtaaaccgcggggctttgcttctatgtcgtgggcgttgggcttgtgtcgagacttggatcgatcgatgtgtgtggctatgcggctctccgggcgtgtggttttattggtggtagaggtagcggcctactagtgttcggggtcggcttcccgctccgatccggccgcgatgccaaaatacagttcgtctcggcttccagctccaggccggccccgacgcccagtgtgtctagtatacggacgtaaaaaaactcaatcctaggtttg

SEQ ID NO: 43009 - DNA, 9449 bp, Oryza sativa
gattcaaacccaggattgggtttttttgggacggagggtgactaccgtacagtgtgatctacagactactgctgtgcatacgtattcaaaataggacttgcatcgtataggccggatacgtggcttatcgggtacgactacgatgcccagtagacgtaaccgattgcaatggtccagatgaacagatacagcacggagctagttctgatgagaccatcagctcatagcgattcccatcattgatttctatagcaatatttttagctaacgatgaaaaccaatggcaaaaaggaatgacaacgtaatacaagtggctcgtgcagcctttttatgcaatagagaaaacaatgaatggttgaacatgctccagtccatcaaatgtaaaacgtaaaacagaaaatgttactattattttattattacctgagttcatgaaaacgcatgtctccttagatccctaactattaggagtatatagcaattgctcagtacgtactgcgagcctgagcgcagcccaagaactctggacgggctcagatcctgagttttggacaacactatttcctaccaagtctccaacaagtcaagtttatattgaagttgactctggaccttgcaactcgtcagatcaccccgtcatgacagcacatttcagcaaggctaaagcaatcaaacgtagagctagccacttctacttctgttttccgcatctctgttctctcctcgcattcacttcagcagcccagctcttgccaatctctgtctggaacttgcctgcagtaacaagatttacagatatgtttaacaacagaggacatgtttacaaatttttaaatagcctgcaacaatgacattaccagcggtagagaggaagaactcatctaacactttgccatgctctgtagaataagatgggaagagttagtgttacaaacggattataatccacaatgtacatcagatatgtactacttgagtaggatgacaacataggcaggcagctggaattatattgtacagtgccctgaacaaacaaaagaagaagatggtggcatgaagaaagcggtttggtatgattgtcaacacagcagcagactattcaaagttcttgctttgtaaaaccaagcatcaatgcacgcatcagaatggtgcgataaaaaacatgatgtatcctgcatattactgtaacagcaaattgtttcagaggaaggacccaatctaccgcctggtagacttcacagtttgttaaaatgagtaagcagctagttgaatgtacacaaatttaaaattacagaaaagtaatacctttctcatattctagtgcttgaagtatcatttccacctgcaaaacaagtaaatacaagaaatggtaaaatcccttgaaccatagtgaataaatagagaatgaaaacaaagaaaaggacaaatgagatgtgccccagagtgaaactgcaaatgaccaatatgtgccacaacacaccaaaatacaatataaatattacaccttaaagagttaagaatacaaaatgaacaatatgttgcatgcagggtttaaaattccggaacaaatttcaggtctataggtgggtcccaatagacagtgagctccggtgaaaaatttcggcaaaacactgttcatggtccaaatccccaatttccaatccccttctcactcacctttctccccccgtcctcccccaacatctcctcccatcctcccagcactagcgagcaacaccggcagcggttgctggaactggaggcagaggggtggctggagtggccagcggtggttccgcggctctccggagtgacgacgatgacacaagcggcaaggcggcgcgggcctcgcatcctcgtgctggagtgccagcaacggctccgcggctccggctcgacggcgacacaagccgtggacctcgcatccttgtgtttggctggagtggccagcagcggctccacggctgtcgggcgcgaccgcgaccgcgacaacgacacaaggcacacaagccagagaggacacgacgacacaatccttgcgtttcattctcctatcctgtccccctgctttggattggatggacttgatgcatgtctatattctgatatatgtcaaatttctgtaatttttgttgttcaaattcaaattttgtttgaaaatttcgttcgaaattccgaaagatttccgaaatttcgttattttgctgacctccgaaaattttccctttcccgatagattgaaccctggtttgcatgacacccctcttatgtaataaagaatattcttacaagcaaacatgcatgcgttaaagtattggaaattaaaaatattttgcattttgcacaagcccaaaaagttcaatgaactattgaaaccattcatcaaaacaaatgttatattcttgtttattttgtctatgttaatgaagaaaagcaagaattttccagttcatatgaactaaatataaaatatttatctatgagtgagttgtttcaggaacttggacatggtttcataaagcgttactctagcaagcttgaaaattgtagaattgtgctgaatttgtaccaattccaaacaaaaagaaagctagtatattaacgaaaatgataattctggtgtacatttcaaattagactccaggttgagaaaattaaaatcaacattataaaaggcaccaagttaagaactaagaaaaagaaaaggaacaagtagacagttcagaaaataaaaggcacgcttactttatcaaaatcctttacaaggttggcttcaatggatgaattattttcatattcttcccagagctccttgatctcatcagctacaaaaaacagaacactaaaagtagtgaagattgatgtcaaacatcatccttcatgaactcggacgtcacatcccaaatggacacaaacctattggtcctccaccgagaacttcacacatttcatttagagccttttgttcacggcggcttttttccgctttaggtataccgtcggatggagtaatgtcaccaacaatagctgtcaaacaaaaaggataaaaacctgaatataaaaggatgctaagaaaagtgggaacatacagattatacagtcctagaataaggatgataaatattggcagatgaagtgcaataacatattatcaacaagtgcatacaatagaaaattaagctaaaaacagctgatagggtgttctttggcataccttcagcaatgtcatgcacgatagcaattttgatgcatctgttttaggtaaaataaatatgtcatcacaaacaagtaaataactaatgactaatttagaaaggaagcctgaaacatctggtattttgttgtaatcaattaactagatgaacaaagaacagacgaaagggcattttttaatgctatggaaatttgaataagaaaaacacggacctttctcgatctacagcaggtaggtcaccggcaatcaaagccataagggccatacggtacatgtgatcagcaatagactcaggaccctttatgctatggtttatccagcctttccttttagtggtctgtataacagaacagaaacatgcacaactcaatatatcgcagaataataacgagtataatagacctaggcaacacatgcatggagagatgaacaattgaacaggatccagacgcttgttcatatgcttgttgctggtcacacatcccacctacttatgacatcgtaagcaaggtacccatgatgcgagacttcatggaatcatggtaatcaattcacaatacaaaatggcgattatgaaacccctcatagctgttccacattccccaagctgttactctagaaattaagggggtatcaccagcccggttgtacacacgcggtcagcgaaggacaggcatatgccttcggagcgacgtatccagaggcgatcggatcacgaggaacatcccgttggcgtaccttaaggcgatggcagagggtgaggaaatcgatggccgaggaggcagacgacgccgcggcggagggcggcgccgcggcggccgcgtcggccggcgcaggcgtcgtccgcctagggacgggcgatccgccgggtccagggatcccggaggcggcgcggacgccgggcgcgaggcggcgccgcgccgggcgctccacggggagcgaggccgggaggatgccccgcggcgcgcggcgctggaggccgccccctggaggggccggcagccgcgtggtcacgcccatcggaggtagggctcgaggtgcgctgtggatcggagcttgtggtggtggcggaggcggaaggctacggatcaatgggatgggatcgccggaggaataggcagcggcggcgggtctcctctcctctcctttgcctctgctcggggtaggtaggatcacgaccgcacgagacgaaggcgtccgatcggacggccaggggtgcatccgctcgaacatgccgtaacgcctcgtgatcatccggccgtccattccgtccattttaatcgttcgccgttcattacgcaggagcagcacatggtgctagtgctatagggacaagccaattttgcttgcgcgtcatcttgattcgtgctctaaacagcatctggaatcgagtactcggaattatacatcctgattttgttcttttattaacattctgcaaagatgtcgattacactgcaatagtacagtgggtctacttcatgaccatatatgatgagattgtaaacttcgtcggcagctctgtcacaataatctcttctaagctcgatcttatcataggccaagcattaggattcgcagcgatcatacgacgatgaagctgaggtgctggaccgttaaggcatttacatcaatcacacagctcctcaaattagccatagcgaatgcgattagattacactgagatatagcgataacaaattatcagtgacgccatcagatcaagttcgtcaggggcctcggtgccgaccgaagcacgagaagcatccctgtggctggtcggtcgggatcatgccaccgcccttgacgtgtcgatcgcctccagcatggacaccacctccgccatcgccggccgcttgtccgggttcgcgtcccagcagcgcttcatcacgttggccaaggagctagggcagcagcgcggtatctcaggcctcaagttctgtagtacatcatcaatcaaggatggtgattttcttttcagtgcttcagagttcaggaatcagagaggtgaagtggggaaaacgggataggacggcgtttttttttatttacctgacgaacaacagctgaagtgacctctgagaaactcagatcaggatacggcatatcgcagcagtatatctcccataggcagattccaaagctatatacatcacacttcctgttgtaaggatggccgttgagaacctgcacaatgatgccaacgtatgacagtaaggacaataacagtagactagaattacggaagaatggtacgtgcaattttggaagatcgcagaaacacaacatgacaatgaataagatgattgaggggatgcagggttaagattttccattcgccaagcaataagttttttgaacgataccagcaaggaaattttcagtgacatatagtcacttttcccttcttaattcgatagtttggtataagtaaagacctatcagcataaatgatacatgatcagcataagatttccgtatggttgaaggaaaatacctcgggtgccatgtaaccaagtgtgcctgtttcacccgtcatatcactaggatttgaagcctcaattcgtgcaacaccaaaatcagcgattttcactgttcttgatttgtcaaggagcatattttcagtcttcacatcacgatgaactatcttctttgagtgaagatagcttaatctgtcagtgcaaatcccacaacaaaatcttctgagattaaaacggaataatagatgtaaatccagaaaaaggaccaagagaaacatatattattacttaccccctagcaaggtcaagagccaattggaccacaactttataggctagcttccttctcctgttctttatcagaaaatttttcagtgcacctccggcaaggtactcgacaacaacgcagcaaatattacttggcatgccaaaatgtccatgttctgtctgtatatttaaatctcttgcacccattatagccccaataaactgtcagttaaatttcaagatattgtcaggacccagttgagaagcagaagacaactacgttcaccaagtgaatgaaaaaaataatgataattgttgatagctcaaaatgaactgtgtagatggcagatactaatatttattgcttggtaaattcggcaccatgttctaaaatcaattccattgtaattatgccataccaaataggagtacgcaccttcaaataggagtacgcaccttcgctactattatcagaaaaaaaatattgtccaattatacaagattctaatgctctttagcagtgcatggctaaacaccttaataactattttatacagaagaggaaaacatggaatccaattttagacacgatactgggtgtattatatagctagcaccagagtttgaacatgactgccagtcctcctactgtcatatctgatatctctagccatgaaaatattattgcaccacaaccaatggtttccttaatagattataatgccagagatacatcatgataaaacaagtttgcccatgtggttgtgccggacaatattgaatacaaattggttttgtaaaccagggctaataaatgtaaatttcccaaatgttctgtaaaccagagataatgtaaattggtctatatatttatcagtgaaacgatttaacctatgaaatttgaagggatgaaaaaaaaaagtcttctccagtcaaagattaccttggtaacatttggatgatcaagcttatgccagacagcgacctcttgtgcaaatgctgctcttagtgaagaaatttctcgttctgatctatggccatcctccccccagtcaagcattttgactggatgatagagaagatatatcagttacttcgacaatgaaactacaagtagaaataaaaagtcttttttgcatttagcaattgattcgaagacaaagttatattgaagtagtaatgctgcatattactacatcaatacacattctttttttaatgtaaatcaatagcacattcttgatgagggtaacaaaatcttggtgaactgtgcatgtctctgttttcctaaaagtgtatttagcaattagctgttaattgccaagtttgaatctatctgggggaatataatgtgacaagtgatgaattattcatgcaaaagcagtgaggaagctggttttgtcatacaaactaaagtggtagagaaaggcaagccaataaaaaactccagtgagttagcaaatactttgaaaaataaaaaaaagaacatgctggaggaacactgccatttaaaggaagctgatggggacttgaaccctgactaaaaccaccgctaccttgtgctaccaggttacatgagcatcaccaagtgatttaggattctaatgacctcttatgaatctaactgatactttccatttcaagacattgtactcaatttcctggtgaaccaatatattgaaaggacggcatgcaataggtgataaagttctggacagaaaaaaccactgcatctgcttttgccttctgtcatgtgattatagctggtgatacagtgcaaaattgctaatccggaccttttatcaacccgaatttggttcagatgcttttgaattttcctggtccctgaaaagtactgtgcctagttgcaacttgcaactttttgatctgaaatatccgctgctttaatatgtaatcttcaacttccaggtgctcatcataagacaaaacacatgaatcatgcctattaaaacttttaactgttggttggttcaatcacatgagaagggttgcacgccaaaagcacgcttatctacccagaagtcacggaatacaccatggaatcaagaaaagcagaggtatcacctttagcaatttgctgacaaggaaaagcactaatgacacgacgagcgaaaacaacttccaaaagcacccgaaacaaccgcacctatggtaaatgacgtttgccatctatcaatcgatcggctctactccataatccatatcctaatccaggaagaagaacataccgatgaaaataattaaatcacgcatcaaactttcctaaaaacttggagaggaatcgatcggaaccagaagctaacgcaggcagaagaagccactaacgagtactagtaagcaacaggccatttcatcgaatagctcatggtcatggacagcaaaaaaaacttggtcagcgccgagtggacgaatatatctgcaaagcaatcagctgtttatagcagaggggcgaaagaaaaaaaaataccagcgacgtcctggccgtcgtagacgccgcggtggacggtgccgaacgtgccgcgggcgatgacgcctctgatgacgagcttggcggggtcgatctcccagtcctcccggcgccgctgatggtgcggcgcctgcggcggctcctccccgagcccgagcctggcggactcgccgcggcggctcccgctgcccccgtgctgcgacgcggcccgctccgcggggcggccgaggtggcgctccagctgctcgtcgaggctcttgaggtcgatctggtccgcccggacgaacccggcgtccccgctcccgcccccgcgccgggatgcctcatcgcgctcaaacctgtcgtcggagctagcgatcgatcgagcgagctgggggggttgggttcggtggcccggggtgggtggaacgtctctgtactctggtggcgttgtggatgccgcggcgtggtggtggtggtggtcgcggtggctacaggggaaggggacgggttggcgaggcggggacggaggcggttcgaggtcgtcgtgtttggggagacgacgacgactccatgtgagagcgcattggggtgtggggggaaggcgaagtactaggcgcactaggagtaggccagtgatgatgacaacttgacaagtggtgaccgaaggagactcgtgtcgcgggggtggggcccgactggagggggggtcgtcagggagtcggaaagtcagagctcaggaggtttcgtttgtgtcattgggcccatttggcatctttttcggccgggccattggcccattagcatctgatttcgcataccgtgtgaactgtgaagtagtatcacgtgtgagttgtgatggcgtgagtctcgcgctgcgcgcaaaacggtgcggccgttttttccgaatgttttgctcccttcaaatcttttccagtctacatagaatatataggagtcttttcttgaactagtagcgggtgcactactacgtagtactatacctgtacaagtgtaatgt

SEQ ID NO: 43010 - DNA, 29772 bp, Oryza sativa
atgtttgcaaattgcaatattattatcgttacgtaggtgttttagtactgttaaaacctgtaggaaaattgcctcccacgaaaatctacagagaactgaaatgacagtagaaaaattggaaaaaaaagaggaattgtttttattaaaacaatcgcttgaaagtggtcctagaaccgtagttttattctaaaacgttccaaagagagaaacgtcaggctttctagtcggaataagttcacttcattacccatttgatcgaaatctaaaccataactctaaactacaaaaccagatatctcgatcttcaaactcctaaaaccggtgtaattggactccctgagcggttttgggggacggttttgctgacgtggcgccatgtggcgcctacgtggcaatattgaccgagtctttgttacacgtggtgttgatgtggcacctacgtggcggtagaaataaaaagtatgcgtgggacccattagtcattcacacaaaaagaaatgtgggcccaccttcttcctcctccctctctcccttctctctctttctttccccttcttccccttcggctggtggcgcgcggggacagcgagagcgagcggcgtcggcatcgggcggcggcggcggcggtgcgggagaggagctggacgaggaggcagtaggcgcggagggagtggggggtcgacgacgacggcgacgaggaggcggcccagtagaagaaggtgagcgcgttcctggcgacgagctccggggaggagaagtggcagtgcttggcgaggagaggaggacggcgtcgacatgatcggcagcggggaaggcggcggagagcgcctccactgtcgctctcggatggtgcgcgaggtagtgggagatgcgccgaggcgtcgtggcggcggtgacgacgatagcgcacggcggaggaactcgccggccgtcggcacgcaggggaggaactcgccggccgtccgcgcgtggggaggggctcgccggccgtccgcgagcgggggaggggctggagctcgccggtggtagggagcagcggcgaaggggaagaaggggagagaaagagagaaaagggagagagggaggaggaagaaggtctgacatgtgggccccacatgtcagtgggcccatatttctttttgtgtgaatgactaatgggtcccacgcatactttttatttctactgccacgtaggtgccaagtcaatgccacgtgttacaaagactcgatcaatattgcacgtaggcgccacgtagcgccacgtcaggaaaaccgcctctcaaaaccgctcagggagtcaaattgcaccggttttaggagtttgggggtcgagatatctggttttgtagtttagggtcatggtttagatttcgatcacatttgagggtcatgaagtgaacttattccctttctagtcctgtaacaactttctacgtaaaattagagcccacgaaggcgacaattctggcccgttacagcgcctgaagaacagaaggcctagacagcagtcttgggccgcatcgagccatacaagcccaggaaataaagcagcccagttcaattctatcctgttactactaatttaatcgcgagaaaaatccccagcgggagagctcacgaactgttcccttcccatggcggcgctgcctctcctccggtggggcgcttcctccctccgaggaggccactcctccgctccgccttcgagccgcctcttctccgcgctccgccgacctcccgccgccgcccgctgcgagcccggctcgagggtcatgctcaaggggatggactaccctgagctcgaggtaagagtactcctctcggcgtacgagttccgtggatccgtttgcgagttgttggtcggaggtttccgttaagcttatctggcgcgctcttccgcagaattgggtgcggtcgcagggcttccggccagggcaggccatgatgctgtggaaatgcctctacgggaacaacgtatgggcgcattgctatgacgagctggctggtaggtttcagtgtttagttgttatgccacggactatattcgctataattttgcagtctacaggttaattcctctattagtaaccttgagagcacatatatactacaaatctacaatggtgtctatcctgaaggaaatgaatgccaaattgtcaactgccaaggagataaaatctactcataggatttctgaagttttgatgtgtcagcaaagttgtttatacatgaaaactgctaaattagaagtaggttagtggttctattcgaaagtaaaaaaacatgctactccttttagtctgcatgtacttgttgcattatgttcagatgtgcattttctgcaaccttactaccttcgttacagatcagttcagcatatatactttatctcttgctacattatgtaagcagcaaaatctaaaaattcgtcataattcataacagtagtatttttaggggcggattgaaaaccagcggcatttgatctaacttaacaatggtattagcgtttcagaaagtcatgctccattagtgttattttctgaatccccacataaatgtagattgattttgctatcaaatatcaagtagaatttattttcgacaagcaaaaccagtaactttaccaaagctttacaagttttaagattagctgtgatggatttatattgcaccattttgtctttcttgtttttgtgtaagggtgtattccagtgatccagccaattggaacctacaagtggatttagcaattatcttgtgtttctttttccctttgtaattttggttgaatgaatctgatcgtttgcatctaatttcatccaggtttaaacaaggacttcaggaaaatgctaacagatcatgctgatcttaaggcattaactgtgaaagacattcttaacgcgtcagatgggacccgaaaggtagtttcttctgtgttacttatatcttctgtactatcttcagatcattgattatggaacacagaatgctacagatactgttctctcttgaagatggatcagtgattgaaacagttgtcattccttgcactagtggcaggacaactgtctgtgtttcaagtcaagtgggttgtgccatgaattgtcagttttgcttcactggaaggttcgtttacttcttttgaataacacttaacttttcaatgattgtgttggtgataattttacagcgttgcttatattttcatgctatatctgtaggatgggcttgagaaagcatttgtctacagctgagattgttgagcaggctgtgtttgctcgtagactgttttcagatgaatttggatccatcacaaatgttgtatttatggtaagcatcctcctcatggtaactaatggctctagcttttatggtcgttgactgagcagctgactgtatagttaattaacataattcactttgtagtttacatcttgaatctgtatatatctatctttaacatgccaatatttttgaactgtcgaacatatccttaatgtgatatcttgtgccacaactgtcaagataatcatatagatatgtttttatgcactctgttttcttacaacatccccctgcttctgtctgtatttcatctcaatggtatcaatattaactgttgttaaaattcaattttgttaacttgttacattgttttggagaactgtgttagtttaactattagtcttatcatgaactcatgggtgtttaggtttgtaatattcactggcatataacagttaattgattgtctgccttgcatttattcatatgatgcttgcagatacttctacaacctttcattaatatcaaacttttacagggcatgggtgagccgttgcacaacattgacaatgtactaaaagcctcagctattatggttgatgagcagggccttcagtttagtcctcgcaaggtcactgtctccacaagcggtcttgtcccacagataaaacgcttcctacaggaatccaattgtgcgctggctgtgagtcttaatgcaacaactgatgaggtgaaatccagttttggttgttgtgttgcaaaagtggtttggcattgttctgttgtttctataagtctatactatctttttcttaggtgagaaactggataatgcctattaatagaaaatacaatctcagcttgcttcttggcacattaagggaggaaattcgtttgaaaaagaagtacaaagtgttttttgaatacgtcatgcttgctggagtgaacgacaggtgaggaacctttggattatacaaaaatttccctgattgttgttggcttgtggcaattatgttatgaagttgtcttgaatattatttcttaatacttgcgtaaaactgtttttttttcttatttggaggtattttacatataggccagaataatttagactataattgctactcttattgtaatcatctgttcatagggaattacttgtatgtcttggaaataaccttttttgtccttgcaataaaataagttaccccttggcccttgtatgattgtatcattaatatttctgtggattactatgcttacagtgtggatgacgcgaagagactagtagatttagttcgcgggatcccttgcaagatcaacctcatctctttcaatccccatagcgggtcacaattcaagcccactcctgatgagaaaattattgagtttcgtaacattttaattcaagatggccttgttgtatttgttcggctcagcagaggggatgatcagatggctgcctgtggacagctaggagagcctggggactaccagctacccctgctccgtgtacctgagaaattccaggtcgctttgtgactctaaacagtaagtacggtactacaatcctcatagatattgtagaatagctttgacaaaagacatgtaactttcatgcggttcttagaggtcattctctgggccaacctgacgactgacggaatatttttgttactttctttaaggaaaatttttgttgttactacaacaagacagtgtcttcagctggcttatggcatgtaaaagaacatttaggcatagtgccgctaatctgctaagtaccaaaatccagtattttccatggatgtgtgacgcttcatctctccctatccgaattgccattggattttagcaatatatgtctgcattaatgcttccactgtgcaatacaaggagataaacctaaatcatgcaactttcaagttcatggcatttaggcactttgcatagttcctgattcggcctaagtcgtcaaagttaattctttggttagtgcaggtatgacaggcatctccaaaaggttttacaagattgtgccttgcttgagataccttaaccattaaggtgtgcatgccattgccacgacctgaccaccatacggaaggaaaggaaaagccaatctagcgcaaaccccacctgtaaaagtcacttctttccaaaagcaactctattatgctgcacatattgggcgtctttagcactaatctgctgccgaactggcagtctacacgtctactcgttgctttagcagaggcatagattttgacagttgctgattttgtatatggcctagtttagttaccaattttttcttcaaacttctaatttttccatcacattaaaacttttctacatacatataaactttcaatttttcatcacatcgttccaatttcaaccaaacttttaattttagcgtgaactaaacacaccatgtctgttctcttctgcgagtggctcttctttcaattatattttcggcactggattcttgatatttgacacaagctttaatatacggactacgtgttcatctcctcacctgctcaccagttttagcaggaccgacatctgctggggagccttggcgacaagggttgtgacatttgctgttgtcaagtccactttgaactaattcttttcttccatgttaaataaaagcacaaccttttcatgggccccccttgtgaaacatcctctattaaattctggtttcagctgctcaaggcacctagcaggagtacttgccctccaggaatccctccctgtctaaaaaagaatcattctacatgccatcactaaaacactatctgttattgtttatagcggaggcaattattaaagagtggtcctgttcgatctgctgcatttgttttacagcgattatacatcctcagagatcatttctttggacaaatatggtttacgaggtccatgacgtacatgtcaaggcagcaaaacataaaaactgacagcaactcatgttcactacagggcccacaaaatcatctcaaaccggatggattagcggcctcttgtgcgaactactactgccaatcgcacgtcttcacgatgtctgtctctactagggagtatactggtcttttcctggacagaaataactccctgtccatttcgctcctaatatcatacaatcgttttgacccttaatttgtagccgtcaaagacggctccaattcgcctaccacgacgatgacatggcaattatttacgggtaataattccatcatgctagcaaatccaaacttaaataagagtatagaataagcttgcgttctgtcgccacctagatccgatcatgaatcatgatctgattaacttgcatcacacgcgtatcctaattctatcaagaatcctcgcaaactgaaaaaaaggaaaaaaatctgacaagaaaagaagaagaacaggaagttgtacacgcccaaagatctgtgacgttacagagaaataaccgtgataatctcaaatccaacggcaaaatcttggatgggggaaggaaaagcgaagtgcggtgcaacgtggaaagcaacacgtaacctctccacccccgtgcttaacacgggcgcccatccctcccgtcggatccgcctccctcccgtgtttgcgccatgggcgagaccccgcgtaccccggcgccggataggccgccgcctcccgtgccggtgcgcgttcccgtgccagagccccagcccgagcccgagacgccgcaggcgtcgccgtcgccgcctcccgcgcccgatccgccgacgccgctgttgtttccggagtcggcgccttcgacgccgcgcgaggagtaccacacgccgccgccgtcgctggacgaggcgcgtgacgaggcgctggtgcctcatcaggagggcgtcgtcgacgtcaacgggggatcggaggccgccgccaagagcccgcagctctcgccggtgcggctccaggtgtcgccctcgccccaccggttgctcccgcctgcgccgggctctcccgccgtcaacggtgaagatggcgccgccgggacggcgcaaggccgccgtccgggacgcccgcaacttcacctcgcgacgggccgcctcttccggacgccgtcgcaggggtccctcgccatgtcgtcgccctcgccgtcgcctacgccgccgtcaccgctgactccagcgcccgccaccaccgcgcccgcacccacgcccacggccaaaagcaagagcgggcagaacacgccgaagcacaaggaggcgttgaagccgccggccacgcccgtcgcgacggcgatcgcgataccgttcaacccggccgaggaggccatgacgtcgcctctgcggatcggcaacggcaaggccgcgcggctcgaccaccagcacgggcccgtggcaggggcggcggagaacggaggggacgtgccgccagaggtggcggccgtggccgccgtcggggagaggaggacgacgtcggtggcgctgcgagtggccacggcggtgctcagcctggtgtccttcgcgctcatggtcagcgcgcggacgtccggctgggccggcgaccactacggccgctacgagcagtacaggttagcgaccacttttgcctagatgctcgttttttttttctcttttgtttgtcacgttttagtcggatttgtccgggttttgacggttacgggagttggtacttgtaggagtagttagtatctgacttcttgggagttggatttatttttctgtcttgcaattatgggggttaattgaaattatagtcgttcttactaaattgattgttcgagaattttcgttactgttccccattggtttttgtcattttgctgtatacaaacgtggatactggttctgggaagctatattctgtactcttgttcaatagtacagagtagtatttcacgtgctctgcttgaaattcagattttatcgtggttgatccgttgatgttacgtatgttgtgcaccgatttttgaaaaaaaaatattgttgtacaaatagaacttgcgagtgaagattaagaaaatttaaacacctcgtgaatgcagagatacttgttttgattcaggtcgcttagaggtagaacacaatttcagttttaggttaagacaataatcaaacggttttctctgaatttctaaactagctcaactctacactaaacagaggaacatagcttcatcttttggtggtttaataactttctcttctccccattgaacaacactaaaacttgcaggtacgccgtcggagtgaacatcgtcgtctgcatctactcgatcgcgcaagcgttcggcgagattcgccgcctggtttcgccgaggtttcttttccggagcacctcgagctactacttcagcctcttcctggatcaggcaaagccccagcctctcatccttcacctgaaatgcgccattccaaagcagggaaagcagaggtgtttccggtgtctgaccatctgatcttcctggtctcgctgcaggtgttggcgtatctcctcatgtcggcctcgtcggcggcagcgtcccgcaacgatctgtggatgtcgagcttcggcaaggatccgttcaacaagaagatcaacagcgcggtgtggttttccttcatcgcgttcatcggactcgccaccaactctctcatctccacggccaatctcttcagcatgatatgatacgtacggccatctctcaagctgatttggggatgtggagtacttagtttccatcgtgtaaatttttgtggcacatatacacatatgttctctgtctagggtcatgatcaggaattcatttgcacacacacgactaataaaatataggataaaatatgttacactgtttcatgattaaaatatgttacactgtttcatgattaaagaagcttgatgtgtctcaaagtcctttctttgcatagcattgctagggattactgttgcaaatcaatcgctgttgagatgctacaaattaattatctgtaaagatgtggtgattatatgtaacatctaggatagcacagtatctgagagactgtagctgctggaattggatactattccccgtccggcaacaggaacaaaagcgacggtgacactactatctgacaccactatagtgtgctgttctctgttgatttcgtccaacctacgacttctttaatggatgcatgcataattcataattgcatatcgtttaagattctggccagtcttctccaaaacttacagagaatcttgcgctgaaccaagaacgtacatttctctgaccgaacacaagacgcggtctctactcgtggagctcgatttggttcactctgctcagccagatggagtgcaggatcatgtggaagaggtcgtaccggaggggcctcgcgtgccacaggaaatgcctctgcagccgcttgacgcagccgtgcatggccacgtacttccggagcgtgatcccctgcagtatcttcttcaggtccggtacgtccttctcggcgacgaccaccgcgaaggcgctccagtccagcacgtcgctcagcggcagcacgaagttgtcggcgatgatcaccggaacgcactcgtagtagagcgcctccacgatccgggggctgttcacctcgtaccccatggggcagaggcagaagcggctgttcttcatgtgctggatgtagctcatccgccgggacacccgcgccgggagcggcccgtacacccgcatgtcgtcgtcgcggccgtcgccccagtgcttgaggagcaccggcctcaccctgccgtgcacgttgccggcgaagaaggcgaggatgccccgccgcgacaccggcagcccgccgacgtaccggagcggccgcctcggcgtccggatcgtcgtctccgggagtgacacgtccctgcccggggtgaagatcccctccgagctgtccgcgttgcacagcgccttgacggtgttccggcgcaggtcgccatgcgccgtcgtcgtgtaagatccctgcagccattgccaggaaccaaaaccaaacacgatcaaaactgcaacacaaaaagagagtgaaaaaaaaaacatcaagatgttggtttacccaatcatggcaggcgacgaggaaatggtcggcgcctctggtgcgattccagaacgggtacttggcggcgaggcctttgacgaagtcgcggaggtaggcggccagcggcctgaggttgtgggagtcgggaacgtagagcgagatcctgagctgctgggagctgtagggaaggtagaagaggtgcgccttggcggggtcggtgacggcgaacctccggctctccttgaggagcttcatgaaccagccctcggacgcgtagatgccgctgaggggaggcgtgtggaagatgggcctccggccgtcctggtaaatgtaaactttgagtatccgttccatcagttcatagctcctggatgatcacattttcgctacaattatgacaagcttagtcaccatactgaattatcagtggtacaaaaatctgtacaaaatgcagaaatattatggtttgataattatcagtggtcaacataatgtacgatgccgttgactttttcaattaacgtttgatcattcgtcttatttaaaaatttataaaaaaaatatgtaaaaatataagttaagattataatttctccgatgataaaaagagtcacaacaaaataaataatagttatataaattttttaaataagataaatgatcaaatgttatgtaaaaaattaacaactttgtatattttaggatagaggaagtaatatacgcagcaaggaacgcaaatcgggagacactaacaatcatgtatggagatgttcacaattccggattttctttttgttcaaaaacaatttcgaattgtgattttggggtgggtaatgttttcctacgacgcaaaaataaccccccaaatttattcgaatttcatgaaaaatatttaaatttcaaaatgtttcattcaaattacaatggttatgtaaattctcgctaaccatagcttgaggtttagcaatagtagtcattcgtcccacaaccttatgtaaaaattatctatagtttctttgaagaaaaggctggaatgaatttcattactaaaaaaatgatcaaaatttctaaagttcaatggaaatttctaaatatttgttcccctgaaagtttcccgttccgaaatagtgagcctcttgggtacaaaccacggcccattgacttgtctgatctgacatcacaatttcgtttaaaaatataagacactagatatatttatgatacattaattttcactaaaatgtagtcaaatcagtattatactgtaatatatctatattttcattttaattacactataaatttaaaaacttacaatataattacactgtaagttttaattattaatctatatgttttccaatacacactatataagagaatttaagatataaaaaaattattacctccttgaaagagcataagggatagaatgttagttgttacacacatatataagatgtatagccatcaacatagtaaaaaacgatcgaaatctagtaaaaaaaaatacacgcttctacatgtccggaaatccagagaaatagaaaaaaaaccggcaactcgatcatcctgtttatcaaaacatgctagaatgagacgaactttaatttggtagctggtgcgtgaaacgaggaacggaagaagaagcgacgcatgcaccaataatattatacctcttgaactgggagacgttcttgaagagaggcgcgtataggtcggggtcgtcgatcaccggcccggcggccattatctccttcttggcgtaccgcagtgcctcctccggcgccatcctccaatacgacggctgatcaccagttcgacgcaggaattaacaaactcgatcgatcactatgctaacacgaataaataataattagatttggatcggcctctgctcgatcgatcgcgtacctctcttcgtcgcggccttgcagcaggtgacggtggcgcgggaggaggaggagacggcgtcgccggtgctggaggaggcgacgagggcggtggcggcggggagatcgcggcggacagtttcccggtgaagtctgtggcgggcacgtggggtgaggatgggagggagaagttgaggagcacggtggtggccgcggccgccgcgacgagggaggcgatggccccgatgcgccagcaggagacggagaacatcgcgccgcggcggtggtggagccggcggcgggacgggccggcggggtggtgcgcggtggcggtggcgaggcgctgtggcggcattgggtggaggaggaagcgggaggcatgaatgggtggaagagcgcgcgcacgcgcgggctggcgagcgtaggcttgcgcgtggccgagtttgtagagaaacccgaggcgcctacggaccaggtgctcgattttttctgagaaaaataagatgcccacgatatcaaatgtgatcatacatgcatgcatacatgcaaaacttcctagacaaactttaaaactatttttcctcttaaattatttattcaaatcatggtcggatgacaccattaaatccgttccaattaaatctttaaaacagtaccatacatggatataatccgataaaaaaatatttagcttattattgaattatttttaaatgttgcatgttaaatcaagtaaatcagaattgtttcgctaagtagatcgcaaatgtttcattttttttaaaaaaaaactgaaacaaaaccaaatcacctcatgaaacattttactaaaatatatgaaacaacggtttctcaaaaaatggggttgtttcaccctgcgtaaaaacaatattttagcaaatagcgaaatgatatttcaattcactgcaacatttgatccatatatagtgaaacattacgagtacactaagtgaaacatttttaatggaacagaaaatgaaacggattcccttaatagggggtttccataatacgtgggtgatttgttgcaaaagaatattccaattcattgtaacatttgatccatatatagtgaaacattttttgtgcataaaaaaatgaaacgaattcctttaatagagggtttccataatatgtaggtgatttgttacaacggtgtgcgtggtggggacacgtggcgggggcggcgcgtgcgcggggccgcggaggagtgcaggcgctcgatgcatccacgccagcatcgggggcccaatttgaggcattttccagagaaaccaccgcgatgcgcggctgccactgtatttttctcttcgacactcgatctcttcagatgggccgtgtgtgggctgtggcacggggtgggaggattctgggcttctagcccgatttggtctgagagatcgagactaactggaatcatagaatatgattatataactttttttacacctggagaatcaaaatgacaaaatctaacagtgaatagttcgtgcacaatccaagcagatttttttatcccctccgtttcatattataagtcgctttgattttttttagtaaaacttttgtaagtttgaccaagtttataaaaaaatatagtaacatttttaacacaaaataaatagattattaaaatatatttaatgaaatatttaataaaactaatctggtgttgtagatcttgttaattttttttcataaacttagtcaaatataaaaatgtttggctagaaagaaagtcataatgacttataatatgaagtagggggagtagtatcttttttctcggtgtatgtcaaatttggttatgcatgtttgtttagtgttcagctttttttttaaaaaaaaaaacatggacaattatccctaccctcggtagcttacaagtttatgcccatccctggtctagtacaatttctttaattttatcccttgatctcaatcaccatgctatgattttattttcatcaatttcttggagttgaattgtaaaagagtagaatattataataatggtgtcttttctcctcttaaaagtgttcttttccttcttttggatatatagacctatctgtattccctcaaatgaagcattaaactatcgtttggtacaccctcattcagctaggcaaacacatatgcgaataattttcaatgttattgaacactagaaatacaagtcgtcttagtggtgcgatctgtcggtgagcccgggttgcctagggtcatcgggccttggatccgccccctgcatatataccttatattgacactctcttaaaacacaaccattgccatctctatatgtgtctaacaagaaccttgaaatgtctaccttgcttgagatatcttaaccattaatgtccgaatgcttgtcatttgtaaccacttgaacacctagagagagaaaagtggcccagggctaatgtgagaaaatttagtcacaacaagataactatcttgttgagaaaggccagatgacatagcttgaaggagattagggttctagaaaagaggaatagacatagactagggcacagatcattggaaggggaatcgatcgattattcttgcttcattaacgaagatatatatagtaccaaaccttttaaaggggtgcctcgatttgtccctaagataagtactaatttctattaggcaaaatttgttacaggacacccaaaaaaagtgtaattagctgtgggacaatgcaaagacgtgaatttgcccgaggacacttcaaaaatgtggtaatttgctgcagaacactaaacgcattaaaatataatatccagtcaatggatgagagagaaagcacataaaatggtaattttgcccttatcttcttcttcctctcgtccttgcccaacatagagtagagcctcctcagcttgtcgtgtggggcgcgcatgggcacatgcaccagcggccgattgcctggaacccctccacgcaggcctacgactgggtcggcttcacctgcgacgccaccaacgccaccatccttggtctccgcccacctagcgtcagcctcatcggatgctacgcctctaggtgctctcccttcgatgcaaccacctcttcggtgatgtcccatgtgacctcttctccctccctggctccgtcccgcccgacgtcgccaagctcacgggtgctccaacaccttgctcgcacgcttctcgccggagtccttcgccgacaacctccagctctacgataagcagttgagccagccatgcgtgcgagtcgttcttcccgtccccactaccctctcctgctggcgcgccgacggatagcggtcgttccatgctagtggcctataaaaagaagtggaaatgtccggcacggcgatccacaacagcggtgaggagtccgtggcggcgggcgtggcctgcgaccgcactcacaacaggggacgcacgcgagaggatagtcagaagaagaacgagagaagggagaagaagataagggcaaaactgtcattttacgtggtttctctcttatcaattgactagatattatattttaatgtgtccagtgtcctgcagcaaattaccattttttagagtgtcctcgagcaaattcgcgtctttacggtgtcccacggttaattacacattttttaggtgtcctgtaataaattttgcctttctattactacagaaagtaatcaatctaattttatcaatgaggaaactaatctgaccaaattgcattgttggtgccttgttattaataaataatgagagaacaatcaatttggttcctcaacatcgcttagggtgaccttgatctctaacatgtctttaggtgaatgtggtcgttgaactcaccttacacgccatgctaataacaaaataactcaagaaaaggttaatgttgatctcaatctcaatgttaagaatagattatttttcatccttttgtgtcttcattcaagataaataaagcctactactttttccatttcaaattattgtcattctaggttttgagtccaacatttttaattttttagcattaatttctaaaaatccgtgtactttaataacataataacatgtgaattagatattatggtttgccaacaaagcttcgaagagttgttttctacatatgacatatcggatgggctcaagggcagatccatgagtactttgtacgggttcatctttttcctcctccagcccccctaccttcttcctcttcctagcccccctaccttcttcctcttcctcttctgatttttctgaacttttctatttttatctttaaacatgaaccctttcaaaaacttatttctaagatctgatctttttgaccacgtcagtcggactagcgtggtaaaacaacaccatcaggctagtctgattagcgtgaaaatgttatttgtttacgtcgatttggctggtgtggcagcgttatttgactatgccaccctcgctgacgtgacatgacaaaactgtcacgcccgttgtgtatggcgtgtcagtattattttattacaccaaacaggctggcgtgatcaaaaggttcagattctacaaataagtttttaaatggtttatttttaaaatttaaaaataaaaaaatgatcttctcttcttccccctcccctgtctcccttctctctatgcggaaccaacaggatggggcggcccccaacacccacctttggatccgcccctcggcaggctcatagactaagggcctgttcagattatagccaaaataaatcttacctaaaatttgggcaagatggcaatattgctaaaattttggcaggatttcttatgtatttaccaaatttagtaacaaactaaatgtagatatttttttagcaattttacttaaaaaattgtatatttgaaaatgacaacaatttgaacacgctctaagataaaagaaacatccggaatcaaagtgacttcaggctggtttggacagagaaacatccggaatcaaagtgacgtcaagaccaaactttcaaggacgaaattgactatgttaccaactataacgaatgtaactttgtccttgcactctaaaaaaggtggcacggcggagccaacggactcctctcgggccgtccacatgatgcacaaaggcaaccagctgtaaaagtatgcatgcaatgcttgtttctgaaggaaaatccattgtactgctacacatatacgggcctgggagtctacacatctccacacaccttgctttagtggggacacagatttggacacatttcagatcatatagatacatgatgatctgatcagcagttttagcagtagtaaaagactttctggtttgctagaaagatgtcgacattttgttaatctcagtcagtttcctgtccgtgtccgcttgctccacacgtataggtatagatctttagttgtttgcctattttggtctgcctgatttttttttccgtggcggcatattataccttttaactttacattaaaaccttctccgggaatatcaagcatagttcatagcagcgcttgctgttttaagatatgtattattttttttacatgtgatttggttgggatgttatttgttactatcatgtggagtttttgcaggcccgttttaaggtgtgaatgtgcttgttttttacaatatatgttcgttagattgtacttacatctacttatattcacttacatatataattttaagaatttacaatataaatatatgccgactattttttataaaaatacgacgacatatatagatagttcctaaaattttgctctgcatggtgatcatgagcgacagatcttgttgcatgtcaagtctactctagatcaattcttttcttccttaacaaataaccgtacaatacataggaagtactaattaagtgcatcctagcttcatttaattctcattcaaggcacccactcttctcacatactcttcttgtcctaaaatatacagtcttaggataggaggactacgaatatggatatatgaatataatcccatcatatcctagattgcagtatattgggacgaaaggagtagtgacttaagaaaagatatattggacataaccttgtacaatatatcaagatatccttattgtaataggttatgtctgatcaactcctagattttatatttcgggacaggaaagtaatataactgaggtgaactattgtcttccctagtgatttgtacatgtcatccaaaatgtaactaaaaagattttttttttaaaaaaacaacaagatagataaatataaaatatatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccctccaaattaaattcctccgcaaaagtctagtttgcctccctgggttcgatgggccgaattccgctcggcccatctctccccggccccctctctcccgggcgccctcgccctccttctccgccccgcccgcgcgccgcgcgcgcgtgcgcgtgagccgccgcgccgagcgccccctcccttttccctcgctctgtcgcgcctgcagccgtgcagccgctcggccccgcgagccagcgtgtgcgcgccagcgcggacgccgcccgttgcctcccgtgcgcgcgtgccgtggtggccgaccgcctggtcgccgccgtcgtcagcgcctgccgcgcctgtcgctcgtgtcgccgctccgctccataccgcccgccgtcatcgccgtcgtcatcgcccggcccccgccactccgcgcgcaagccgccaagggacggaggccgagccctcctttccccctgccgcgtcgcccccgctccctcctccttttcccgattcggcaaaggggcgagccccctttctctccctccttttccccttttctccatttttcccctctcgccggcgtcacctcctgtcgccgctttggacgctagccggagtgccagctcgccggcttgaccgcccatgtcggttcctctctcccaaaccgacattgccgcccatttaaacccgtcttccccctcccttcctttcctctcccattcgtctcctcgccattgccgccgccccgtgctctgtctcgcctccgccgtccttcgccgagcgccggaagagccggtgcgttcgaggacgcggaaggggacttcggccgcgccctcttcttccttttcctcggcccgaggccggagagatcactcccgcgccgtcggcctctcgtcacagcgcccctcctcacctcggtagtgcctctctccgttcttcctcctcgctccatctcctccccctagctttcggtagtagcttgagtagcctccccgtagttagccggcgccgccccgaccgttgccgtcacttgccgtgtgctcaccgccatcgccacccgagctccatagcacccgctcatcaccagtctcactcagcatagttccacccaatccaacgctagcatcgagttcccaaagccacttatatgctctcaccgccaggaatcaacctctcatgacctcatcaccatttccctcttctcccgccatcggttgccgccgccgcaatccggcgccgtcgagcaacctccggcgaatccaagccgttggctcgcctccccttgtcacgtgcaaccgcccggtgtgctcgctgttgcccgtatcaccgtggttcgctccgccgctcgccgctgtcgtccgccgtccgttccggccggcgtcgtcgtctacctcccgccggcccgcgtggctgccacgtaggcgccacgtcggcgccacctcggccgcgaccggatcagccgacccggccagccgctccctccgttttttccccgtgcgcatggtccgcggtgagccgtgaggctgcgcgtgggcccgccgcatccgttcctccgcgaaccgcgcgcgtgcaccgcgtcccagctccgcccgcgcgcgtacgccgcaaattccctccgcacggtgagccgagccgctgccaagcgggtcccacccgggaccgcgcgtggtgagcccggtccaccggactctctctcctccctcccgcgcgcgcgcttgggccgtcttgggccggccggcccgttaagatcggccggtccgctccatttcccttgggccgcgccctagccgcccgagagaagtctacttctcctccctcttcctttttatttttctcaaaaaggatttaatttaatcctttttcctttagatcaaaaatccaataatcttagaaattcaatatcttcccaaccgtaaatccgtttgactccgttcaacttccaaaattccccaaatctcgagatctatctaatggcacgcttagaggtcattaatagggctttatttttttcgccgtttgttgagttgtcccgtttcgcgtgtagtttcagagcccgaagacccgcagtgcgaggatttcgaggatcaagctccagatctcgagcaaggcaagccacctttgaacatcttgaacctatatttgaaatttaattatgttgcttgaaaaaaaatattatgcattgataggatcgcacttaatctgctgtcccgtctgcaaggcagattggcggacttacccaatttgttgcatttgatccttccattgttaattgctatatctggtccccttgtaaccatctagttgcgtctcgatattcgtgcaccccgtgcgagtatcgacggacgccttcaaacttaaaatctgaataccaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagataagtacgaccacatgggtggaatgggacacccctggctgagtaactagcttatcaggggagccttgatgccgagagacatgtggattcaccggggtggtgtcggggaggacccctgggcttgctggcacagtatggtctgggacctaccctgttgttggtctgggacccctctcgtcggcatatggtaaacctgtatcggctttcgaaatgccttgtcatgaaagcttggaggtctcccgacgtggctgatcccctcgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgactactgattgtgaaattgctgtcgtgaaaatgggttcgacgtctgaaaaatcagcagctgacgggatcagctaggcccgggtggccgtttgaaaagttgttggcccgggtggccgtttaaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttatttcccctggcttgctgagtactcccgtactcacccttgctctagataaataatcccccccagttgctgaagaagatgaagcggatcctgttgatgtggagttcttccaggagcaagccggctacgatgagttttagggtttcggcctagttcccaagtcgcgcctgtgatgattggtccaagtcctggcttccgtttccccttttgtattgcagttgtgatattctgtcttcctgtgataccagcactgtttcctgggactggtatcgattaacaggttaatttggagcgtcacgggctagttccagtcggggctagttcggggcgtgacaatatctttacaaatatacaactttaaatttgacatttacgaggagaaaaaacatatttgaatgcgaatagtgcattattcacaagaaaattgttgtttttatttttagttgtgtatgtcaaattcaaacttgcatatttattatggaagaacacgttttcaaaaagttatatgactatataggagatataattgtctacaaggatgaaaatactctcacctaatataacgaataattcacttgatgggcatgtcatcgcttattaacacacttgtgacattttgtgctctttaatttatggagaatatggtttgtgctcatggttgggatttttcttgaaacaaagccaaaatttattgtattatcggtggagagcatctaaaaaactgccgtaagtttttctagtaaaaaaatttcagatgtaactatagtataattgaagtgtaattacatgtagctgcactataaccagggtttgaaattttagtttgaaatttccgaaatctcgcccgaaatttcggtaatctcgccccccgccggcatgctcaaatctcatccgaaatttttggctttttgcaaatttttgtgaatttggtcaaattttattcaaattcattcaaaatcaatcaaaatttcaaataatttcgttccgaaatttccaaaatttcagtaacccttggcataaagtccaaatttgaaattgtcaaccttgattataactacgttgcaattacggtataacttacataaaacttgtattcaactgcgctttggttaggttaggtagtactgaaatcttatgcgtaacatgtataaaaatttctttccagcaatatttttccttcatgtataaatctcaagatgatccgatggtcataaatccgaaagttttaggggggaaaaaaacttgtggaagtttttttggcaaatccgctgtaaaagttacacgctcgtgatgagtgccgtggagtgctgtatatatagagatcgcgcagagctagctgcttttgccaacaaccaagaagctagctagtgatcgcgaagagatggcgtacaacgacgacgagcagactgctccgacgagcaccgccaccgagccggcgaggccgacggtggggatcacgggccaactggtgaagcaagtgcgtctcaacaagtaccacaacgacgtcgcgtccatggcaccccatgaccaggagctgctgctcgagctcaggggctcctcctcgtccaccgacagggcgggcctggacctcgtcgccgtcatcgacgtcagcggcagcatggacggggacaggatcgacaaggtgaagaccgccctgcagttcgtcatccgcaagctcagcgacctcgaccgcctctgcatcgtcaccttctgcaccaacgccacccgcctctgcccgctgcgcttcgtcacggcggccgcgcaggccgagctcaaggccctcgtcgacggcctcaaggcctacggcgacaccaacatgaagggcggcctcgagaccggcatgagcgttgtcgacggccgcagtctggccgccggccgcgccgtcagcgtcatgctcatgtccgacggctaccagaaccacggcggcgacgccagggacgtccatctcaagaacgtccccgtctacaccttcagcttcggcgcgagccacgactccaacctgctggaagcgatcgcgcgcaagagccttggcgggacgttcaactacgtcgccgacagcgccaacctcacggggcccttctcccagctccttggcggcctcctcaccatcatcgcccaggacctcgagctcaccgtcacgcggttccatggcgaggtcaccatcaagagggtggtctgggtggacgcggggacctacccgcagaccaccgccagcgacggctcctccgtcacagtcagcttcggcaccctttacagcgcagaggcgcgcagggtcatcgtctacctcgcgcttgctgacaagaccgcctcccctccgtacgacgccaatgtctgcttggcacagtacagattcaccttccaggcccagcaggtgacctccaaccccgatctcatcaccataaaacgcagaccgagtgctgcaccaggcgcggcgaggaagccacagccggtggagaacgagctggcccggcggcagcacgccgacatgatcagggcagccagggacatggccgaggccaacaagatggaggacgcgcggaacaagctggaggaggcgcggaaggcactggaggagaatttcaaccaggcggcgaacccgacggtggccatgctcctggaggagctgcggcagctgcgggggctcatggagaggcagtacctctacaacaaggagggccgcccctacgccgcctcctcgctcgcctcccacgaccgccagcgcgtcgccaccaggggccaagccgacggcgtccggctctacaccacgccgcacatggacacctacctcaagcaggccgagcagttcgagaagaaccccgacgaggcgccgccgcccgccacgaagcacgtcccggagccggatcaggtggtcgatcaagagccgccggcgccgcccgccgaggccgacgtcgtcccggacgtgccgcgagacatggcggcgggggacaggaggacgctgtcggcggcgctgcgggtggcggcggcggtgctgagcctggcggcgttcgtgctcatggctagtgtccggacgtccgggtgggacagcgaccgctacgacctctacgaacagtactacaggttattgcatgatcacttgcctgttgcgtctaaacatcatgcattcttaacatgcaacaagtctagatgctagcaatactcccttgtatagttgtatgtagatttatctcaaaattaagtacttcctctatattatagcctgggatggaaacggtcaaaaatcaaccattgccataatcatattttttttctcggaaatgggataaaacatgataaaaattaaaattaaaattgtatccgaaatatcgggaaaattgaaaaatggaactgtacgaacgaaaacatgttataattgatcggaaactagtaataacgtcaaaaacattaatttgtaaaatcatatttttacaaattgtctctcttttagccttgcacccaagtttggaatttcattgagaaattgatggtactctaaaatttggattaaatagagacctcaatcatggtattgggtatttaaaatacagtaattgctatattataaaaaggataatttcctcaataataaggtaaaatttggaaatagcaaaatcttttccattttttatttatattttttactgttttaattttcatctatgttggttacgaccggtagaacttggaaatgagagtcggtaggtcaggagtttccttgaccaagcattgttagtaggttttgtaaatattctacaataaaagttagggggtgtttagatcccaccctaaaattttacgccgtgtcaaatcaaacgtttgaacacctgcatgaagtattaaatataggctaaaaaataactaattacacagattacgactaatttgcgagacgaatcttttaagactaattgctctatgatttgacaatgtggtgctatagtaaatatttgctaatgacggattaatttggcttaataaattcatctcgcggtttactaacggattgtgtaattagtttttttattggggcaattgcgcatttgaccctcttttgaaaactacctaccaatttgacccccttttttcaattttgcttatttgacccttattttcagaattaaagatacggtatgaccctattctgttaagggctactaacggtgttaactgaagcacaaaaggtcccttttgcccttactcatttgaccctattacatgtgggacccacctgtcagttctctcttctcctctcctctcttctctcttcttcttctgacgccgcctccttcattcctccgcgtcgcttcttccctccggcgccggctgccatcgccgccgcccctccctcccttcttcgcgcgccaacctccgcctccctccccgctgcgcgcgcagatgccgacgccaccgccaccgccaccacctccgcagacgccgatgccaccgagagccgccgccgccaggcccggctcccctccctcctttcgccggcaccggtctccgcctccctccccgcacgccgatgcagacgccgccgccgccaggcccggctcccctccctcctttcgccggcgccagcctccgcctccctctttgcgtgctgatacagacgccgccgccaccgccgccaggcccggcttccctccctcccttcgccggcgccggcctccacctccctccctatgcaccgatgcagatgccgccgccgccgtctccgtcgccaggcccggctcccctccctcccttcgtcgatgccggcctccgcctccctccttgcgcgccgatgcagacgccgccgccaccacctccaccgccaggcccggctcccctttctccccgcgctgcgcgccggcctccgcctccctccccactgcgcgcgacgctgccgacgccgccgctgcaactcgctggcaggagagagagacatggagagacatgtggatagggttagagatgggtatggttttctcaagggtattttgggcattataaattttaattatatttcgttcttttttttaaatcaaatcttaacggtgttaagaaaacagggtcagacggaaggttcgtttttgaaaagcagggtcaaataagcaaactaaaaaaaatagggtcaaattggtagttagacttcaaaacagggtcaaataagcaattgtcccttttttattagtctacgtttagtacttcaaatgtgtgtccatatatctgatgtgacacgctaaaactttttatccctagatctaaacacagccacccaaatgttttcctggccatcacattcattaatgactaaggtccagggagcagagagtcttcttcaacctctagatagaatagatgaagaagcagaagagcaagtagaagaactcatcgacaacttgttccggcgatggtgcaacaacagtgatggtccgaaatccagcaaacacaacggaatagatttatcagggttagaggttgatgtgtaagggtggtcaatggaggggcagctttagaggatgaccatggaaggcaaggcaccgctgcccttgaccacagtagagagagaagtagattggttaggagtcgaataacggtggatctagcggtgtgatccccaaaggaactagccagttcctagcttcactacaaagtgatcagcttctcctttttaatttaggtgaataactaatctaatcctttaagtttcaccaaaggtttaatttggttcttcaggttttattttatccacatagatcactttactattcacccttctcatttcatctattatcctttttagttaaaaatattctctcttctccgccaatgtactatgacaggtatgccctcggtgtgaatctgatagtctgcgtctactcgaccgcgcaagcagtggtcgaaatcgggcgcctcatttcgccgaggtttgctgcttctctgaacccgataacctactgcgtcagcctcttcctggatcaggcaagcccaatacacacaatacatcggttcttcatttttcttttgaaacatctatcaacccatcaattcttctgctcaaaatgcgccattgcaaagctacggccatatttatattcaaacttttttctacaaactttcaacttttccatcacatcaaatgttttgatacatgcatgaagtattaaatgtagatgaaaaaaaaatcaattacacagtttgcatgtaaatcgcgagacgaatcttttgagcttaattacgccatgatttgacaatgtggtgctatattaaacatttgctaatgacggattaattagacttaatagattcgtctcgcagtttacacatggaatctgtaattttttttttgagaattacacagtacaacgcagacactcacaacgcacgcgcactcacccccatgaacacacgcacgcaaaccctacccctatgagcataacccctatgaacacacgcacgcaaaccctacccctatgagcatcttcgaagactgggcttttttgagaattacacagtacaacgcagacactcacaacgcacgcgcactcacccctatgaacacacgcacgcaaaccctacccctatgagcatcttcgaagactgggccgacaaattctgaagagattgacgaagtcaccacagacgcctctctatcgacgggtacgtcgcctaccactgaaaccacaacgccgttaaatcctagaaaattcgctctgtaaccactaggctacaggccctttcgctctgtaatttattttattattagtctacgtttaatattttaaatgtgtgtccgtatactttaaaaaaaatttggcacacgaactaaacacaacatacgtgttggagaagcagaagtttttcagcgcacacgcgcgcgcggctaattggtttcatttggctgcaggtgttggcgtacctcctaatgtcagcctcgtcgacggccgcgttcggcaaggagccactcaacacaaaaatcaacaacgcagtttggctatcgttccttgggttccttgcgctggccgccagcgcgctcatctccatggacaatctcttccgccgcatgctctgattgaccaggccgtcgacaatctactcacatgcttctccgatcctcatgcaaacttttaattacatatatttgtgcaaataagtgggacgcgtatgagatatacgttgttcttgtcgtaaaaaaaaaacattctttcttttctaattaggagtacacattggggcatttgtagggtatatatgcagatgcccacgtcatgagggcatttgatacttcaggcgtctgtagaggatacacacgtatatgatggtgtgagtatggcatgtcttagttgtgggcccaattgcactctctctctctctctctctctttttttttttgaaaactcaattgcactctcttaaaagcacatttctagtttgtaaggctagagtggctatatatcatatatgtgtctcaaaggtattgtttgttgtaacttgtaacaattaaaatggctaattgtttcaggaaacatatgcgatcatttagcctcatctcatcgacgctctcctgatcctacataatatgcttccataaataacttatactattttgtatacaattttgttgcttctattttcataaatataatctctatatttttggcagacaactctatttatgaatcttaagaaccataatttagaccccaccatgatcaaatgatgcatacatacatacatacatacatacatatacatacatacatacatacatatatatatatacatacatatatatatatacatacatatatatatatatatatatatatatatatatatatatcattttcttcaatttataacttggtaataatttctagatctttagacgcacggtgaatgtgatg

SEQ ID NO: 43011 - DNA, 10049 bp, Oryza sativa
tatgtttcaaccctcaatacagtttagtaatagatatctcccgataggatattaataaagtattcttttatcattagaaatctaatcataacacataattagatatttataaaaaaaattgtcggttcgatcttgatcgttcatagtcaatttttagttttttattaagacgaataaggtgtgtattattattaatatatagtaaattgcatattgggttatattattttaccttagatttacattgaaccattcttcccttaacgtttccattttacaccatactttgttgccaaaaggttacactttggactaacgacccacccaggggtggagctggcatacaagcagtggtgtcaccggacaacaatgacccatctattagttaaggtatccttctaatttttcaatgaatgacactagtaaattttgatttgtgacaccaacgtgtgaataattttgcactttcattagacaatttagcttatgtggacatggacaacttgacagcatcaacaaaataactgctagcaaactataatttatagttatttgaccatacacaacggctaattcaacaagactatgcacaatgtctaaataaagttcgtgcatcataagttttcttgagtgatttggtgaaacataggttgagcaaccactattgcgaggaattttttgtatttttcatatgtatttctgtttcacttaaaccatgatcgtcaattagagccgacgaatgacaccatcgacctaaaatcatggctctgcccctggacccacctgtcagtgaggttaaatagggactaaaaaacgaagcatcgtgatgggagcttgagagagcatatcgacctcctcttctatcactctggcgagtcctcatgactccaaggcaggcgcgcagaagtacgagcctaaggattgcacaagcagaagtcaatgtcaagcttggggccaatgctggcggagaggaatcgagtctagggatggcgtgcgaggagatcgagggtgagctagagaggagaggaagacaatggtggagaggatcgcgagccaggagacggcggggcgaaagtcggggtgacaggcgaagaggatctcaagcccagggactgtgtggatggaggtcgtgattgagcccatgccaagcgtgacgatgacgaaggtcaagcttgcgtgacacggtgtggatgtaggtcgagcttaaggtccccttccactcaagcttcattgacatcaaccttgcgctcgaggttctgctcccgtacaccggcattagcttgacctcaaccttgaccacgagccatcaatggagaccagagagatgagagagaggcaatattgacaagtgagccactggtcctaactgcaatcttttggtaagaaaatctggtttaatgcgaaagcattggattaagggtggtccaatctaaaatcatgataaaaaataaatagcccaatatgcaattcactttattaatatttagcatgctaatattcaacttaaaatctattgtcactctgtagctcacccaaacacttattggatgtgtcgctatcgacgaacacggaagacccgaaaatgtaaaccatttccattatcttaaaaaagttacatccacacagtaaagctcagttccatgggagttaacttgcaaacctaacattattcagataagcaaatatcggcgtgagggaattttagcccgctttgctcaatgtccgtgggtcaaagcagtgaacccttagtccaagactcacaattcaattctactagaaataatataatgttgttccaagcaataataccttttccagcacggtgcattggtcgtcaaaaggcagtaacatgttttctctctcgaccttcttcttcgcagccagaccaatcttgacccagtcatcaacgaagtggctaggtaatcaaacaaaaatgagattgcaaaaagggataggtgaaagaagcgtatttatacaacagtaattttattttaaattttaaaatgtttcttccttcttggccttgtttgggtgggacagattcttcctggacatgtaagtatggtcttatctgaatcctttgactgctttcagcatataaaaaacttgaaccgagtatggatatgttcacttacaaggtgttaggtctatcttccttcagagagaggagttccttgattccaccacagcagctgtgaccaatcacaatgatacattcaacctgccaaatggatgtctgtcaacatgtgcctttcatggagaataataagatccttgttaactgttgaaggggcgaatgtgtgagttcaccaaatttattctagagtggaattcttccatatccatttgggcactttaaatgagaataaatacagctaacggagttcagctatagtgctctacagaactccgaattacagctataatctgaaagctaactcgtccatgctagaatcatttaacacatgatgaatgttacagactctattattcataatatggaagtaagtggactgtatgatggttgtcgcacaaatatctagcactgctatgtgtatgcacattctttctaaaactttcaaagaacatacagtttcgaaatgcaaaacagaagttcactccctaaatcataccaggggtacttgatttgtgtatacattgccccgacaaaacctaatggtaaacccatttgcatttgacaggatgctttccaaatgaaagagagagcctacacatgcccttgaagggacgcaagattcttctttacttctatgggataatttctagaacaaattagagaagggtaagtgaaacaggaattaatctccttttccaaacaaaggtcttgtgtatgatgtcatcacgaaattgggtaataatttatccacttatcacattacaagtgcaccagttaggtttatgacttcgacataatggggatgtgcctttattgcaggtgatactacgatatccactgctctccttttctataactaatacaagttaactgcaaaatatcatgaggccgttctattcctaaaccaaaaaaacatgcgacttagattagaaggacattaattattcgcaaggaagatgtgaccttgaggacaaccacagcatactcaatggctgacccaatgctgcactgccctctctgcaatcaacatgaaaacacggggcttagtaatttacacctggaatacacaggccaaagttactgactagtacatgaagaaagacaagatataatgtacataaacatgaaccttgtcataggctggaaccatgctggcaatattacggacagtgaaggcctcaccaggttgtagaccgaaggtcagtgttgggcacacacgtgagtcagcacacgagaaaaccatgtactgcaagaaagaacaattaatccaggccaaatcaaaacggagacaatcataccaaataaatcatggatcggcaaatcactcagttatgacttatgaggaaacatttctcaaaaaatgtggtgccgattttgggccttttttttttgtggagacctactcttgtcacgggctaggagattggaaggagggttacggcgaagggagtatttgaacgaagtaaccgggcgtggtcctggacctcgccggcgcggaggtgccgtgaccggcgccgcactagcaaggcaggaaaggagcgatagattggttttctgattgcttgtttattccatgcgccatactggccctttaagtaaagattacaatgccatctaacaaactcttagagataaagatcaaactaacaaactttaacagactctgaaacaaacgaaaacaaatcctgcatatctactgtttgccgttttgctgttgtcgctgatccttgcgcctgcggacgtagtgcattccccacatgacatctctccctccctcgagaagcagctcgtcctcgagctggaaatccggatataatgcacggaattcatccagcgacaaccacgatgcgtctgccgccggcttgttcttccactgaaccaagacttgacggactcctcgagccaaacgactgcgggagactgactgtggttccaaacagacttgaccatgctgcgtcggcggcaacggaggcagagtgcttggcggctcaccccgaaacggtttaagcagtcccacatggaaaacgtcgtgcagacgagctcctggcggaaggcgaagacgataagcgaccgacccgatgcaagcgacgatctggtagggaccatagaacttaggccccagcttgccacggcccctcgtgtcgagcgacgccatcggccgatgcagaaggcgcagccaaacccaatcgcccacatcaaaattcaactcccgatgcttcttgtcataggcctgcttgtacacctgctgtgcctgctccagccgatcacggatggctaccaaaaactgatcccgatcttgcatcgagcgctgaacggctggcaagcatgtactccccggctcataagaacgcagactcggcggtgagcggccatagactacatggaaaggcgtcgtccgcagcgaagcctgatatgacgtgttgtagcaatactccgcccacggaagccacctcaaccattgacgaggacgatctcctgtgagacagcgcaaatacattgcaatgattttgttggtgacctcggactggccgtcagactgtggatgaaacgctgaagtcagattcagctgaaccccggcgaggcgaaacaactccgtccaaaacttgctggtgaagacgggatcccgatcgctgacgatggaggacggcacaccgtgtaaacggacgatgtcgccgaagaatgctgccgccaccgtggttgccgtgtatggatgtgacagcgggatgaaatgagcgaacttggagaacctgtccaccaccgtgaggatcaccgtcttgccatggacgcgaggaaggccctcaacgaagtccatagcgatgtcagcccacaccgcggacggcaccgggagggactggagaagaccggcgggctgaagatgttctgtcttgttccgttggcatgtgaggcaggcgcgcacgaaatcttgcacgagcacgcgatcgcgtggcacatggaaatcggcgcggagcctgaacatggtcttctgggttccttcgtggccgtggccgtgcgccaactccaggaccgcgggtagcagtggtgacgactccgggataaacacccgatccttgagtacgatcagtccatctttgaatgcccacggcgggggtttagcgccgcgaatgatgtcgtcgcggaggcttgccagggatggagtagaggcaacctcgcggcgaacgtcgtcgagcagcgagaagtgcggcgccgatagaacaaacgcttcagccaagtgttcgtcgcggcgagatagggcgtcggcgacgacattggccgttccaggcttgtactcgacggcaaaatcgaatcccagcagcttgctcgcccaatgatgctgtggaatggtcgagaggcgttggtcgagcaggaaccgcaagctataatggtccgtgcgaatgatgaagcggcggccccagaggtacggtcgccagtgacggaccgccttgacgaggccgatcaattcgcgctcgtaggcggccagcttggcgtgacggggggcgatgggcatgctgaagaacgcgactggaccgccgccctggtggagcacggcgccaaggcccgtacccgacgcgtcgcattcgacgatgaagtcgcggttgaaatccggaagttgaaggaatggcgccgccgtcaaagcgtgttgcagcttgcggaacgccgctgccgcctcgtcggaccaacggaacccctctttacggaggagcgccgtcagtggcgcggcgatagcgccgaagtcgcggatgaagcggcggtagtagccggcgaggcccaagaagccccgaacagcgcgcaccgtcttgggcaccggccagtccagcacagcctggaccttgctacggtccatcgccacaccgtccccggagatgacatgccccaggtatgcgacggaggtgaggccgaactcacacttggagcgcttgaggtggaggcaatgatcttgcagcgtttgcaacaccgtgcgtacatggcggaggtgctccgaccaagacgagctgtatattagaatatcatcaaagaagacgagcacgaaccggcggaggaacggaagcagcacgtcgttcatcaaggcttggaatgtcgccggcgcgttcgtgagtccgaagggcatcaccaagaactcaaagaggccttggtgggtgcggaacgccgtcttgtgcacgtcgtccggatgcatcagcacttggtggtagccggaacgcatatccaacttggtgaagaatttggcgccgcgcagctcgtcgaagagttcctcggcgaccgggatcgggaacttatccttgatggtcttgtcgttgagggcgcggtagtcgacgcagaagcgccaggagccgtcgcacttcttgatcagcaaagccggggacgagaatgccgacgagctgggccggatgacgccgtggcggagcatatcgtcgcactgtcgctcgagctcatctttctggatgtgcgcgtaccgatacgggcgcaccgcaacagccgatacccctgcctccagtcgtatgcggtggcagagatggcgttctggcggtagtccgtgcggctcggtgaagaggtctttcaagacgtcgagcagatcggtcatgaggtcgcccggctgaccgtcgatggcggcagcaagggcgggcgccggtgcggcgtcgatacttgtccacgtgacgcggtcgtgggcgggtccgaaggcgagggattgtcgagaaaaatcccatagcgtcggtccgagggtgccgagccactgtgcacctagcacaatgtcgtagccgccaagcgggagtgcatagaagtcgatgtcgaactcgtgcgagccgatggagacgcgctgtggcgggcacctgcccggtgacggcacgcgatctccattggccacggctacgctgaggccggggcggcgctgtagagggacgctagcctggtgcgcgatggcatcgttgatgaagttgtgtgttgagccggagtcaaggagggcgacgagttcctgcgagccgagacgagcccacaccttgatagtattgaacttaggagcagagataccagccagggcgtggaggaagatgctcggctcgtcgagggtgatggcgtgtgcttctggcgtggagtcctcctcgtccccggtgtcttccgggaaactgataacctcgatcacgaacgacttcttgcaccggtggcctgcgacgtacttctcgtcgcaattgtagcatagcccttcggagcgtcgttgggccatctcggctggagaaagtcgcttgcggggcagagccgacaccaggggttgcttgccagcagcggtcgatgcggcaacatcagccgaagtggtcgatgcagatgcggatgcggccgacgacgccggcagtgaaggccgcggcactcgtcccgtgcgcggcgcggatggatcagtcgggccaagggtggcgcgctgctcgtacgcgcgtgccagcataatggcgtcgtccagcgatcgcgggcggcagagggcgacatcagtcttgagcgggttgacgaggccagccgtgaagagctgaacctgctgggactcggatagctgacgtcgcggcacgccaaggcgaggaaactgttgacgtagttctccaccgtgccagtgcgacgcagggccgtgagctcgcctagcgggctgtccgtcatgggtggcccgaaacgagtgtgcaccaactggacgaacctccgccacgacggttcgccagaattgagctcaatcctgtaataccacaactgggcgtccccgattagatgcaatgaggcataccacaccttgcgtgtctccggcgttttctgtccgcggaaggtctcgcagcggttcagccatggcagcgggtcgcccttgccgtcgtacgtcgggaactcgagtttggcgcgaggaaggaagctgttgtcgatcgcggtgtcgtcgccgtgttggtcgcgtcgcgagcgtgcgtcagcgtcatcttgtggcggtgtgttgtcgcgtggctgacgtgagaccaagccagaagggttcgtcgtggccgcgcgctgggaagcctcgacgcgctcgacggcgaggttgagagcgcggacttgctccgagtactcgaaggcggacgcctgcacctgcgtgacgcgatcaggcagcttgtcgagttttgccgcgagcggcacgaggggctccaaggtgctcatcttcctggcgagatcggagatttgcgccgccatggaggtgaggttcttcgcgatttcatcgagttgattctgagtagaggccattggatcggaaccagaggaatctgataccaagttgtcacgggctaggagattggaaggagggttacggcgaagggagtatttgaacgaagtaaccgggcgtggtcctggacctcgccggcgcggaggtgccgtgaccggcgccgcactagcaaggcaggaaaggagcgatagattggttttctgattgcttgtttattccatgcgccatactggccctttaagtaaagattacaatgccatctaacaaactcttagagataaagatcaaactaacaaactttaacagactctgaaacaaacgaaaacaaatcctgcatatctactgtttgccgttttgctgttgtcgctgatccttgcgcctgcggacgtagtgcattccccacatgacactctacagcactagaaatcacatctctagcccttctcacgcaagtcataaaggaaaaaacttagaacctaagcaagctaatagaataagaaaacaaaaatattcatttatttagacgggtctgtccttcaaaaaaaaaaaaagttaacatatgcaggaaccatgtcattggtcatctatagtaagccgctctgtgcttttgttcatgttagttcctctaatgtagaattttgaagaaattccactagtactttgtactgaagatgaaaattttgtcaactattttttttatcaatatatattgctcaatggtcacaatggtaatgagctgttcccatcagaattccttagtcgagtttgacttcagtccacaaacaaaccaaaagagcgtaatgtgaggtatgcaccctccaaatggcataattcttagtagagacagcaaattatgccggcgcattctatgtgtgctggaaagaacaaattataggtttcataatctatgtataaaactattaatctgatggcagcactatacctttggtgactggccagtcttgagccgctcaaacagctccggcctcttgctgaaaaccgacaaaaacaaatagattcgatttagcacaaaatcgtattaaacacaccgacgaactctcagggcatcagaaaaatactcgtatatagtattcctgaaattctcgaacccagtcttgaagcgctcgacagcgttcatgccctgcaagaatcaagcagccaacacgacataagggcggcccatcagcgacaacaacaggaggatcataccgacaatgagaaagggaaatcgaccttgtcagtgtaggtgataaacgggggtggtggtggatggtacggcgtggtaggcctcggcttgtgctggatgagtgactctctggtcgaccgcatcgggttctccctcgcgggtttgtagaccgggaagcagcagcagcaggcacccatcctcgatgcgtccccgcgaccgcgagtcgctatacgaacaaaaacgatcggcgacaaacgaagaagaagcgcgcactaatgaggaggcaaactctgaacctagtagccatgaaacagataggcccgtgggtgaaatcagaaaatcacttggactctacctcttcgtttgcaattgcaacagatacgttaacttgacttaatttacggcatttataacgaaaaccgtataggtttcagaggatttaaataggttgcggataaatttcaagatcaatctgcaggattacgcaagaaggaaaatcgagtaccttatttcgt

SEQ ID NO: 43012 - DNA, 6201 bp, Oryza sativa
tggctcccaaagaggttggggcttcgcctatttggtattcccccccaaatgtaactccggcatgccatgcggggagtctggaggtggacggcgccgcggcggccggggagtaggaggagatcagtttccgaagggaagtggggttgagggttagtgcggcagaggcgcagagctacggccggcggcggccgaggaagagtaacgaggggccgggatagggttggctggggcggcggcggcggcagccggacatggcgacgagtgctactgtggattccgacgggtgcggaacgggaatcggacaggggttttgctgagcctatcaaatttctccccttttttttcttcagtaaattgttacggcaaaagaggcataaaaggtttgttgccactattaaccctaacagaatatagtaatattaaattttggcacattttgttaaggctttcaacccatatactaaagctaaattttgtcactctttttattatcaaattgtactagttttaggatactttggtttgaagccttactatctttgtctcataaaaaaattcatttttcagtttttggatacaacgttttactctttattttattaaaaaaatttatgattaatgtttttattgttattagatgataaaacataaaagtactttatttgtgattaatttgttttctaatttttttaattaagacagatatcaaatgttggacacagaaaccaaaaatgaacttattttgagacgacggtagtacttagtagtgtttagaaaggggtctctataattatgaaactcataagcaaattactattatattatccttttattagaaaaaaaatactcgatgttcttgttctaattggcacttgtaggtgatgccttttcagattcaatttaattatttaattttaagtattttgaagtaaatgcatgagacctttgaggtggtagcccacagtctaggaagaaaaaggtatacatggcactccatctgaatttgcagctaaatctccaattccctaaatttagccagcatagcacaatggtttgaagctatgttgctctctctctctgttcccacatacatattcttgttatcggctactatttatatttaaactttaatcactttatatttctaaaagaaaaattatatacctaaggagataccgtgtcataactcatactccctccagttttattttaattgacgtcttagacaatgacacggtctacaaaatatacctttgaccttatttttctattataatatacacaataaataaatgcatgttaacttttattatagtgttttgaaagacaaatctatatatgttgttctagtttctttaaactaaatacttttgaagttattaatggtcaaagttataaaagtttgacctcaaccttgtccaaaacgtcaattattatagaaccgaagggagtaaggtgtatgttgcattttaaatatatataagcagtaaactttttgtttatcttagaacatttaaaaactgttaggaacggaggtagtaccatcgtgcaattcaatgtgtttcaactaggcacttgtaaaagacccacttagctcctaccaacaatccaacgtggagaatttgatagtactcccaccattccaaattgatatacatattttatagttatactaagatcaagaaaagctaataactctctcatactatatttactctaggctctagcaacaaactcaatgcatgcgccatccccactatttcctagtcaatagcaaatcaagatattgtatgtaggtaataaatttgtgtgcatggatacatgcatcaatgtctatttacttcagtgcacaaataacgaatagacttaatgaatgaacacaaatatatagattatttaggaataaccttaaaaaaaactatatgtagatcaatttggaatgaagggagtatatgctatatatatatagaccattttagatgactggtgacatgcgacaactaaagcacgttaataattgtagattaatattgtttcacgattcagcatagttgggcagaagcctaatttatatattaaatgttgaaaggtggcaaattgttttgatcgaaatattctttgattagtaaaaagatgatattgagctataaaccgtgtatatatattccgattacaaccagaactatatagtcaaataatcagttagtattagcctgcaacagcaatgaaccttaattatgttctgaattaagcattgatacaattttgatagctattaaagcatgacccagggatggatgctaatttgcttttggaatataatgcaactcatgttaggggtgatgtatagaagcaccattttagttattctcttctttatatgcatttatcatcacttcttatagcatctacttatcatcacttcttaggctgtgtttgaggagaggagatagaggagattggaaagatacgtaaaacgaggtgagccattagcacatgattaattgactattaagtattttaaactttaaaaatggattaatatgattttttaaagcaactttcctatagttttttttcgcaaaaaacgcaccgttttgtagttcgggaagcgtgtgcgcgaaaaacgaaacaaaactcactcacaatcaccagatcacccatgaaagaacacaaccttattgtacatgtggatgatggttggtattatttttttatgagaaaaaaaattgcacgatatctagctttttgacaatcttgcacaccaaaagaaaatgctggcgccagcgagaaataccagagtaaaaggtagtaaaaaggtaaactcttcataataatattattaagacattatagctgatgtcttttgatcacactgcgatcaaattatgcatcataggcagtacaactccgcgtcaggaaaaagtagaggagatatatttcttgttattacttaatacagcattcacatatatcgaaccatccggtacgtacgtagtagtactccacgcgttcacatcgatgatcggggacgatatcctcaggtagtacttatgcaaaagcgttggcgtaaactgacgaactgaacggacggacggtcggatttagggctcccataagtccaagttgccggagacgaagtcgtagtggccgccgacgagcttgagggtgccgttggcgatcccctccttgacgaacgggtaggtcttgaggttctccagggattggttcacggcctcctgcagatcatcagatcaattgttttgatcagggacgcagaaattcagtcagtgctgaattgaatagacaacgcaagtttcagacagttcgattgtccttcctatgaatgtaattaattctgatgttccaatttcatttaacattttgatttatgcatagtggttgtcatgctactagtacgtgcgttaccttctccaagatggcgcattggtcatcgaaaggcagcgaggcgtgctcggtctgaaccttcttcttggcggggaaaccggtcctgacccagtcctcgacgaagtggctgaaccaatcaaagtgcaaacccgagtcagaaacaaacgatgatcaagacacgctaacatttttatttcttcaaccctttgtttgtctgcatacagttatgcccaagttgccaatactatagtactatcactaagttttcttttgttcagcaacttacaaggagtctggtgctccatccttgagtgagaggagggccttgattccaccgcagcggctgtggccaatcaccacgatgagttcgacctgcagattattcgatccaggtcaataccccacaatcaaatcgtgcacgcacactttacgcatacatgtgctgtatgagcataaaatagatttcaccaaagtacggtgctttcctactaacaccgtccaaatatactaaacaaaggcgctaattatgctccctgcttgatttgacaagattcatatgtaacgcaagtaccaccttcaccatgaatgttacacaccctacataaacctaagctggatggattatgtggggaagggaagattcttcttgatcaataaaataattcacacaccatctggcgtcagacacgacccatttttctcagcctgtacgaaaatatttttctctgatccggtgtgtgaagttgccggcacaattagagcaacgggtactatatagttgacataatagagcactatctgtgagagagagagagagagagttgaccttgagggcgcagacggcgtactcgatggccgacccgacgccagcgtgcttgatctgcagttgacgcacacacacgaggggggtcaaaatcaatgcaaaccgcggcgaccgaccggaatagctagcttaccaatcgaccggccggcgacgaaaacgcgtacgatgaagttggttaccttgcagtaagctgggaccatgttggcgatgttgcggacggtgaaggcctcgccgggctccaggcccatggtcaccgacgggcacacgcgagagtcggcgcacgagaacaccatgtactgcatttgtcccaacaatcagctcagttcattactccacactaactagtagtggagtagtaattttgcgattacacagccatatcaggagatcaataagcatattaggattaggcgattagcatctgttctactagtactaccactactgctcttatcgataaggaggcagcagatgctgataggcgtatccgagtgcccacaacccccacaggaatctgacatttttttcccgttctcttgcccccaaagctgccagctttttgacctgtctgctctgttttccctgaccactttttccacccagaaaacagaacggatacgcaaggataacccacgacacggacgagtatgagttcatggcccatggggggcatataactgttgcgctgattagtactaatcctaatgaactaacgatcccactggcgacaacgccgacggagacaaaaacggccaaataaccgagcattagattaagacgcgagctgacgcatccaaagcatgctcatggcgatcaggccccaccctttagcaaattgccggggccgatcgattacgggcttacggcagcagcagcagcaggcagtcagttgcggcgtagattaatgtttttggatgggggccatcattttccgggagaggagatttgatattaataaagtatatatgtacgcatgttgtaatgcaaactgctggacttttgcacctgctcatcaatgcgtgtggctggccaatccaagttactgtatagcgaggcagatgccaaaatgtagtgtaagcaaaaggttggatatgcgcctaaactttcgttaaaggctgttgagttggacgtgcaaacaaatgcgtgattgctgggcccacaattatgtgatgtcctccgggccatgtcgtacaggaaatacttttgcttagctacagctatagtatggagtatatcaagctgcaaggctttatccactgtttctttcttctccgttgctataaacaaaagagaacttgtggttcacggtacgttctagcttgtgtggggtcagcaaagacgatgatatcgcccaaattaatttgggcatcattgcagtatccccatgagaatggccgtgtccaaatgaactttgaaattcatcaacacgtacagcgaggttgccggccggtccaaatttttgtacccaaatgttaggacgacgtacgccaatttagaccgaggcgctgccaggagaccctagcctcgatcgacgacctaattagcttattagagcatgtacaatagcatgctataagctagctgtaaacatattttaagaagctaaataaaaagagagaaaagcagtgggctataaatttgtagccagctctagcacggactccaagacacagtgtgtgtatgacaggtgggatcaggtattagtagtgtagtatgtaactattgtatgaatgagtttctagattagctatatatgaattggagttagtagttggctgtactattaaacttgctcttactattctaaaattaagctggacgcaacgaagaaatcaaaaggaaaacagtagtgatgatggatgctaaaccctatacgaggaaggcgacatctcggcggaaacacaacatgggcaagcacatgggggacggtgaagaaatcctgcatgttactaggtgcgagcctcgtcttc

SEQ ID NO: 43013 - DNA, 21027 bp, Oryza sativa
aatcctcttatataactttggccaggcaacttggacaggccagttgctgctaacttttgtccagtttgaccttgatggccatatatgctgtgggcaccgtaaacagtgtacaccggatgggcaaacacaaggctatatgctttgcctggttgccttgcttgcaggttgcaagcatgcgtgtactttctacctgggagtagcagtagtatctagaccggtaggaatctgtgggccaaggtgtgttcacgaatccccaaatcaaccgcagagatcgggggtaaaaggttggggcttttcttttgctgacgaggtttgcgagctgagggatggacggtgtagcggccatggaggagtaaccgtaaaactccagctggctgggttggctcactagtagacaaagaagaacaaattttgagcaggaaatggacggagcagcgtaccttgggtgcctggccggccttgagcggctcgaagagctccggcttcttgctgcggaggagacaaaaagacaaacagcaaggtgatcatgtcagtttcatctcacgccgcgcgcgcggctacccaaattcttctcaaattaaccatctataggcaaggggggcttactcatagaactcggtcttgaacttggcgaacccatccttgaggcggtcgacggcggcgtccatctgcaagcaaaaataattaatcacaccgatcagctctcatgccatcccaatcccaaaccaagaacacacgcacacaaaaacgcgtgaaaatttttatacacccatatgcatcatgaaaatatgcgagagaggaggatatcgccgtcgttgtgggttccctgcgcccacgcgaggcatgcacaaaaggcgatctaaagcggatgcaaaggatctcccttttttttctctttgcccaacaaaaaaggaagccacgcccgcgcgaatcgatcgacggatgaatcaagaaaaggagagagagaggagaagaggatggatggatgatgatgagagcagtaactgtattgacggatggtgcgggaggaggaggagacagggggacggaccttggagggtgggggatggttgttggtgaggagtgacggggaggaagaagaatctatggacggcttcgtcgccgctgctgctgctgctgcttccgcttcggccgctgctgctggtggtggtggcgatggcgtcccgtttggggcctttttatagcgggggaggcagaggcatccactcatcttccctatatcgaatggatcaaacgatcggctctagtttttgacttttttttttcccttccgttcgctggcggtcgtcgcggcctcccggatcactagcaaacatgcatgcgccacgtggaacgcggtgagttggagcagctagcaaagaggtaaaaatatagcagcgatggatggatggaggggctggttttgtggccaaaataaatggccgatcggaatggcaagagccctccccctgttttggtatgctgttcagccaaacataattttgcgggttttgtttaatttccttcctttggcagagcaagtaagaaatggggttgcatgatgcaggattatgattacaaaaatggagatcgattaattttaagggagtatgattagtcacacgaaatggtcatatgcctttttccttaagtcgatgcatccagatgatcaacaactccttgctagtgtgtatacacatataaacggtcgtgtggatcgtcctttatttttctttttgaatttgactcgtgacggctatactattgatcccagaaatgaaactactagctaactagcatgtgtgcgtgcacggctttcttattgtggaagaatggcagttgttttgattaaatcatgtgcgcgctaaggaaaaaggttcaggttgatctagtgtttgtgtgtgctagtacttagcagtagggttgcctcgttaggcacttcttttgtggagtatctgattgttgatagttgaagttaaagctgaagcaacttcacgacctcacaaaattctgattcgatcatcagctctcctcctctcttactttgcagacattgacaacctcttactactatacttatgtcacgcatcagacaaatcttgaaagtggatttgtttgcaagacaaatacaagattatctaaatcagatgcagatttcaccatgcatgaacccagcagcaagatttatctgggattctggggtgatccaagtgctacaagttgtttgcgctgtttgggcctcggaagcgtcagcaggatgcctgccaggttgagcagttttctactgcatcctcacatcttaagagccgttttgcctggtgcatcaggtgaccaaagtacatggagcagctactggctccgtgatccaagaaacaatagctccaaacgagaccaagaaccatttcatagtatcccatatgcctgaataactactatatcagtaccagtagtacgggagcaagctacacaatctatgctggatttgcgcaatctggcgcgttaatccggaactgatcttgtcactactcagcagttagtttttctgtttatccatctatctgcagtacttagacaaaaacaactgctaactactctgcatgcatcagtatgcagccatcccagttaacgggagagttaggcacttaggctgatctgaaaaggaacagtaagttttcggcaaggcgagaggtcgctttgcaagctggaagagccaatcggccaactactctttcgcggaatcttccttatctttgcgcccatattacttgactaaacacaaatggcatagaggtcccctactagtagtacatcatgcaaggtacaattagcttttcgccacaagatgggaaggttttggtccctaatccgttaactgcaaccacaggcatattcctacagagtaggtgtttctttcgggtatgcgtctgtatgactgtataggttgacaaatcagtattgcaagctagttttaatgttggggcttgtcttgtatacatgaaccaggaatttcagtactgttaggcaaattttggtagagcttaattgatagaaattaattcccaatatgactctttaaataaaaaaaatatattttcatgttggatgtaccctcgccggtattgattaatgaaagctcaatttccctaaatattaaggaaacatttcaaaccggttttgataacaggtggattttcttgttgacatctcatctgtgcatctaacatcagttaatggtcttgaatggttttgtaccactcaatttttggtgagggtcaacgtcaagctcagcctgaccttgactgcaacaaaaatcagggcttgtactggttaccccaacaagtcagatcaccacgtacgaaataaaattaatataaaaaatattttgagttcaaccatttacagtgaaattccctttttaatgtttggagaaataaaaaattgcctagaaaaacagcaaacttgacctttctagcatttctgtatatactagatactatgatctttatatggcttgagaaactaaagacaatactccgtatcatttttcaaaataaaatggaaaatatataattgttaaaataacgaagttgatagtgactcgacagtccattactaaagctaaatcatggacgcttctcctcaagcgaaaaagaaacaaagtagaaaacgaacactatctgtccctgctagaactttaccttatcgtttgagggaaaagccgcctagatgtttgatttcttaatgtacttggagctttgttcattccactcaagacttttgggggtatcttttatatccaaagcgctttcttatctctaatgaacaatataattggccaactgtttgggaaccttttctcctcccgaatattctatttagagtttgttgacgtgcacgttgattgacagaaaacaaattgggaaaaaagcataagaagggcaatatgcaatatatactcctatatgttgtcagtgttgattaaaaattgaacatacattttcttttgctgtacactgttcaatgattgcttaaaaaactaagagagtcggtggtcacggaacagtgcttagttggacaatttgccgagttgcggggtgtgtgtgatgatggtacgtgggattgacgcataaacaactatgtttcgaggtatggacaattagacacacagtattagactattagtcttagatataacactgcagtgcatgcatgcatgcatgtagccattcttgcacagtttgcaggtatggataaaaccaaatgacatgttgtgtgtacgtagagctagagagagcggcaggaatgcaagctacgtacgacccgtgcatgtgtcgggcctaatgcagcacgaggcgcgtgcatgcacgtatcgtgtatgtatatgcagccttgttatagctaaattagcatgatgcgaacgtgtcataaaagcttgagatatagaagggtgcccggcggattgtatatatgcatgcagctagctgcaagggtggcgggaccatgcataatgcacgtaccgcggcgggggcgactggggcggcaaaaactgtgggggtgaggattatgctgtggcggaagggggccgggaggttgctgctgttggaggaggaggaggaggaggacggtgatggggaggctagctggcgaccactgtggcgcgggagcgcggggtgacagtggcgaagcaccagctctgggcagcggcggcggcggcggcggtcgacattgtgagaggcggtgcacggcgcgctccttatagcagtagctacacacgcgtctcgccgccgcgcccgcgcgcgcaacaaatagacgcccgcgcccccgcgtgccgacaaccagcgcccccggacagcgggagggagatggtggcagctagcgagcgccgagcggtgcgtacgtgactggtgatgggtcgttcgcggcgccgggtggctggggcgagggggggcgtgcggcccggctgggcgggtggatccgggccactcggcgcctcacccacccagcgcgccacacgcgcgcggataggctcgcgataacgcgccgcggcgccgtggccaacggttccccgcccgcgcgtcctggtccacacgcgcgcggatgatgggccgccgcggggcggaaaacgaaggcaacctacgcgggtttcaatgcgagcggctttgcggttgggtcgcgccgttgcaggttgtgggtggatcgctcgatggagatgtggatgtggatttgatattgcgatgacgatgccaccgctcgcggcctctggagtctgtctcacgggggggttgggccggtcgatcggctcggatgtggtggcgctgcgaggtgtggaacgtgtgatcagggcttgcttagccacggtaaatatctttcatttagcgaagccgtcaaagcaacgagaatgcaccgccgcgtaattgtgggtttgtggctgtgttggcgacggattggtcgtgattaggttctgccgatcggagcgggcacacgatcttggggtggaatctactgatgatacacgttggctgtagtttgatttgggtgctagattaccttgcggaagtatgtatagtagtaggaactctaattacagaaccctttttcaatagcaggatttaattaattgggccggggccgttccagcccgtgtgtcctaaaagaaatgtcaaggccttggttttctgccttatgttgcagatagaaacgagctgggcggctggcccattagcttaagatggccacctgtgatgtgtcagtttatgttcctaaatcctaaggtggaccgtaacactgacatatggactctaaacccctttttcaatatttttactttttaaattttgaatttcagctattcctaaattatattactgtatggactctaaactctttttccaatattaattacttttaaattttgagttttagtatttaaaaaattgtattttttatggattctaaactctacttttatttttattttattatctcagaattttaattagttctaaattgcatacctagactctagtcttttctttcaatattccttatttttcatttcgaatttcaatcatttgtaaaatatatttctttaaggactctaaacccatcttttaatattttctttttttttcgaattttagctattttaattttttatatatatgaactctagactcttcttacaatattatttatttttaatttcgaattttagatatttacaaattatatttgtatatagactctaaactctagttttaatctcttatttttaattctaaattttaattagttctaaattgtatatctacatcgactctagtattctcttccatatttcttttttttttctaaattttaattatttataaaatgtattttaatatggactctttttttttatttcatttgtaaaatatatttctttaaggactctaaacccatcttttaatattttcttttttgtttcaaattttagccattttattttttttatatacatgaactctagactcttcttacaatattatttatttttaattttgaattttatatatttacaaattatatttgtatatagactctaaactctagttttaatctcttatttttaattctaaattttaattagttctaaattgtatatctacatggactctagtcttctcttccatatttcttatttttttagttctaaattttaattatttataaaatgtattttaatatggactcttttttttatttttctctaattaatgtgagaatttttaagtcataagagcgaacttggagcctcctttttctattacttttataagttaatagatagattttggccaccatagtatgaccccctcgtacagaaatttataaggtttaagccgcccgcatgtaaactaataacccccttgtactgaaaaacactttctgtagtagtgcctctaccactacgccacttttacgtacggtagcagaggtgtgttctatactccctcttcccaagttctatattcattattcgtgcgcatgttttctgaacagttaaacgatgtgtttttttaaaaaataattatataagatagttgtttaagaaaattatattgatatatttttttaagttttttagctaatacttaattaatcatacgtttgtccattgcttcgttttgcatgctaggaaaatgttctcaactgccaaaagaacacaacctaaaacatgaatgaaaaccatattgagatttttgaccgtataggttgtccccgttttgtaaggaccattttattccgattcggtaatgtttggactccggaaatgaaatataaatggtatagtgtgttatgaaaacttaaccttaaaccttatattctatcattgtttatgttacaatatcatcattatgaacattcaaattagttacttactactgctttgaatcttcactaatactccctttgtttcagtttacttgtcgttctagcattcaaattttttgttagaatatttatcgttctcacaatccaaggtacacttggagatgttttttttttctttccaccttttatcaatgcattttaaaatggccgctaccatgatatccgccttttatcaatgcattttaaagcttgaacatgtgatttccaagaacatgggttcttggaagacctcagctgatcttaaaatttcagatgaaactactgcagagcctatgtttatgcctactccttgaaaggagaaaggagcgccaattcgcatctgatgcctttagtggcatggactgagtttttcctcattctgacagtaatttgtttctaatatgaactgatacaatttttccagtcaacatattttccagttctcgttagtaccatggcgtgtgtgcaactttgtatagtcctcctcaagctagcaactgagcttgccacagcggctaatggtgggtttggaaaagcaatttggcatgagttatgatggcaagtaaaacaatataaacaattagcaaatgattagtctagtattaatcagtacaaacttgaaaaagtgatttatttgatttttgaaagaacatgttcatttatatatttaaaaaaacatatcatttaaaagtttggaaaacgtgtttatgataaataaggaattttttcggtccacactcacttaagaactaatatttaatttttctctacaggtactacttccattccaaaatagtggtcgctttgattttttcgtgtaacgtttgaccattcatcttttttgaaaaattattgtaaatataaaaaaagatatgccatatttaaattatttttttgataataaagcaagtcacaaacaaaataaaaaaaataattctataattttttttaataagacgaatgatcaaacattataaaaaaaatcaatgcgataattattatcggacagagagagtaagtagataactaatcataatgtaagaaagttctacctaactaaagtgaacagttgacatggaatacatattttaactcatctaagaaactgcttgcaagaacgagatggaatacatggcacgtttatcagcagctacagctacatacgggaaaaaaaataaaacagaagaaggcagaacaatcgaaacgagtgcgtaccatttgccatagcagagtattgatttcgctgtgagtatcctgtcgaaattccgagcccaaccttcgcgcagatgtcgaaggacgcagttgccatggcgaaaaaccttcagctgcctctccatccgacaaatttatatacgcgccacactcgtgctgctcacagtggggcccacctggcggtcgcacagcgacttgtatgcggcgaaatgtcgacaaggtgacatggtgagctcattgtggcgaatggcgacaccgtaacctcacagtgtcgccccgttttgatgtcttggtctggacggcgtcatccaaacagggacaagagtagagcggagaagccatgggaaatagccaagatggcatcaccgtaactcggccgtctcattcatgtaacccaattttggcgacctaagtgcatgtacaaagatacagttagatatgagatttatattatctagagactagcatcctacaacagttagagacaatatggtctataatcattaatatataaaaatactttttcttactcttctttcctttttttcatcaccatgcaacaaaatttgctctaataaatgctaagagtcaactctgagcagttgtcatgcataacaaccatattcatttctctttcttttatgtcatcaaatttatttgcataacaatagagagagatcactaataaagactattgtatatgccctaaaaatagtctctacttatatattatgatatttgaataaattcaacccttattctgaactgcagcagggccaaatggatatagccgaatccgttgaatacgctgggagtgatgagaatttgctaaagtactttatctttttgaaaagtaattttatagtccttaataagtacttagatttaccaaaattttaatgcaaatttcggaacttatagtgccgaagatatcgtgaggtcccaaattataatcccggtacctcttcaagcattgtaaaatcactcttttaaaacacaacattttttttcttgttttcttggtttggtacactacaagtctacagcctactacgatggagtaccagatgaggatgtgtggcttatcaacacctgggccttattctgttaccaatgtgtgtacgaatcaggcccaattcatgcctcgttttggcgcctatccaggcccaatccctaccggctgtccggctctattacattttggcggggatatgggtcgaaaggttctagttcagtcgtcatttcgactcatttgcagcccagatattgttaagaaacattaaacattgacatttaagatttgtttctatccaataaaaaatagctcagtacctcttggtaccaagattattttcgattactaggatttaacaatggccattctgcctagttagattcaacgataggaaacgatttggagttagatccaactatagaaaacgatttagtatagtgaggtactggtacatcgggatattttttgctggatcggatcaatatatttatcatctgtaattgggtatgcaccgcatggttttaactgcaaaattttaagctagaggcaggaagaatgttaataccgaatgaaatttagattggtttcgagaattcaaattcaaaacaatgcaatttgaccaaaattggatcaagatttggcacaaaatgtcgtatttctgtggtcggaatattccaccgaacttgatttaagaaagaacaattaacctttccaaggtgatttagaggggagagacatcctccaaataatttttaagaaaaaattgcgagtgtgttagaagttgaacatgagatttttttttcgaacggtcaggctgttgccgacgttttataataggcaaaatttgctacaggacaaccaaaaaacgcgtaattagctgagggacaccgagaaaacatggaactgctctaggacactacaaattttgtaaaatttgccgtaggacaccgagctcattattttatcatttcccggctgaaagtggcgagtattttttcaaaatgcccagattgccccgcgtcccaatctatactctggagctttggaggtgataatggcatcaacctgctctttcggggagatgaagttgtgcaccgggtcggtgagatccggcacgaggaggctgtgggcacacaccatgtctgcctcgtcgaaggagcccatctcgatgagcaccaaggcgagcgcaaaggcgatgtgcaggcagcgcggggccatccatgccgctctcctgaggtgattcgtcggcttttgctgatccgcgtgcgcgaagtaccattgcgcgagatagtgtgggcaagcggcgaggcgtggtacctctcgaggagctgcttggtggcgagcccgtctccgcccgtgtcctgcagcgcggcgatcgccccgtcggcctcctcagtgaatgcggcgtcatagtccgaccagtcccagttgctcgccggccgctcgccgctggcaccggccatgggaggaggagcgtgtcacgacgttgcagcccgccgcgaggcagacgaccgacaccaggagcgcgcgcgtgaggtgttcgccgaaatgccgatgtggcgggacgtgacggctttgcgtgcggagaatgaggtggcgattgcggctgtgtgtgggtgggtggatggatggatggatggcgtttggagcaagtatttttacgaggagagagggagggagggaggaaagcggcgtacggcggttgttgtgtgtaagttcggccgtgtcccgactactgcggcgaaacggcggcggtgatgccgtggtggtgccgcctgtcctgtgggtgtcctggcagccgaagaagagcacgttggtgcggactccccggcggcgagctacgtgatgcagtccgccgagtggtgtgtggcgaccgagtttgggacacgggggcaatctgggtattttgaaaaaaaatactcgccactttcagtcgggaaatgataaaataataagctcggtgtcctacggcaaattttacaaaatttgtagtgtcctagagcagttccacgttttctcggtgtccctcagctaattacgcgttttttgggtgtcctgtatcaaattttgcctttataataagaagaagatatcacattttaaggagaaaatgggaccaaaccttacagcgctcagttaatctcatgttgaacaactggattttggagttgaaaccttacacccattgcactacctagtgtatctcaaaggaagtaggtaaaagcacactctgctctttatctaacacgaaagcaaacatggaccatcacgtcaaatatttgaagaggtcggagcgtaatttatttactaggacgactctcagcttgcctttccccggcaattttgtaggcgctgtgttccatttccgtgtcatcacaagcttcttaaccaataagaacggtttgacattgatccgtcaaacccaaaactgaccaaataacctctacttttacatcaactagctgggtggcccgcgtaattgcgcggctagcacccatataaaattatatatttttaatatatttttacttaaaatttattaaatagttatctcgttgtcttaagatttaaaagaccaaaccttatcatcgttgtgtttctaattaattttatagtttttaaaagtcacaccagttgctaccctttatttctgtcatattattctttattagcttacccaatctaccgtactgtttctattcattctccttgaaacctttaaaaattggatagtaagtttttagagtttattatcacgttgggcttcttatttataatttatagaagtcctatcaaaccctgtcattatacttctctatgactgtccactgcatcttctttatatttttaaaactcaaacataattatcgttgatgttcatttttcaactttctagaagtttcgcaaaaacgccaacgactttgtctatatactcctgtatggctcgcccgatgccgtccttctatattgttattgagattttaaaatcaaacatgattaacattgtggtttatttttttttactttttagaagcacgaacatttaaaaattggaccttatagtttttgagtttattgtctcgttgagtttcatgttttttataatttttagaaatctcgtcaaacgcagccactgtactcctctacgacccgttcgccgcatactctttattgtcattggaattttagaaatcgaacataactaacattggaattcatttttttactttctagaagacccaccaaccatcggtggctctgccattttattcctatacgacccgcccacagcctctcttttttattgtaattgagattttaaaaattaaatatgattatcattggggtttatttttttattttctagaagtcctctccaaccgtattgaccgattgcttcacgacatgcccgtcgtctttccttttaatcatcattaggattctacttggtgttttattaattgtttttcgatatttcatcaaccgccaccactctgctcctctataggcctcttacttaattaatctcgtcatgtgttttagatagtattttctttcaatagtcttaattattttatagttatttataaattgtattctagttgaaatcttttttttctttttctaatttctaaatttatttcattttttgtattatatttttttgatgtttttattttttatattcaacttcagttattttacaattgtattcctagtttaactctctttttaatttgcccaatttcggatgttatgttatttttattccaaattttaattaatctactatttggttcaatattgcttatatttaattccgaatttcagttaattttaaattgtattcctacttgaactcttcttttattatccttttttctaattttgattttttatttttttattctgaattttaattaatctcgtattggattcttgtatggactcttctttcaatatttcttattttaaacttcaaatttcagttatttttaaattgtattcctacttgaactcttctcatttttctgaatttcgttatttttataatataaataaatatgctcaaatttatataaaaatcagttaaatatatcaaaaccaacgtggtttctcttaataaatgtctctatttgaatgacatatatcattactatatttttttatatagaatgtctatatataattaatataaatagtaattaatttttttaaaaaatctcatagtatcccgatcctacgatacgatattactttgagcaaaacgatactacctagtatcccgatcctgacaacctttctacgtcatcgtatatttttattaataaatataacaatattttatatatccatgatctatttataccgctgtacattttaattagttacagtgtatctgcaaatgatcttcttcattgaatgattttttttccacattgttagtcatttttttctttttcatgcatggtatattcgatttttggctgaggaacgcatgagttgtcttggtctttgccttcgcctacatgcgcatactgttttgaattggatgtatccatcttcaagttctactctaatccgtgctttaagtccgtactgtttaatgacgtccgtatccattcctaactcatcagcctactctaactcctcatatattattagcggtatttctctgtacgattctgatccaacatacctccaataaatcttagccattaaaatctagacttatcacaatccaattatcacaatccaatggttaatttacttttctttttctacgattaatgtggtaattttttctagctttcacagcgaacgtggtgccttctttcaaagctgttttaataatataatagatagatagatatatttgtagtgcatactgacctacataggacattaacaattaatcaccaccaaacaaagaacagtcatgctaaaaaggaaaataaaaaaaaacatgtctgaacactctccggatgctgaacatttctcatctctgatatcacgcacgtacttacgcaaaacgcactgcaccagaacaaaattgtctatggattagaataacattctttttcgtgttcatttacgtgcggctccatgtaataatcgcacgagatgacgatgctttcctcctctcccgtgggataatcactatgcgcagtgtgcgaacgcatggatcacacgattctctgtagttaatctgccgttgaatttatccgcgagatcgatcaagatctcgagcgcgtagatcgcaagaaacccgctgctgatgttgtaatccggcagttactagcttccagctgttcactttgacatgttctttcttgcaatatcttgtgagaaatatatgtgttagcacatgtccttttctgccttttcatgaagctctgatctatattagccacaaacctagcgtaagctagtacgtactactagtacttaccaataaccaacctaacctggatcacaccaaccataatctagctagtgagctaaggcatgcattatcggcgtgtcaataaactgaccggtccaagatgacgtacgtgcatatatccactgaatccacatgtccgcatacatgtatatccgtaagcaaacaggcatgcttaatttcgggataaatgaattgaagaaaaagaatgacgctgaaacggcaacggatactcattgacatttcataccagctagtcactgctctctgttcgagcagctcaggtcaggagcagtttcagaggtaatgagatggtgctttcttgcagcagttgatttcgtgagcttgggatgaggcgaggattacggctaacgtgtgtcatctcctcgggttaaacaagctagctgcagggtcagtgtatatgcgcctaactgttaggtgcttgggtgttaggcaaaccctgaaattacacatgacgatggagagtaattatcagagcatgtgattgcgagagatttacatcaaacccgtgcataatggctttcggaattaatttggctgctgctgatgtagtgatgtaccaccattcggacacaggtgatggaaaatacctgcctgaacaccctgatcactgaacgtagacagacgcacacctgacctgaaaactgaactgacaaatacgtttgacacccatcaattctcactgatcatgtcgtcgtggagatggcattgatcagttcggactctacagctgagcgttactagcactacactgatcaaacaactcgtgattgagtgcaggttgcgtccgatttgggaaaactgcaagagtatccacttctctgtttttctttcttcaggctgtaacatcgggacgctctgtgttttcctccctggattgagaggctgtttgcatcatctggatgatgccgtagcagccgtggaacctgcctgaccaggcgctcagatatgcatcgacgcatgccgcgatgcagcagcgctcgttttgcagcagaagtcgggagcaagcaacaggcgacggattagagtccgggctatgtccaggctccgtctgataggacgaggggctccgcttttccggggaggtcagggtgtcccgtctccccgtagtaatggagagttggaaatgagggtgcacaatcaagtggttaattcacatgccacgaaatgtgaaatattttgggtacaacattcacatgcttagaacccaacttttcaaattaatcatgcgcctagattaatggaactgttaggaatagataggactcatagtttgtgatctgtaagcatcacaaactgccgtactctttgttgctttttcctagaggtggattatacttgagggttgaacaaaagaggctcctctggtcatttctgaaaagctaatggaggtatgggttatcggtgacatgtttaagtaactttttttcaagctagcatttgctagtttttaagtaactccaggagagttgttgtttgactctccatgtcaaaatttggcaaacatatagtctatagagaaacatgtctccaagcaacatgctattttgatagccaaaccactccccctagcttgctatctattccggctttgccaaaaggtgggtgccacgacctgaggcagcttcggttcctcgccaacgctttttatatccggccgttcacccatctgccaagcaccgccgtcaacatggggcctcatcgtttgccttatggcttataagccaaaaccaaaattttaattttaaaacttgaatttgaatttgattttttttcaacatagtttttttcaactttggcttttcaatcactaaaaacatatatacaaaagttttactcacgtatcattttgtaatcgctaaaaagccttatggcttataataagactagatcaaccgatggggaccatgatctgctgcatatcttgcaatgatgctatcagcatcgcggccgtcggccttcgatccagcgtacgtctcactagtgaggcagggtggagtggttggcgaggggaaagatctagatggagagagaggaagaataaataaagagagtctaacaaatgggatctattgttcgattgaacagtttaatgtagagattatagatactgttgtagtgaaacataaatatggctatgtaatttgtgcattctgatagaaaaatagccactcttgaagatccacttatattagaattatactatataacgttcaaaacttactctgcagttacatggtaagtttcaaaatttacattgtattttcttcttttcgaaaaaatatattatttttctaatatacaatgtataagagaattaagaataaaaataatttattatctacttgaaagagaagataaggaaatgttgaagcatatttacatctggagagagagcaattacactcggggaaaacaactggctgtgtttagtttcatgtcaaaattagaagtttgactaaaattgaaagtttgaagaaaaaagttggaagtttatatgtgtagaaaagttttgatgtgataaaaaagttaaaagtttaaagaaaaagttgggaactaaagcagacctgaaaattgagccaaagatgtcggtatataattgaatgacagttactttaagtgggttctttgaaaagagcaaaaatagaaaaaaaaataaaataaaagtacatgcctgttgaatcttagagcaaatacaatagcaaactataagcaagctataaccacgtatcgagaagaaaagagaagagggagaagaaagcaggctacagatttgtagccgactgcaacacggactccaagacgttatgtgtgtatgagaggtaggacctggtattaatggtgtagtatatttttatacgtaactattgaatgaatgggctattagattagctacagatgatttgttacgggcctgtttggcacagctccagctccagctccacccctcctagagctggagctcaggcaaacagtttcagctccaccaaaactgggagtagagttgggtggacctctctcacaaaatatactagagttgtggagctaggtttaggcagctcaacaactccactccatactcaactcctgaagttaattttaagagttggaactgtaccaaacaggccttagtcagcagttggctatactattgaaattgctcttagcaaacaaaatatcgcctgatttttttagttctgtcaattccaaagggaaaaaggtcaatgttctagatgatcacgagatgattgaaacaattggtggcatgaatgcggttcaccttccatgcaatcaattactcgtatagtcgcatgtagctcttcataccatttcattaggcgaaaattcacaagttattctaatcgcacgcccaatcattgtcggaaacccaacagagaaagaaatatagggcaaacaaagtatgcagaaaaagcaacacaactactccagtagttagattgtgcaaacaagggggaaaaaaacgactcctgtcaatctacatatccaataatacacatacacatatgtacaagtacaaataatcacatggaagctcttcttttttttctctcacaacttccccgtgtgtgattccctaccacgttcacaacttcacatgtcgttcgcaataaaccgacttgcagagctgtattcctcagcgaatcccccacatttcgcctgttctgacttcacgcctccaattttgacttcattaatcccccgtgcaatagcaaagctatagattacgctaatcacacaaacttcaaattgcagtaggcttcaagtcaaaggttcgaaacttcaaatcccggagaattcaaactcgaaatctctctttctcacttttttgagttgaagtggtcattcgccctgacggtgacggcttgtgtccggcgatcagaaggggcggtggtgagtccggctgaggccgttcacgttggcgaagatgcccatgagatcctggcggtacggcaggaacgtccgccgcgtcgcgccgccgtgcgccttgtggttgggggagtaggacagccggtggccggcggcgatggtgtcgagctcggtgtggagcttggtggcggcggcggcgccgcccttcgtcgtgggcttcggtttggggtgatccctggccggggacgacggcgcggagaggaagcggaacttctccttgccgtcgctgtggctgcggccgacgacgagctcgctgatgcggcgccaccgcgcgatggaccccgtcgacccgctcttccgcggggggcgcgacggcgaggacgccggcgacgacccgggcacccagacgcagtagctgtcgggcgacacgccgtccagctcggcgatgtccgtggacgacgacgacgacgacgtcgacccgacggacgaggtccgcccctcctcgaggaacagcctcccgagcggcggcctccgctcctccgccgccgccgccgcaggcgtcaccgccacgtcgtcgagcacgcggccaaacaccgggtagaacgccctgatgcggccgtccgcgaagagctcgtcggccacgcccccggcgtccgtctccctgctcacgaacgggaactcgaattccccatcggactcatcgccggagaacgccgcggcctcctcgacggtgcgatcgcgaggtctctcttccatggccaccgcctcctctgtgatgtgacgatgcgtcgcggttggctctcgtctcgtgtggttgtgaggtggattttgggagggaaggaaggaagctgccccaagcgatcaccaactaataactagtcagccaacggtgcgtggcgtttatataggcgatcgatcgaggggggacgcgaccttctcgaaggtcgccttcatcacttcgctgcttttatctcgatgccctgcctgcgctgcgctgtttgggcttcgaggtggcgacggaacacgtcactcgtgaggcacgcggtgtgccgttggcaaggttcccgtttccgtgtgaacgggggttatttgtttttttttttcggttttacacatgttttgctactagtacgatatttctggaagaggcttggcggttgcctacaacgagacgtgacgacggacggtcgatcgacgtggttgcttgtcaagcaagctggaagctgctggggagttaattcggtcggttcgtaggatcacacagggcggcaggccggcgtctgtacggtttcggaatacgcatctcgtggggggggggggggggggattatttggtttcgtggccagcaggaaatcggacgtggcgagggacgcgtggccattctccgaatcggggcaaaagaattctgcgagtagctatggtcatgatcatttcaagttcatattccattcgacccgcgtctcgaaattctggaacaactccaaaatgcaatcatcctcgatgcctctaaggcctaggttggggaagattctgagaatccgctggttggtagctaacttctgagaatctagaaagctgggtttttcagcttttggactctcaaaatttgagtggcaatctggactgtttgggggacctggagattctagaagaaggtgcagcagctagaagctccctaaacagaccctaaatcttgcttaaggggtggattaacaagccagcttgacttgttcaagctcgttattttaacgttaacgagctaaaaggctatcttgctcggctcaaaagctggctcgttagacttgttaccgagctatttatctttcttattatatattgataatttcaaatttatcattttattacatattccataataataaacatcaaataataaagaattcactaaatataaatagttttaatgtaattactagactaagctctagcccatattcatatagatgtaaataaatataggtatacatatatgtctagattcattaatatatatatatatgaatgtggaca

SEQ ID NO: 43014 - DNA, 7147 bp, Oryza sativa
cccccagttgctgaagaagatgaagcggatcctgctgacgaggagttcttccaggagcaagccggctacgatgagttttagggtttcggcctagttcccaagtcgcgcctgtgatgattggtccaagtcctggcttccgtttccccttttgtattgcagttgtgagctcgggatctgtccgtagcccaacataactgtattccaactctataataaagagacctctgttgctgtaatattctgtcttcctgtgataccagcactgtttcctgggactggtatcgattaacaggttaatttggagcgtcacaggctagttccagtcggggctagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttccccggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtggccaggcccactctctagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcctgtctggccgaggagggtgtcacctcagttgacactatctcttgggactcaggccgcctctgccacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcactgcgcggaagcgtgttgttggttcttccaccgtgttccgtttccactacccagctcccccaccgctagcggtccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccatacccgttgtatcaggtgtttttatgatttgaaaaatccagtttatgcctagtgtgtgctatctgagttgctattttctttgcttcttgccctcctaagtgcttatctgactcttaccccgccctcttctgggagtttagatggctagccgcccccgccgtacagctcgtgcgccagcccgctttggttttgaagatggtagagtcgaaccagaagcaaatcatgaatcagctaatgagcagtctcaccacagcaaccgttcgcaccgtactgtttcccgcaacgcagaggttgagcaaccccgccgcagcagccgctcgcatcgcacagtttcccgtgatgcagagatggaacagtctcaccgctctcaccacactgccagtcacaattctggagaagaacgcctcccttccccacctcatgtggaaaacaacatgcaacacttaatggcagttcagacacaaatcttgcaaggactaaccacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactccggttgagaagacgctctacgcctctcaccagttaagaggacctgccgcagattggtgggagaattactgcaatgcacaccttgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaataagttggctcggtacgcccctgaggaagtggacacagacaagaagaagattaggaaattcttgaaagggatcgcagttggaatgagactccagttgcttgcgcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgccctcagatgaaccgtccggcacctccgccacagcagcgtgcccctagtggcaacactgcgccaaacagtgttacctctttcaagtcaccacagggaccgtcagcagttcagtgtttccggtgcaaccagatgggtcactatgctagacagtgtcctcagaatcctaccaacaccaactcaggacatgctaatggcagcactgccagaactcctactccagcggcagctcagtctcgtcctagctctcaggcaagtggacaaggttcacgtgcttccaacaactttggtcgaggccgtgtgaatcacattcaagctgaaaccgctcaggatgctccagacgttgtgatgggtatgttctctgtcaacaccgtacccgcaatagttctgtttgattcaggagcttctcattctttcatatcacaagcttttgtgaaaagaaatggttggaaaacccaaaatttgcgtgtaccaatgatagtacattcccctgggaggaatataagggcaactcaaatatgcccggaagttaaccttagaattgaggaagttgacttcctagccaaaccgatagtcctagactcgcaaagcttggacatcattctagggatggattggttggctaagcacaaatgacagatagaatgtgccgaaaagtccatcaccttgcaaggacctgaggaaagcaatccgctttacccctaacacccctaccgcaagccggtctattctaacctgtttacaagtcacctccttggagtcggtgcccatagtctgtgcataccccgacgtatttccggaagaattaacaagaatgccaccagaccgagagatcgagttcgccatagaactggcactaggcactgccccaattgcaaagagaccctaccgaatggcagctaatgagttagcagaagttaaaagacaaatcgaagaattggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaactcaaaggagcaagagttttctcaaaaattgacttgaggtcaggttaccaccaactgaaaatcagatctgaagatattccgaagaccgctttctcaacgcgttatggtctatacgagttcacagtaatgtccttcggactcaccaatgctccagcgttcttcatgaacttaatgacaaaatctttatggaatacctggaccagtttgtcgtggtgttcatcgatgacatcctgatataccccaagaatgtgtcagagattcgcagcttccttggcttagcgggatattatcgaagattcattaaaggattctctaagctagccagacctatgactgagctgttaaagaaggaaaagaaatttcaatggtctgcagcctgtgaagacagctttcaagaaatgaagaaaaggttgaccactgccccagttcttaccttgccagatatccgaaaagatttcgagatcttctgtgacgcatcaagacaaggcttaggatgtgtcctaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgtgaagtatacaccgatcacaaaagtcttaagtatatcttcacacagaccgagttaaatatgagacagagaagatggttggaactaatcaaggattacgaccttggaatccactatcatcctggtaaagccaacgtggtcgctgatgcgctaagtcgcaaggcctattgcaacgtagctcaaatacggcccgaccaagatcacctgtgcagagaattggagaagttaaggctgaccatggtacagtcaggtgtccctgccagcttgacagtacagcctaccctagagtcgcaaatccgggaggcacagaaagacgacgaagggataaaagagttaataaaaagaatacaggagaagaaagacaccaatttttccatagacgatcaaggcacagtttggtgcggtccacgcatctatgtaccggccaagaaggagttaagagatctcatcctaaaagaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccctagcgggtacgactccatttgggtaatcgcggatcgcctcacgaaatcagctcatttcgtgctagtgaaaaccacctatgatggaaagaaactagcagaactctacatgacccatgtcgtatgtagatttggctgtcccaagaagatcgtgtcagaccgaggcactcagttcacctcaaggttctggaagcagttgcatgaagctctcggaactgatctaaattttagtacagcctaccatccgcagaccgatggtcagaccgaaagggtaaaccaaatcctagaagacatgctacgtgcgtgtgccctggatttcgaaggcacttgggatcgttgtttgccgtatgccgagttctcatacaacaacagctatcaggccagcattcagatgtcgccgaatgaggcaatgttcggaagaaagtgccgcactcccttgtgctggaatgaggtgggcgaagcgctagtattcggtcctgacatactcaagtcagcagaagaacaagttaagctgatccgagaacgtttgaagacagcgcagaaccgccaaaagaattacgctgacaatcggagacgtgaccttgagttcgaaaaaggagatcatgtatacctgcgagtatcacccctccatggtatgagaaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagttaaagaaatgtcttcgaattccagaagagcaagttcccctgggtaatatcgagctggaaaagaatctgacttacaatatatgttcgttagattgtacttacatctacttatattcacttacatatataattttaagaatttacaatataaatatatgccgactattttttataaaaatacgacgacatatatagatagttcctaaaattttgctctgcatggtgatcatgagcgacagatcttgttgcatgtcaagtctactctagatcaattcttttcttccttaacaaataaccgtacaatacataggaagtactaattaagtgcatcctagcttcatttaattctcattcaaggcacccactcttctcacatactcttcttgtcctaaaatatacagtcttcgttccaatatgtagcaacctaggataggaggactacgaatatggatatatgaatataatcccatcatatcctagattgcagtatattgggacgaaaggagtagtgacttaagaaaagatatattggacataaccttgtacaatatatcaagatatccttattgtaataggttatgtctgatcaactcctagattttatatttcgggacaggaaagtaatataactgaggtgaactattgtcttccctagtgatttgtacatgtcatccaaaatgtaactaaaaagattttttttaaaaaaaaacaacaagatagataaatataaaatatatctatagcgcccgttccgtcgtggcacctagcgggaaaattatctcttaaaaaccctaattgcgaaatttgtttctttgcttgttgtctagtgtccgtgccatctcaagatctcaatccccgatctatcgtcgagttcaattccgaatccaaatccctccaaattaaattcctccgcaaaagtctagtttgcctccctgggttcgatgggccgaattccgctcggcccatctctccccggccccctctctcccgggcgccctgccctccttctccgccccgcccgcgcgccgcgcgcgcgtgcgcgtgagccgccgcgccgagcgccccctcccttttccctcgctctgtcgcgcctg

SEQ ID NO: 43015 - DNA, 1185 bp, Oryza sativa
taaatcggagctaagatgaattagttatgaatttttaaagattaaatcggattacaacacttaaatcggtttaaattgaattatgacgcaataatgaattatttttgaaaaggaaaagaggatttattgcgtcagcgggctagggtttggtggaccgggcgcacgggcgacggttcacgcgaacggacggccgagattgatccgatccaaatcggacggccgagatcgaacgagtccacggcggctcacgggagaggggcttgatgacgccagcgatgacgtcaccgacggcggcggcggctcggcaaagaagacggctcgggcggcggacactcgccggcgaacggcggcactaggacgcaaacggaggacaccaacgggtagcggacggcacggcgaactcaccgacgaccaaggcgacggcggacgaccaacggacggcgacggcgacgaggaggaagcggcggctaccttcggcttgacgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgacagcgaagctagggcgcacggcgctaggacgactccggcgacgagaggcgaaggcgagggtggcggcgagaagagaagagcacggggatccttttaaaggggctcggaggcggtggcgaaggcccacggcgacggcaacggcgaaggaaaccttcgggaagaacgaatccgagacgaactcgaatccaactcattccaaaccgattgagccaaagattccaaaggagaaaaggtagaggagatcatttcccctctattgattcggccggagaaggaaaggaacggccggattggaaaggaaacagcggcggcggctcggcggcgcgaaactagggtttcggcccgaggaagacgacgggcctgacaggtgggacccacctgtcagcggctgcgagggcgcgcgcgcgcgcgggcggctgcagactgggccggactgggccgagaagagagagaaggcggttttgggccgactttcggcccaaagccaaaagaagactttttaaaactttttcaatttaaattatttcttaaatgcaattccatttattaaaaatactt

SEQ ID NO: 43016 - DNA, 990 bp, Oryza sativa
ggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaatgtttccgtattcgtgcccgatcatattcgatttttgttcgtatttgagataatccgtattgtttctgtattcgagctatccgtatttgtttttatatcggtaaagaatatgaacacaaatatgatacgagcattatctatctatatcccctccgttttcatcccacatcgcgcaatcgatccccgtgccgatgctgcctccgatggtgcgtccccaacgagtggcggtgagccgtcacaactcacaagacctcactgagatgggctagcaagcttggtgggctgggcccaggatcccaggggcccacaggcccagcctttttccttctccaagaagggcggcccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgcggcggcgggaatggaggtggcgccggagacgctcgacaccctgtcggggtggttcgcgcagtcgctctccccggacgccgccgcgcgccgcgccgccgagcagagcatcgagtcggccaagtgctcgccggggttcgggctcgcgctcctcggcctcgccttcttcccgcgccacgacccgcagt

SEQ ID NO: 43017 - DNA, 703 bp, Oryza sativa
cattcgagcagtgctcatcgtcgttcgcgccaatcatctcatcctgaagcgctccaagtgccacttccgcgaacagcaaatcaactacctccgacatgtggtgttcgcaaacagggtgaccatggatgtgcacaaggtgtgcgcaatggcatactgtcgcaaccctctccgtgggagccgtccgcagcttcctcagcctggctggatactaccgtaagttcattcgcaactacggtgcgatcgcagcaccattgacggctatccttaagcgcgaagcattccacttagggatgaaaacagtcggaaacgatcggaaaatagcctcaaccatttctgtaaccatatttttctcggaaacgatatcggaaatatcgaaaaaccggaaacggaacaatacggacggaaacatatcggtacagatcggaagtcggtaacaaatacggaaatattaaactataaaaatatatatttaactttacataagtatgttatatgtatacataagtatagacatgccctataaatatcgatatatttagaatacggtaattaccacattataagaaacggtaatttccacgagaatacgataaatacggaaacgatcggtataacagcaaaaccatttccgttttcatttccatattttttgccatttccatttttgtttcggtcgattaccatttccatatggctcggccgg

SEQ ID NO: 43018 - DNA, 1672 bp, Oryza sativa
  unsure (1)..(1672): unsure at all n locations
nnnnnnnnnnnnnnnnnnnnnnnnnnnnnnnnnnnnnnnnnnnnnnnnnnnnnntgatcctggcaagctcctgcaattctttatttgtttttgtagccttttttacttcccctcaaggacataaacaaatgatttgggttgtttcacacaatgcatgaattgaaacgaatcattaatcataacatatcaattaaattggacatgactaaaaaggactggtgcgtaaacaagttaaagtttctctcctaaatgcataaatgaagtagatgttctattgtatatttaaataattttagaaactagcacatatatgtaaaatcaacatacttctatggttctaccatctaaattgttgcaaaattgttgagttcactactcagaaaaattatgtcaatacagcaggggaggacctaccagtacagcttctgcaaatgataaaagtagaaatatgtgtctcaaacttcacaaaataatgcctgatagatataagaattgagaagaaatcaccaatctacataccgcagccagtcacaaaaggcccacggacgtacacagggaggaccccatggaccatatgcatcaccaaacctaccttcagctaataagagcacaatgagcttcctgcaatagacaacaagacaacagtactcgggcaatcgcctcagtgacgagctttaaggaagacggactaggccttgatcttcatcttctctccttcagtcttccctactgccaatatctcttccagcaatcttcttccatctagcagggtaaggtccagcttatcactgttcttcttctactatcattctgttacgagtcctggatctatcataagcactgagcagcctcactcccacacattgttatgcatcttatcatttggaaaattacttatatatatcataaaataaactgaggcttgtaggtgccatatacttaattcatatcagggtactggaatagagacatgaagctgtataacattctctcaccaatgtacatatcaaacaaaaatgcaataattaggctagtttccttaatataagtttagaaaatcaacatgatgggctcatcatacaaaaaaaagtttgaagctttcaagctccaagcatatagcttgcatgaaaagagaactgtgcagctaaccatagcatttctatctcacaatgaaaagactgggatattttccaaagaacctagcaaagatccatcatgttgaaatttagtcactattcagcataattagcctcttcgaccatatgcaagtctgcaaacagggcacgcatattcataaatatgaacacataaggtcactagcttcattgcccacacaatcatcatcaccagcaactcaaccagtccatggtcactaccttcaggtatttgaaatatcagggggctagtggttcacttaggacaaatgcttgaataagacttcgggctgcatgcatctggtctggtgtgccggatatcaaaatagcagtgtccattgcattacccatcggatctgcgacagttatcttagcccctgaaaactgcacatggcttaattatgtcagatgatacatccaaccatttactggatatgctacaaaatgcactagccgaatacaaacctcacgaattctgtttaaacagcctccatcttccccacatagagaaggtaaaa

SEQ ID NO: 43019 - DNA, 1197 bp, Oryza sativa
ttttcattgctgttgatcaacagataaacatattcaagccaagacaagaaacaaacccaggaaatccacccattcctctatgcgccattcctgggatatcaggcaatgaaattggatcaccaacaacctgcatgccctacaaagtaaagaccacaatggtaaggaaaatcataaaacttgtatatagtagtatacaagctattttcttcccaatcatacttgtttaccatgttacaataccaatgcatcatgacatatcttcaaccatcaacaattttcctactctagtggtgactataaaacacttctgacaccaactttaaattacttattctcagaaaaaggggtgacacatatggcaccgaaaaccaagaaggcaagaacagatcttgtggaatgtcacactcatgggtaaccaaatttggttcccagccaaattgtcaaacaaagcaaggtaaacacatactccctccgttttttaatagaagacacctttgacttttgacatgacgtttgaccattcgtcgtattcaaaacatttttgtaaatatcgtttattttgctgtgacctattttaccgttaaggaactttaagcatgacttatatttttgcatgatcgcactatttttttttatataacaaatggtcaaacaacatgtcaaaagtcaacggcgtcatctaaaaaacagagatagtaccatttcaatttgtatcctaagagacactcatagggacttcagcttaatattgcaaacacaacaaaggaactccaggctgaaggcaataccaccagaactttgtaacaaggtaggaacacatctggtgccaaatatacataaaacaggaaattgtgctggtctttgagagcattgcaagcatctcaacaaagggagaatggagaaaaaagattcaagcaactcgcattctcatgcatggtccatgacatcttaaagtgaaaaaaaaatacatagattgataccttcatggtccaaggagcagacatctcatccaatggtcgtcctataaaatctttatgaaactgaggcacattaggaaaaatcctaggagatatagaatcatggtttcccgcatatgaaccaaactgaggatccaccaaaccaaaaggtggctgcacattagggactgttgaagccattctgtcccggaaaagatggttccgcagtcttgcagttatc

SEQ ID NO: 43020 - DNA, 1344 bp, Oryza sativa
acatgcagaattgcattctgtgcaggggaaattccatcacccggatgctacagaatagagacaaatgaatttgaatacattagtcatcagtggctatctatcttgagaacacactagacagtaataataagattgctcagagctaagtccattgcaaattacaaatttctaacaactgcctcaggtgtcaaaattaagaacaaaagctgcgaagcagagaaaattagtgcagaacacaggagatgtaattaaatttttgttacatccaactttctagcacactatgcatgcccctctcctgtctcggtgcacataaaaacaagagttctattggagttttaatattgagtttttcaagattaacagcaggctgcccggcaactacattgcactaatgttttgcagtttctatgcaatggtagccaatgcataattaaagacggaatatcaaaaagtatgtgagtaattttttagagcattgaaatattcaaaacactagaaacagtgcagtatgcagaaatatgcatctgttggatatattttgttgagatttatggcaagctgcctcgcaactatgttacactaatatttctccatttctatacagtggtacaaatgcagaactaatgggagaataaaaaattatgtaaatacaatactaatatttttcagagaatctagatattcaaatgctagagatgcagtatgaaaaagatatacgccctatagttctactgaatgccatgtttctcagacagatggatcctgaatatatttctaggactaatgggctactagctactacaaagcaggttacaaatggactaaactgatattgatcaaacgaatattatcaagagggaaagaagctggttaccgcaggtcctgagataaatacgatgcgatcttcagattttggaacagtatcaagaacctttatttcacagcctgtatcattctgaatagacttgatattgtttccacccttccctattatacctccaaccttgtcacttgagcataacaacctaaaagtaaggggttcaggtgggactgagccatggccatgcattagagcttcaggaaaattgggaagatgagcaacatttggcccttgaaaagggagatggagattaggttgcattcctggaggaagaacatctggttgattgaagaatgaacgagatgaaccagaattatgagcaccaagaacatcactctccttaggaggatgagtaaatagcaactgagcaactgtattcagaactttcctgactgagtcgagctctccagtgatctgaagaaatgatatttgaagggagtatgtaatgattttctgatgca

SEQ ID NO: 43021 - DNA, 8238 bp, Oryza sativa
agtggcgaatccaggataaaaatggaggatgggctcaaaagtctaagccaatataactaaaatcagaattcgtacccttacacaagttaaattcaatgcacacacatcaaatagaaaaaaaaactataatcgaagtctctttggtcaatttatgctctcatcagcttgggtagacaggggcggatccaacttgggacatggggggttcagttaaacccacaaacttttgggggaacaaacaaaccaaactgttacttgtatattaaggttaaggctctggaattaagagaagagcttcttacagatctagaagagaagctagggtttacgcaagcaaattccaaacggaagcacacccggtgggagagagagatgaatcaagctagggtttacgcaagcaaattccaaacgaaagcacacccggtgggagagagatgaatcagaaagaggatgtggatgctcaccagaatcccctcccctcccctgctcgccagatggaggtcggcgcccctcccctgttcagccgcaagatggcgcaagagcggaggagacgagacgggagattttcttttatacgccatggtattttcttttagcaatatgtaaaggtatttgcaaccatctatagcaaattagttttgttaaatttaggattaatatattttggtaatatgtttgatttgtgttatattttcctatagactcgatcaaacttaaataaattttactaaaaaaaagtcaaaacaacttatataatataaaatagatgaagtactttaaatgatgctaatgatgatatctaagttcgccttcaaatcacaagctatcatgtgggaccacaagatcctcacacgtgaatacttttgtttttttatatagcattgtatgcctaatcaattaaactgtggttataaacttatagtttgtgctttcacttttgatctcttataatatataatatgttgaacgcacagacctttagctagttttttataatgactggtgacccatatatcaacagtactgagagaaaaatgtgacaaacaatatgtctcttatccttccttatcatcatgcacgctattattatggtcatcattgaggccgggggtgtcaggcttacagggactcagggaggcaggagtcgacctggtagagagtggagatgctagattcgggctcctccttactatatacggtagttctcccgcaatcaaagggaagaataaaaagaggagagagagttagtgtgtgaagcggtggcagattcattggatttggaggtggagtgacgatagagccaccgaacttggagatggatataatgggatggtccaagttgaaacaaaattgtaaagttagttgttgtcaaagaaaataatggttaaagatgatataatatgaaaacttttaagaatacatagtacaaaatataatttactttttttctctggcataattaaagatgagttgttcgttagccgatagttccatgctatgctaagcccactataattttattgtctctacataatatgattggtcggtttacttagctactactaataatctcatgatatgttggcgtgtgatgatatgggcttctgctaacacgggctgattaattatggttggatagatttggctaaaaaataaaaaacaataacatcaattttgcttaatagtacaacattcaattgtggtctcctttttctcactacatgatatatgattattctctcttatcaatatgtgcataactatattagtatttcccctaattctttcatattgttttttacatatatgttaatttgaactaatatttttttctcacaattaaatagataataaatcgtttttccatatttatcgtacataaaatgagtatagtacattgtataatttggaaattatattacaagtgtatgtaatttaatgtataagatatgaatttatatactacaagttttgactctttcaaaaatgctgcaccacattagataggtagttaagtgaaaaaatattaaaaaaaacatagtcaaagccgtttctttatttcattcaaaacaagacattttggaacctcgagagaatgtaaggaaaaagagaggtggtgagcttgacagcttaaaaaaaaataacacgttgacgtgaggtgagagtgagattgttgcccagctagcgttttcaacgttcggtagttggccgctaaattaatgccaccagatataggtctttttttctttcggtttcattctatgcaaaacttattgtaaatctctaaaatcttagagtaaattttacaaaactatatatatattgaccaaattattgtaaaactatagatgtaagatggtatatcacaaaactacaaacttaacaataaatttatcataaaactacagttttattgtcttgtagttttattgtccatatattttattataaaattatcttaaaatatattttggggttgaaatttttagcattaacgttatctttgagttataatgtccaaactttgtgattgaattgatataaaacctgtagatatccttttgtaataatccaccttatatttgtacttatgtgataaatttagtgttataaatttgtagtttgtgatacatcatattaaatttgtagttttgtgatgatttaactaaagtacctgtagtattatgaaatttactcaaaatcttaatacaaagatacatacaacttatacatattctccaaaatcagttaacccggtgaaaataaccaaatcatcacgttatgctaataattcgatacaatgaaataacctgcgttttttcttcttctcaaacatacccctccttaaaaaaatatattctagcaacgaacctacatgtatgtatccagaatcgtagccagagttagctatcactgtaaccacgcatgaaaggcgcaacaatagactttcaacgagacaaatagctggttagcacggtacatgagacacaccaccacacccatgagatgacgagcccatgacgtgtaaaacgaaacggacaacaacagaaaagaagcagataattcccaattgccgtgcaccaccggagcctcgacggcggcggcggcgcgcgccggcgtggtggggcgggcggtcatgaggtgcacgcccatcacgttggcccccacatctaaatccccgcacgccttttctcgtgtcgcctactcgcccccccccccactttgttttcggagggttaacacatgcattaggtgctaataaatcatcatccagtataagagcaagtttaatagcatagcccaatacttagttccaattcacttataactaatctaatagccagttcatataatatttgcttactatattattaagagcacccgcaatggtaaagtaagttgctctctataaaacatgtacatctcagtaatagactagattaatagtaaaccacctcaatagtatgtctacatgggtatctatagctctctcttctattgcctcgtttttctctacagactatctccatgttagtagatagctttactctctctctttatttaatttattccaagtagaaaaatatgctgacatagatctcttttagagagcctatagataaccattacgggtgccctaatatatggtctcacatatcatatacatattgcgttttagagtccatgctgtagctggctacaaatctgtagcccgcagcttttctctcttatcttttatcttattaaaatatgtttatagcgctgatagtctgctattgtagctgctctaatcacccggggtgggggccagccgcgtcatggcgcacccacgaacctacccgcctgagtcacgcctacatggcccccaccaccccgccccctcgttggccccacacgtcagcctcccgtggcggacacggcacgagtgagggaagggcagagtcattagcattagcgccggggataggggggtgccctgaaaacgtgtcacgtttttccttaaatagagttcacgtttcccaccacctcgtcacgccacgcgcacacgcgcccgatgggccccccagctcacccggcgaccctaccccgcctccgcgtgactgcgaggtggggcccacctaaccgtggtcccctcacgtcagcgtcgcgtgcgatctgggggtggacggggacgtggtgcagcacaaacggggggctcctcctcctcgggcgggggcgcacgggtcacgtggcgtcacgagccccccctgagtcgccttcccgatcccccagcgacacgcgccgcgcacgtgctcgctcacgcggaggaggaggggggccagagccgaggcttccccggctgacggctggagccgatctgagctgagccgagccggtgtgggttcacgtgaaggcggagacgagaggggtcgacttgcgtagcggccaggatcttctgcggtgatcaggcaaagggaaaaaaaagaaagaaaaaggaggtgtatttgttttaagtgaaaccgaaagagcatatagccgtagtttggtgatgtgtatacagatgtaaagttagaagtttagtgtcggctggagcaaagccgtgaaggtaagagagaagcgtatatgagcatatgagattttttgtacgctaccaaccacattatgctactactagaagatatgcttttcatacagggcaaatgtattttttttataaaaaattttctaaccacaaccgtcagccatgtcacatgtgatgttttattataaagctactaattcctagattaatattttggtagttcatctaaaacttgtcgaacaggtgccgatgaattttgaacacatatgttgtggattatttttgtgatattaggtattgtttgatattgacgacgcatatttctgcctcttaccatgagtcggtcggcctaggtaaccgtccctagtggccgggtcttggctttgacactaacacaactaatgttttcgtttcctatacacatatagttttttaagaacaaaatcttgctattaacagttaccttccatgtgcatgaagatttgtgccccttctcaccttcgtcgagttaccaaaatttggttccatgatagtaccacgcccaacttcactagcaaccctcgccaccaccccctagaggcaggggaggttgaggtgacgagcacaaacgacttaaacatgtgtaacaagggcataacaatcttattgtcgctagtctcctatgaaaagtatgagggctagagagaggattggcagtaacgaaggaagccgataggactcgtcggtatatatggtggagtttgaaggcatcgcacgaaataggggaggcaatgaaggaagaagggggaagcggcaagagggagtattatggttagtctgggtcgacaagcgatgctttatatagtgaagtgtcaagatccaaaccactcagcagagatcatgctagtggaggggaaatacttgattcaagtttttatcttaggtgtagcacaagacccccaacgtgtgtaaatcttattcgtcaaggtattgagatttcattacactatagaattattgtaggttccttgattaaatccttagagcaacactaagagactcactagatggctctccaagctaaattttagcaaatatcaaaaaatcaacctccaaaatacttgccaaccagttggccaaatgcctccctttgatgttcaaaattgccagccataatcaatggccattcatgggtcccatgctgatcctctctttctctctcctttatcacctttgcgagaagacgtgactcacacgcacttcctctagctcgccttgtcccagcgccaccgttgttgtagtccatcatcatcgctaactcaagcgccacatcccccgggcacctagtgccaccttacccaccctcccctagcccaagtatgccttgctccaaactactacatcgtcatcttccgtcatcgtccattatcaccaccgacttaaggcgatgcctctcctagcctcctagtgtggccttctttcatagtttcccacccgttgttaagaaggacggagcgaggtcaatagggccgatgacgtcctccaaatcccaagctctacatccccgtctcctcctttgcaaggctgtctatgtagacgatgtcttctcattggtgatagaaggctagaagtagtcattggagagggtagatcgagaaatggcatggaggagaactaggcagaggggaagtatgcgagagagactaacatgtgggtcccactatcatagtggaaactatagatggagagcttgttggagcacacataaaatatggagaattgaagagggatctttttggctagctagccagccaaatgggcaaacaaagagcacaatttgaaaagagagtttagagttgttcctataaatgcatttctctccaagtttacaattgagggggaagaaactctagtttggcttgcttattctacctttacaaccatgattcaattgcatcttaatcagatttaatcttaatagctaaaattacttgcattgctcaatcctattaatgtgttaattcatctttgtccctgcccaaataaatgtcacgaatgccacatccgtcgtggtaaaagaaagcaatatgtcccaaacaaatgtataccaaaatggcttggagcgagtttcccccttcccccaaagccccaaaccgctattgaatggcttaggcatactatatccgccacattgccatatccgggaaagtccaaaaatatcttacgaagtacaaaatctttcttatatccattagtgccaaccgagcaagagggtggggaagggcataagaccccatggttttgaaatttaataaatatcacaaattctacttccattggtgaaagtaagcaagaggtaagctatggcttgtagcgagccggtcctctatgctctatgaagtggtttgggttattaggtatcctacatccatcaacacttataaacatagggaagtttaaatacaacctttttatacacattagtgcctaaggggaggaagaactgaagaaggtagacatggatacgaaaacccctggttttgaaatttcataaactaaatttatttaaaacattgtcatttacccaccagtaaattttacaatttctagctccttcaatattaacataagattgaagaatccatctaattaggatacaaatattaataaaccaaagtcattctagtaaaaaaaactacattataaatcacttatctcctcttgtggcttaacctgattaacaaatagaccaatccctcctcaacctccgtctcctcgaatgatcaaagagcacgtggccactatatgagcaaaccaattgtcctgagctgacaagagtccaaggcttgaattgagctagtttctccacccccacgagccacggatccatcggctcaggttccagtcccaccgggggtagagaaagcaaggcaccctcttcgtcctcctctcacaccttccctcttcacacatcacgcgttgtctcctcctccccttccccttcctcaaaatctcctcaacacgccgccttagcctcagccccagctcctcagccctgcgcatgcttcgatcttggtgaattcagggagctcgtgaggttacaattaaggggaataaacactagtttggcttgctcattcaacactttgcagcagggtccaattgcatctaaattatctgcagtggtcaattctactcattaattcatttatgtccctgcctgaatgaatatcacaaataccatatccatcggtgaaagaaaacatgcggacccaaacaaatataaacaatggcttgaagcgagccggctctcccatacgccacaaagcggctcgatatcctatatctgcaacatcgctacttttaggaatgttcgtaaatatcttatacatgctagtgccaatgggagtatgatggtgtgttggaataggggaaccagccccatgattttgaaattcaacagactaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctgcatcgactcgacttgaatgctcgtagagcacgcaaccacactgtgtattgaaacaaaccacc

SEQ ID NO: 43022 - DNA, 2149 bp, Oryza sativa
aaattctggttgcacactttgtggacgatttgggttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaagatggaggctgatgaggatggtgccaatggcggaactggtgggacatggactgacgaggaccgagcgctcaccgccagtgtgcttggaacggatgcttttgcttacttgacaaaaggaggtggtgccatatccgagggccttgttgctgcatctttgccagtggacttgcaaaatagactccaggagcttgtcgaatcagatcgtcctggtgctggttggaactatgccatattctggcagctgtcgcgcacaaagtccggtgaccttgtccttggatggggggatggctcttgccgtgagcctcatgatggtgagatgggacctgctgcttctgcaggtagtgacgaggccaaacagaggatgcgcaagcgtgtgctgcagcgattgcactcagcattcggaggtgttgacgaggaggattatgccccaggcattgatcaggtgacagacacagagatgttttttctagcatctatgtactttgcatttccacgccgtgctggtggccctggtcaagtatttgcagcaggcgtgcccctgtggattcccaacactgaacgtaacgtatttcctgccaattactgttaccggggataccttgcaaatgctgcaggatttagaactattgtgctagttccatttgagaccggtgtacttgaactgggttcgatgcaacaggtagcggagagttctgacactctccagaccataagatctgtgtttgctggggcaattggcaataaagctggagttcagagacacgaggggagtggccctacagataagtcaccaggtttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggg

SEQ ID NO: 43023 - DNA, 3496 bp, Oryza sativa
gacgcttgtcaatggcatttcatggattatctcttttttaaatacactgttgatcagtttggaaagcggtatatgcaataaatgagggagttttttttccttttaacgtgggcgagatatcaatagaaactgtctacgtaacatagcacaagaaacagatataattgagtaatgctcctattaaatttaactctggaccatgtttttagaaagccattttgcacacttttattgatatgaaaacacagaacgttcagtaaaataaggggctcatcaatacaagaactcttcaaatcaaattagatgtatgtttagatagaacatgtgccaaaaaatttggcttcccggcgaagcgctcaacagagacttgcaaaatcacgtcaaaatattgcattcatataaatttgttgacgaaaagccgcattgtttccaccacttggaagtgtggctgcgttctttcaagggagagatagggaagattgtgactcgttttccacgcgcatgcttttcaaattactccctccgtcccagtatgtaacaagttttaagctcgtggacaagtattaaattttaaactggtaggcggcaaaagcacatacggcaatacaaactagtactctattcttttcttctctttcactgataactatgctgaggggtagaattggtagatttctggtaaaagttgtactaggttgtaacatttgggacaaattttgaatgccaaaacttgttacatattgggacggagggagtactaaacagtgtgttttctgcaaaaaatttctataagaaagttgttttaaaatatcatattgatccatttttaaaatttaaaatagttaatacttaattaatcatatgctaatggctcacctcgttttacgtattttctcaatcttctcttttcctctccttccttgagggcgtaggcttatctccccatcaacaacatggggtaagtacctgaaagaaccaattacaaaatttccttgcgcatctcgtatgctctggctcctctgtactcgaaagaatgtcaaaaacaaagcatctacatttaccttgagagtttcttcctgtaggaggtggtttatgccatccttcatgtggttttgtatctgttttttgcttgccattttataatttagtgcaagagtaataatagatatagctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtaggatgccggcggcggcggcggcggaggggaaggcggcgcgcgcccgatcgacggcggcgacagcggacgccgcggccgacgacgtcctgtacgtcttcgctctccttcgtcgacgtcgtcgtcttctctgtctatgagaatctagttctcgcggtttgatcggcatatccacaggatgccgcggggcgcggaggcgaacaagggagcagcgggcgggcgcgcacccccgcccccgccgcggcggcggcgaccgcggggcgggacgacagccagtacgattccccctctccttcaccttctcttcctgagaatattgcgttctcgcgagtaatgacatctagcattgcaggactcgtcgcgtcgatggaagcgcggctggagtttgcgcgcgtcagccggcgaccgcagcgcgggaggtgggcacagcagcagcaggaggcgtggctctctggttagttcgtcgtcgtcttctctgcggccggtttttcggttgagagtttgtgaagcaaggtggtttgtgtgtgggggtggggggtggtatccggatcggtgtgtcctttttttttttgaatcgcaaattcaatttaattgtcgggattgggggtggtaatggcaatctatttctgtggctggttcttagcgtttcgatgtgtgctgtgtgatgagttcttgatgcggtaggctattgcgtcacttcggtctctagaagcgaggaagattctgtagtgtttgctttcaaatgctttggcaagttcgattcggctgtagatttcctgcaccaaacttatgttgggcttgcaagttcaggaatcttcagtttgctgattgcatatatctgaaggctgtttgcacaattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaag

SEQ ID NO: 43024 - DNA, 1764 bp, Oryza sativa
aattttcttgctgataatgtttattcacgttggtaatctgtcttttttgcaagcagacacgcaaaaaaattcttattcgggatggggttttgtttcaccaaatgaatggcattcgtcacaactcttcatcttctctttgttttcccagcctggtgcacattctatcgtctcatctggcattgtctataagggtcaactaattagatgatgtcttgcaattcttttgtttgttcttcagcttgcattgggagtttaggtactaggaaacggttttctgcgtttagattgcttgctagtttcgatgtgtgttgggaaaaagagctcggaagcgagctgcatgctagcggtccatcatattcaggtgtagtttggccatcaccaatgtgcagtaaaagtttcacaatcacccaattaagcatgttgatgaagccactttgacaagcagcgaccaaacattgcgtacctgtgcaccgttcctaatttctgctgtctcttgtgtaaggaactaagccagcttagttggtcgatagctagtgtgggtgtacacctagaccaaaagttttatcaagttgaatttgggtgcctattttcttgttaaactagatgaatatcccgccgcgttgctgcgaaaaattacgttgcataatatgtacaaatgtaatttgattatcaaaatgaaaataatttgatacaattttgagtctaaaaataattaagattgcatgttttaagatagaagaaagaagagacaatttggaccatagctctatcatccaaaggctagaaataattaggggaatatagcttaatgagagaagagataaataatgtattaactacacttaataagaataaactatagtatataagattacaaagtcgatcctaatattttctttatcttcttaaaataaacacaatgaactcgcatgtttttgtcttttctgtttgaatgatgtatcacagaatgccctgcaaatttgctgacctttttaacctgatacgtcactgatcggactttgaatcatcttttattattgttggaaggaaaaagtatatatgaggtcctcatcttgtcatcgaattacaaaatcatcctccaaccgcaaaatagatatatatcatccctaacttacaaaaccggatcactctaggtccttaggtggttttgcccctagttttgtctaatgtggcagttgagtcagcgtgggacccacgtgggccccacatgtcagtatttccacatcaacaccctctctttcccttcttctctcccctcttatctcccttcctcctctcagtctctctctcacttctctgggcaggtcggccgcggggagaggcaggagaggaggagggcgtcggtggccggcgacaggcgatgcagcggcgacgcggaagaaagggagacatcggttgcagaggccgtaggcatggaggagggtgtcggcggccggcgacggcaatacggcggtggcaacaacttgggagaagggtcgacgatgtcgtggtccaagatggctctagcatgggcggtggtgtccccgggacggcaagtcggtggggagccatgagcctctcctccgaccttaccttcttgcctcttccggcggtcatggcggtgtcagcggcagggatagggctgacgggaggggccctgagtcgttgtcgtgcagcagcggcaggggtagggccgggcggcgtgcagagttgtcgtcgcagaggcgcttcgggtcccagtcccctttccttcacgaattccgc

SEQ ID NO: 43025 - DNA, 6294 bp, Oryza sativa
  unsure (1)..(6294): unsure at all n locations
tcctccgccccctcccctatcaaaccctcctggggaatcgtgactcctcctcccaccacagggactcctcggaagttgactgcgatcaggagtgccgccgcgacgaagactctgcacgaggcgcctgctcccgcgctgccgccgctacgtgactgcgtcgcccgtcgccaaccgccagacctcctcctctcccgcctcgcgccctcgccctgccggccgacttgcctataagacgagaagtgagagagagagaaaggaagaagggagagaagaggggaaagagagagggtgctataatatttataatactaaattagtttcatcaaatcaataattgaatacgtcgacttttgaggtctcgactagacgaatacggtatttgcatggtatggggatcgtcagtaccagggtatatgcgagattgagtcaaaagcgacagagacaaggattttatacatgttcggaccccttcacaggaaggttacaaccctactcctgttggccgaagccggtgttactctatattcatcagaatcatacaagtacaatatttgggataacccatctagatgtcgttgacttggcggcatagataaccaacacatagtcgacgacaggatagttttcctcctcgaatataaactcgccgagatcagagatggcgctagatccctcttgtcgacctccgcaggcaccagatagggtttatttaggcttatctctgatatcgatgtttggcttgtcttggcttgtgcgttgatatgttgtcccttctctcctcctatggggtcttgtacttatacccatagatatctccttgtccaagtagaactagggagaccaatatagataaaatccaaatattccttgtagtttccatatggaactctactcatcctcccttatccggaactccttctatatatgaggtatgatttcgtataggacttggtatatggttggccccgcctagcttagtcaattactattgggtatatggtatccataaccctgacagaatatattttcataataaatttgtcttgggtctaaaatgttactacttttttctacaaatttggtcaaacttaaagtagtttgactttgactaaagtcaaaacgtattacaacctgaaacggagggagtaataatctaaagctagctcttttgctagcttttgattggtccacgtggcacctcttactttgaagaaaaatcataaatttatagtagagaaaaaaaaaaacctaacaatcatatgtgagaaaaatctagagaaaagtatcacatatggatttcagaggctttcagaggcttccgaaactatctttcctttccaatcacacgaacttgtactcctttgccttgtataaatataccacgcctactcgatattactcctataactttagaatatatagtaatcccaaaattattaagaaacaaacaaatctaaaacaactaatttacattcattttcttctttaaatatactacgcctactcggtactactcatataactatagaatatataagtaaactcgacattattatgcaaaaaaaaatcgaaaacaaacaaagaaagaaggcaaccttgtcttcttatgtcatgaaataagatcattaatacctcagccaaaaaaacgattgtgtttttttgttagacaagatattttttaaaaaaactctgaatatactaaatgattgatctttcaaatattcaaatccacaaacaaatatattggaactaattaattttgacaaatctcaaaatttacttgtttagattttattaaaacttatgtataaaatgacagattaaattttgtacttttacttgacatgacatacaagttctatatttttatattttttatgacaaatatatttttcacttctatacataataaatattgtcaaactaaaatagtggttcgcaattttctttttaaaatattttataaaaactctaaaatttcaaataagaaaagaagtatatacatattttaaatagtgagcacaccaattttatcatttagtattttctagtggtaagtatatataggttgagtagcaagcatgccaacggcatgccgatgttttagtgatatgtaaaatatgtgtcaaacgcataaacgactggctgcatcagcgcgaccaaagaaaaaggctagtgtgtactactactaatatattttttcctgtttagttgtatgatgctgatgagtatatgatttcaaattttgccatacttcactaatcctatttggtacatgccaccattccaaaattataatacttatttttacactattttcaatgatatattttgaccattaatttattgtatgttatgtttccaaatgatataaaattagcattacatgatatgattaatatgatcattagttaaaaatttattgagtttgatttttctaaaaaaaattgggttcattataatttgacagagaaagtatttagcaaagtttaaggtttattaaagtttaaaatttagtaagaaataaatcagtgcccctattaaataatgtaggattgtatgtgagagggtgggtagttagtggtatgatgaagaaaattttgaattaaagttaattgatggtaaaaaaatataaagtgacaagtttttgagaataaattttgaatcctaaaaatggagggagaactagcatatgactataggagtactagcggataatatttgcattgatgtaaaattttgccctttcattttttgttgtcagtactgcagtagatgtcaatatagttgagatatcactaacctattaaaaattcgacagtattaaaacttatttaagatttagtactataaaaattttggcacgacattaatccaaacaagcctaactgtaactatttttctccgtcagtactacgtcctgtctttagtatagtagtatactctgtttttctagaattccacctgtgaaggtatgaccggaaagaactgtgaagatgcagaagatatgactggaaaggactgtgaaaaaggtgcaggcaaaaaaagacagcgaaagaattgatgtaagttatgcatgtgtttctcgtaattgcatttttactgtaatcttattgttttgactgattgtaacatgttgatgcacagtctaccatggatagatgggatgggcagctacgtgccactgcacccagctggtgaaaaaaaaggacactgcatagtctgctacgataaagtcagtatcagcacactacactgcatttgcttaaagttcatactaccggcgctgatgccgcgaagtatggaaaaactataaatgttggcttatgtgatactccactaaaatcactatctgagtgctgggacacctgtgcctgcggtacatggtacaacactctactcaagcgagtttgctttgagtttgtgtcactgaatgtttgtttactgatttgattttacaatttgctttagcttttgaagaacaagacatctctttaggggtctcagcctgatagtgacattgacagctaattgagagatgccttctgttttgattgtgagtgtggttttgcacaaacactttacggtcatcacaagtcccactcgtgggtaggaatcatacaataccttggtgtggttttgcacaaacacatggcatgcatgaaccacatttgacttaacccactctcacaaggtttagtctaactcttaatgatgcatatgcatatgacttaatattggccattaaatattccattcataaattgctatacaaagcaaaagagaaaattcaacatatcagtaggtcttatctagccatatggctcgatcaacgccgcttcgagccagtgtgaccaagtcattagcatgactaagactatagggaaaaacccggctattacatgaagtatcgtgatgccactcagtacatctggtggtggttgtggtagcatatgctaattttattgatggatggataagacgaggtgttgcttgctcaagcgataggagaagcggctgctttgaatgtttcatccattactctaaacttgtcagcaggtgcggatgcgtcaatcgcatcagcagcaagcatgaaggcaatggaaactgcggcaacttgtctcttttctcctgaagccatggctgtgtcgagcatagtagcagcaatcccagccatcttggccgtggcctccttagtttccgcctgttttgctggtggggcagcatcaacaacaccatcgagggcttttctgatgtaggagcatgtctcacttatgcacatgtcaacattggaggtgcaatcctccgttggcactaacatggccactttgaagatatctatcattgtcgtaaagttgtatggagacattccaataggaaaggcaccaggaatcttggtgcattccacaggtgaggctagcatggttgacactgtaataacgacaaggattagtgtgattaccttggccatcgtggaatatatatcccaatgatttgatgatggatgattcaatgcaacaagaagtagctaacctaggttgatgagctgcttgctattatgaaagtgggatgtgattgctttaaatagtgtaaggcgatggcctaggaccgcaggagctttgtggtcaaaaattagttggttgcatgcatatgtgccaagtctttgggccaccacgcatttctcccaatcacatgtcattagcgagaagccaggtgtcgggtgcatagtcatggtaactggttgcttttttttgacaatggaatcttttattgaactcggtcaattatatcaaggtgatattactacgctaagtaacactcccagcctctgcatcccaaggatccacacaactaaacacatatgaaccaatttaaaagaaattaagtacaagaagcatcaaggaccatcatcctaagactagatcaccacctatgtccctagttaaaacactcattgaccacccgctccaagtgtagacacgtcgcaataaccaaatcccacgagctcggctttttaagaataacctaggtgtgcatccaatggatagttacaaatatgacatgtatgtgtgataaataacttttctatcaaaaactatatagttcttacgtaaccaaagcaactagcatgtggcagtcgcccctaacaggacatatggttacatatctttttgaaaacccgaaagccaactagtgaccacttgtgaaacactatcgggtggagtaattcttgacgccacaaaaatgatggaccaaactaaatgggctaagaggcattcaaagaaaatgtgtttaattgtatccttattattacataaacaacagttttgatcgccttgctaattatgtttagctagattgtcttgggttaacacaactttacgatgaaggtaccaaaggaaaatcttaaccttcaatggcatatttagtttccaagggcgtctatttatattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaannnnnnnnnnnnnnnnnnnnnnnnnnnnnnnnnnnnnnnnnnnnnnnnnnnnnnnnn

SEQ ID NO: 43026 - DNA, 16574 bp, Oryza sativa
cgccggggacatcccggcgaccaactccctcctcgccgccgcggcctccctcttctcccgcttccgcaatgccttcgacagcaacaccatccgcctcgacctcaagtactgcctcgagaacttcgccgctgccctactcgagtcttcctctccacctcccgccgccttcaggctgccgcacccacggtcaccccgcctgaatcccgcccggtgtttgagtgccttcgcctatgctgcgagatcttctattcgctcaactccatcgacctgcccgagttcttcgaggaccacatgcgtgagtggatgacggagttccgtgcgttcctcaccacctcctacccgccagcgatagaggcagacggcgccccggatgcgctccgcgccgccgtgtgtgacaacttgcagctgtacatggagaagtatgaagaggagttcaggggatatctgaaggagttcgttgaggcggtctggggcctcctcatggcaccatctgtctcaccatcccgcgggcagcttgcggtgaccgcaataagatttttgacaacggttgctgagagcgtgcaccacgcgctgtttgggagccctgatgcaatgaagcagatatgcgatagtgttgtaattcctaacctgcggttacgggatgatgatgaggagctgtttgaggggaactgggtggaatatgttaggcgtgatgccgaggggagtgatgcggatacactgaggcgggctgcatgccggttgctgcgggggcttgcggcaaactaccgggagcaggtggctgcacttgtgtcagcacaggtccagcagatgttggctgcatatgcagctgatcggacgaacaactggaaagagaaggatgctgcaatataccttgttatttctcttatgcagaagcctggtgccacaggaggtgggacaccggtggttgatatggagagcttctttacatctgtgatcgtgcctgagctgcaggcccctgattgggaatctgaaccaatgctgaaggcaactgtgctgaggttcttgaaggaattcaaggatcaaatccccaaagccactgcactggcactgcttccaagtgtaataaggttcctgatacacgagtcaaatgttgtccattcatatgctgcgacctttattgagaaccttctgatcatcaaggatatggtaccagtaccaagtgcaaatgtgattaccagggctccacgctatgttgctgctgatatcaacccatatgcccagccgattgttcagaacctgtccaaggcactaagttttcctgaatcatatgagaacccctatctgatgaagtgcctgatgagagtgcttgggattgctaatattgctgggcaaattgttcatgagattactgctcgccttgtgggtattcttatggaagtgtgcaataaccccaagaaccctgattttaaccattacttgtttgaagccctggcagcagtgattggtcgggctggtgagcaggacccagcactacttcctgtgtttgaggcaagcctcttcccggtgcttcagaggatattggttgaggacatctcagagttctggccatatgctttccagatatttgcacaacttgtcaatttgagccgaccacctctctcgcagaactacatgcagctgtttggtgtcctgctcagtaatgctacctgggaccgtccaccgtgtgtccctgccttggttcggttgctgagagcattccttcggaaaattccaaatgagcttaaccaagagggcaggctaccgaatatcttagtgatattccgcagtctcctttcgcggagcagtactgaagattctgccttctacatgcttaacacacttgtggaaaatgtgagttttgacatcatgaatcctcacataaatgagatatggagtgctttgtttactcgactacagacaaggcaggcagtgaagtttgtgaattctcttgtggtcttcatgtccttggtggtggttaaatatggaccaggtgttcttgtcagttctgtcgatgcaattcagccaaatattttcatgacaatccttcagcgcttttggattcccaatcttaaattcatcaaagggactgttgaagttaagctgacatcagttgcatcaacgaagttgatctgtgaatctgcactgctgttggatggtgcagcagcccaaacttggggcaaattgcttgacagtattgttgcattgctgtccagaacggatcaagatggggcacaacaagatcagaatgatggtgctgatgcagatagtcagaggacatcaggttattctgtctcatttgtacgtcttcaatatgctggaaagagtgaagatgatctgttgaaagaggtaaatgatccaaagcagtttctggtcacctccttggctactctttctgcgcaatctccagggagatttggtcctatcattgagcagaacgtggatcctgcaaacaaaggcgctcttattcaactttgtgcagcttacaataccaacattgtctaggtaaacaacctctcagttccttcccatttattgcatcgagtcaatccaatgcattttcatttgttgtcttgaaaacatggaagtttttcatctataaattctaatattagctgtaagtgaactttccattggacacatgcaacaaaatctcagtttgatgatcctataaactgcaatgttgtcctttgtacaacttttttttcttagtttggtgcttcaactgtataatagagatgcctcttgttctgtgtagaaaaggatattattatgcacattgtggctaggcccattaatagcttctgtcttacctattcattcaatagattatgttatcttagtatcccatgatttatgttgcaccaaagtgtttttttttttgagtcacaaagtagaattggtcacatattggattaaatacccagatagtatcagaattcacaataactgacaactatgtaggtgggagttcctgtgagttaaactatgagtttgttatccctggcataccccttccacacaggacacctgggcccacacttaacaattctttttggttagggtgtaaagaactctttatcaagttttctgtatcatcttggagcataactaaagccataaacgttctattattacttcacattttaaactgcactgacattaggccttgcatccaaatttttatgtttagtttagttgcctcaataatcaaaattttgtatgaaaattgagtgctatgtgttcagacatgggttgggaaatatagtactaaattgccattaggatttaattaaatggcagtctgaaacataatgtgaaatattatttagttattatgcttcatgtcacttgcaggcagaagtacatccataatttgttgataggaactttttttcctgagaaatatggtgatgcaaaaataaaacaacccctccaagcctgacatatgtcttagtgatgaacattggaacttattctagtatgttctagtttttgtccattattattgtggtgtcaatcatgagccttaggaaacaccgtccaaatgtgaatcagaatccaaatattgcaaattcaagatcatgttctaaactctcctagcgagaatcttactcatgattgttctgcaagtacatattccatgacttgggatggatgtaacttactgaaaagcatatggacacagttcaatgcaagcaattatctaggatgtaagcgagttgcaataaccaaagtatagaggctactatttaataaaattgagaacatattttccattcgtgattcctttatatgcagattgcagggaaatgcttgtttggtgggtcttgtattagctagaatcatgataagcagttatcttgatcctgaatgctttgctttgttgtagtgcagacatgccaattacttatttgttccttgaatatctccttttggtagtaccttgtctagaatatttgcaaaactgctatattatttgtttatttcagtttctctaaacctcctctgaatgtttcaggagccaatggctttgctgtaaggcatttgcattgtttccatggggttttgtcaaaggatgtctcaggggagtctatcggtcggtcggtctatcgggtcaagctggtcttcggtttcatccttgcaatatttctggcatgtgtaggttggtcttgggagaggaaggatgtcgaaatcatatagtggtggaaaaacatgaacattgtggtggaggatgtctctttgattggaatttggaattttcttttttggtgtggaagaggtttgtttcccccggaaaacatgaacattgtggaggataccccgagaatattgccagcgtaggcatgtgccatcctggtggaactttgctgtaatttttttgcccttgttggctgaatgccttgctctggcgtaggaaatggtatatggcgtgggagtatattgtcatcggtcatcaccctttgttaggtcgggttacaaaaaatattgcgaacctcgattggagctcgcgatcctgctgccatttgctctgttttttgaatgcattgagccgttgcaagctactactatagcatctgcccatttctaccgtttcgtaatttcgtttgctttgcactaagattatagcttcatcaagctgttttggatgggttactgtcaccccaacattatcgtgggaactgcacggttactatgcaaactgtgatctactctcttcgtcttttaccgcacggtgttgcaaatccttatatattttctctatcttaaaataaataaatataatacagagcgtgatatatgctaataatataaatctaaataaatctagatttgtaatattacggtggatcgttgtaatattacggtggatcgtattttcttatagatttatttattttgaacgaaggttacacagtgttgaatggaatcgtgaggttcgtcatttttacgtttctgttacgtattccctctgtcaaaaaaaaaaaactcaacctcttcttctagaacaatgaatatggataaaggcatcctcacgtttccgttacgtactcctttaaaaaaaacttagagaacaaaacgtttccgttacggactccctttctaaaaaaaaactcagagaacaattaatatggacaaagatatcccgttgagttttttttactaagcaccaaaatcgtagacggaacctttttcatcttttgtcgtggcgatgccacctgtgctgcttgcgtggccgaccggcctctgcccaacccacgccggccacatcaccacctcgtggctcgtggcgctgctccgcctccgcctccgccacacggccccgctcccgacgaatcagcgagaaacggtaaccaaaaccttcgcctccagcctcgcctcgctctcgcacaaatcaatcccgcaaaatccctcgaccctcgatccccccccttctccctctctctctctctctctctcccggtgatcgcgacgccaacccgcgctcgcgccgggtaaggatcctcctcgattccccgctcctcccatctcccgccctacctagctcacgatcggtcgccgccaccgccgccgagtggtcggtctgtgtggctcgcccgagctgcgcgttgtgatgatggcgatgcgcgtggttcgagttctcgatgcactgggggctaacgacgaatttgctcctccgagtttcccttttttttttctttcatttcctacttcccttttgagttctttccatctattccatttcatacgtgtctctcattttttatcatgttttctcccttgtttcttcgcttacacgatgtgcaaacaggcaacattgaagaccaaaaagaaagcaagaatcatatggataccgagagcatccaggatggtgatgacatcctgctgtcaggtggagacgacgacaggaatggagggagtatcgcggagattcagacaacggtggacctcggggtcgcatttggctcggagaagctgctgaatttggagatgctgctgatggagatcgcccatcgcgcaactgagatcgagcccctcgtgctggatgcagagtcgatatcggccgagtcggttcagagggtttctgaattcgacctcttgcattgtatcctagattcagaggtcaaggagttggagaaattagttgattccattgaagtggatatcgggaatggtggaaagatgatggcttctgatgaagatccggtgagtgaggtgaacagcaagctccgagatgcagccgtgtctttgaaccagatgcaggaccttatttctgctattagaagacaatcggcaaactttgtgaatgtctagacccttctcaggacaactctggtatgctcatgttagtctggtgctactagtgctagctgtttgctgtatgttttttttttcctgacaattgcatttgtacaggaactagtgaagatggtggatacgaaaatggtcatggttcatctcgctcagccatgcctgccgaggaacaaagaaatactctgcagctgttaaatcagtcaatagcaagtgaactggatctcggaaagaagttacatgattcggagtccgttgtggaagagctcaagcttaagctgcatcatgtagaacatgaatcgtatttcttggaggaatctgttgaagcgatctctgaaagaatgtttgcagctgaaaatgcatctgaattgtttcttggagcgtcaaaggaacttatcggtaaagttaatacaatacagttccacctaagtgcatcaattcgtcgggaaggtgaccttaaatcaaagttagagcaaagcttgacagaatcgaatggttctaatagcactctagagaagatgaaacaagacagtgaaaaggaagtgatgccgactcaagcccaaccggactctgagttcttgactttgcaggataaaattcagcaactagaggaatggctgagggaatctaagtctggattgccattgacaattgcatcaacaggagaaaatgaagtcggcgaagatgagatgagcacattcgaaaatattgttaatgatattaaagatgctgttttcagagcagaaagtagaacacagaatgctgaagcaaagtgcaaacaactttctcacgctaatatacaactcgatgaggagctaaaatccctcaaaagtcaggggtcagatagggctggcttactggaggagaagcttaaggagtcagaaactcagttactgcatgcaaaagcatcgattgaggctattgtcgaacggcacagtatatttaagtcttcaatgtctgatatggagcaggtgattgatgatctaaaggaaaaatatttgaaagctgaaaccagagctgagaatgctgaatcaaaatgtacattgctgacagacactaacttagagcttagtgaagagttgtcatttctgagaggtcgagtagacactttagagaattcactgtgcaaagccaaccaactgaagatgtccgcagcaaaagatattggcattaaaactaaaactatcactgacttagttgcaaaacttgcattggaaagagagtgccttcatttacaggtataaattttattattcaagaaaaaaatactgtggtcagtattttaactttgtcctgtgtatttatgttctttgtatgttatgtaactgtacttcgtatgatttttaccaaaagtactttgtatgatttttaccaaaaaaaattgatgcttatgattcacattgttcaaataatatctttggggttctggacttccggttcaaacagaagcgccaaaagataaaaagaatgaaggctattcttggagccaggcaatcagttaatcatagatagacatacgcaggatttttttcacggtcatctagtcaatataccaagctcatattttgagattctgaatgctttgagtagaaacactgaacagactgaaaaaatagttcatatttgtatttcattttcataacatctgcattatgtttctttactccttttagttctgaatgttctgctctttctttggcatgttttagcctttttaaggcatcagacttttcaacagactggcgctaaccaaaattagatattttattaataaattcctttggatatcaatcctatgactgcatcctccttttctcagttaacagtgttgcagaaattactagtataaataagaatatatgtactcctggcttcttaaccagcttcccggtatcttctctgtacagattgttacactgacgaagaagaacaggatgttggctcaaaagtgcaaagaaaatattactgaagttacactactaaacaacaaaattgctgccagtgaaggtgaactcaagactactaaagtaatggaggaaatggtctcagattcttcacctacacaaaccaaggtaagttcttgcggtgtcttgttttaaaacatgtagaagcagcaaattcttcgggtctgatcctctttgttgttctcacattgaccacaattgttgcatcattgaagacaatcatcagtgtagaaaacaactctttacattgaaattgcccacccaccatgctctctcttccatgagtaatcacctgatagcgcaaagctctactagcagaactcagattttataagcattcacagctggggttcttgtctcaggaccaaaacttgcaacggttaagggttaacatatttatttcttttaagcaaactttgttcttttggaacttatgtcaagcacaattactatgttcttattggtaattcaccctacgatgtttattaatgtggtaaaaggtgaagagagttgctgacactcttggagaggaggaagatgagattactgctccaccagaggataattccggtgcctgcagcacacctaacacggtgaggtccattgaaccaaaaatcctgaactggaagtggatttttgcggcattcctagtcttgctggttgctgttctcgtctgcctaccgtaccaatgaggtgaccatgtcctatgatctattaacgcagcttgtaggaccagatagaaagcaggtaattttcctgtaatgattcttctaaatcattgtaggaatagtcaattttggtagtggtcgttgttgcaagtgtcagttcttgcatgaactgtctatgtgtcaaataatctctggggtagaagagattgtagatctgaactgagcaagtatgctccatgccttctctgaactagcagatccaagcaaatcaaattggcaacagagaattcatgcagtatctacttgtatatatatttcgagtacttgactaatatcgagtagcatttgttctagacaaagtgatcttcactattttacagaatcacagatacaattagcctgacagatgatggtttagtaggttcagctcatctgtacaaaatccatttgtgtatttgtgagcagttatgttatacaagtacaattttgtttacttactctttagttaaactgtaagctttcttcgttcgtaagttgggaatcagggctgtgacaactgataattgcagtggaaacatcacattagccacacaatgacatgcaagatcagtctgaatcgagcactcgagcttgcaagatgtgagtacatagtggatcattacaattgacatctgctgtgtcatttcatcactgatggattgacacaccacaaacaccccccagctttatcatcagaattcatcaccatgaacacatatatacaaagatgtacatggcttatgtggtactaacacacaataagccttttttttttttggggtgatggtgcacagtaaaaccttcgttttagtatgcctcaacaccagtagacttgcaatcaacatcgaaccatacctcgttgagacggccaatgatgcgaaaggggttgttatactgcgcaattgagtaggcgctcttgctagggtagtttgtggaattagcccatggtgaccggctcaaactcaacgcaagtttctccgcttcctcgacgacattgttgtcccgtgcataacccgagaagctcctcactgcaatgcagtggcttggccacctatccgggtggaggttcagttcggggagaggcacaggaggggaagcctggaacttcgctggtaagtagagccgcacaaagtaggcagacgagtgtagcggccctgcacctgggacgatgctagttaggatgggagttgtcatcctgatcctggaggagttaaggttcgcgcccatcaggtactggaacaatctggcaggaataacatcaagagttagtgcttgtaggatctggtaaaataaattctaccgacagggaaactgaatttcagaaaggtgtaaatgagagtgaattatgaatgaagatcaatgtagtagtgaatctgatgaactcacaggctaccatgttgttaattgttgtcttaggaatcaaaataatcacaaaagtgctaatatattcaattagctctccagcaaatcaacagataatgccttttatctctgtattacatgaagagctctttactgatgcaactaaaagatttggcagtgcagcccctaacttatggctaacaagtaacaaaacaatcctgcatattttctgttatagaaatctctcacaaagacccaattctttctagaaaaaatcagtactactccatccgtattttaatatatgacgccgttgactttttgacaaacgtttaacctttcgtcttatttaaaaaatttatataattataatttattttattgtgacttgatttatcatcaaatattctttaagcatgatataagtgtttttatatttgcataaaaattttgaataagacgtttggttaaacgttggttaaaaaatcaacggcatcatacattaaaatacggatggagtattatttaacatcacaatactgtctcaattcaagaccacattcttcccgattctcaactgaaatgaacaagcatcttgctaaagtcaaccgacaatagccatcgatttcactcatcaatctcttctacaattcaccgatcttttccattcctgcagagcaaccaacacccaaaacgagcaaatcgaagagctgtgctcaccaaaaaaaatcatcatctcctacctactccaccacccaccgcacatgattacagacaggctccaaatcaagcgcggctgatcccccatcccccggaccaaatcgtagcgacgagggtctcggatctgatcggggtggggcgggctttgcttaccggtggaagccgagcttggtggcgacgtggaaggagatgtcgtcggagggggcggacatccagacggtgtcgcggtagcggcgcacctcgaagtcggactcggcgtgcaccgtcgtgtactgcggcgtctcctccgtgccgcgcgcggccggcgggagcagcgcgagggggaggaggagggcgaggacgaggtgcgcgagccccgccatggtcgccgccgcctcagtcttcgctccgagcggctgcttgcttgcttggggaggcgatcggcggtggatcggagtaaaatatacgtacaacagtcggtatatgattggagaattgtgtttcgacaagtttcagttctggacatcactgttttgttttttagaaagagagtaaattatttttgttaataatgaaaaagagtaaattctagtagtacgagtttaaccaaactatcactgaccttgtttagagaattagccaagatttattttgagagctattttttaacacaaggaaatagccatccaataaaatagccctaagttgtttgaattcaaaggttattttgagagttatttggcttttaatgtacatttccatagagggagatagaggaaaaaagacactttttcagtggccccacttgaaatagctccaattaacacttcttgggtgggatagttttttgggtgggttatttccaaataaccctaaaatagcttaacttttagatctttttgagctatttgaggaaaggctaaaaaatatctcttggatctaaacagggccacagtagatttaaaagtgttgtataaaaaaatatagatttaccaataaagtaagataaaatattacaaaactacatatttagtattgaagttatcacaatcctagtttaaatctctatcattacgttatgttagagctataaacatttgtagttttctaattaaattgataccaaacctgtagttttgtgacactcaatctttatttttgacactccatcttaaatatgtattttttgagaaattttgtgttaaatctatatagttttgtgatagaacatcgtaaatatgtagttttgtgataattttatcaaagtatttgcagttttaagatgtgctctttctctatttttttttgacaagtcacatgtctgtgcaagatactttgtttaatttgatatatgaaacaagtttatttttttttacctttttttggttgatttaagctgatttttattttgaagttttttttacatggaatagcagaggttaaggaaggagtagatgtaattagagaaagtgataataaagatgtgtcgttgatgttaataaagagtactaaaaagtagaacatgcatggtgggaaatttaagctcaattggtcctaaggtttgttctccgttcggtatggtggcttgggggttccaaacttagaaaaatttaccatagcttttcagctaaggtggctatggtttgaatggagcacgtcagaaaagccttggattggaactaaaactccttgcgatgaattggataaggatacgtttgatgcatcgatgaaagtccaaattggtgatgggcaaaaggcgagcttctaagaatctaattgatttggtacctaaagtgtaaaatgtcaagtgccgaacctctataggcattcgaagaggaaaaacagcaccatccaggaagctctgcaacaaagaagatggatcaatgacatccgccacaacctcactatccccctccttgatgaattcttatgggaagttctagcccgtgacaccccacaactaacagaggaggtacaagatttgattgtcttgcgatggacaaccgatggggaatatagtgcaaaatctgcatatcaattccaattcaacggaatggtactatcgccatcaacaaagttgtcctgggaggaatgggcttcagcaaattgcaagattttcagctggctagtgcttcaaaaccgggtgtggacagctaaccagttgcagatcaggagatgaccaaataattatttctgtcagttatgcttccggaatcttgaaactgtcaaccattgttcgaatgcccgatctcgaagcaaatctggtttgacgttctcacacagctacgtcaagggcacaacatcctgaaatgtaataacaatagaaacctattgggttggtagacacaagaaacaagcgacccataagtaacaaaactaaaaggactcgtatctctcttattgctcattacttgggaaatctggaaggaacggaacacaagaatcttcagagaaaaggaggcgacagtacactagatgatcgcatccaagaggagttgggttggtgaggtatggccggcgctaaacatattgggagaatgttgccatgagaagttaggagagctgcttgtttgcatgtaggcatgtacggttttttctcttcttccttgcttagccttttggctgtttgtactttaaccctctcctatcaatataaagcaagtcaaatctaaccgggtgtaaaaaaaaagtaagaggaccaccttcttcagtgcgtgattcctctggattaggttaaacgagtgaatcatcaatagcgagcatgagaagaactgggggcaaagcaattgaaaaggacaaagaaccacgacagcccagattttggatggggattgccattctgatcctggaggagtttagagattatcgcctgacatctcaggcactggaacgaattactgtcaggaggaacagcatcaagggttcgtgcttgtaggatctagtcaagcaaattccatagacttctttttttttaagaactaaattccgtagacatggaactgaattttagtggattggtttaacaaactggatagcaaccaattaactggatatatatagcaatcaaatgtgcacaaatgacgtatgccgtcaataattcttgcaggttgtaaatatcaatatgactaataacatggtagggtgttttgtgaggtctagtacgaaactggctacgaaacaatccaatggatcaattagctctccagcaaatcaacatatagtaccttttatctctgagttacattacatggaagattcttcagttcttcactgatgcagccaaagaattcgtagtactgtatcggtcccctaatttatgagtaaaaaacatgatcctatatgattttgtcttctacaggaatctctcacaaagatcaaattcttcctagataacagaattgaacatcataatgcaacatgcaatatgatgatcgagtcccctatggatgatcaagcattcaagctagtttgagaattgctatctagagatcagatcattgtattttaattttagtggatatagtgataatgggaattttcttggtctaaagcctgttccacaacttctaaaaccagataaaactcgtctgtgtacatgttaattgtagttttaactcaacatagagaggagtgtgtatattatatgtcataagaagatagcaagagagaataagtgaaaaaaaacttgtatgcccgttcgactaatgtgagttgaagaaatgataaatcttaaatgacccgccataatcttctctgacaagtgagcactactttaatggcaataaaattgagcatagtgttttcaacgtaaaaagcacatgttcctcctttaactaggataactttcgaagctcgaaacctacatatcatatatatttaataatatttaataagtactccctccgtccaaaaaaacaacctcatactatgatgtgactcatcctagtacaacgaatttaaacatactatatgacatagattcattcacattaatattatagtataaggttagcttttttttttaggtagggagtatatggtaccaaaacaactcacgatgtaaatgctcttaaaaatgaggttaattagatcatgccactgcaaaggctgaaaccgggtgtgtgcctgtgacgaacctacggatctccgctagtttgagagctagaattggggatttaggagaggatttgcaggtttggagcagagtttggggaagaacagaacgaggtaggagaggtagttgagtttgatttgttctttacttcatcgataatctgtctcttacaaagctcggccttatataccccaactcccacgccaccaagccaaagactaaacctcacacctgcgccaacctcacactcagaatacaacggcccaccaggcccatctccctctcactctctctcacacaagtctgtaacagtgccactaagaattctctaaactagaaccatgctaacatatactacaccccaaccattccttgaatcaacttttcagataggtcatattgcccctgctgatgctcacatcatccctgttcctcgttggcgccagcagactgcctagtaggccatggagacaacctgcttgtcgatcgcacaccgtgaagctccctcgatgtggacctcgacgtgcaccaccacggtggtggaaaacctcgacgaccctacggcggtggtcgtcgttgcctttctcagcaacctagccaaactccgcctccgcatcagtagcatcgatcccctgcttccagggttgcataggatggagccaagcgctaattgatcgatacacccttcaccggtcagccgacgatatgtgcataaggtatcacatgcatgaacgttgtgcctgcaggacttgtgtgtctcgtagtcctagacccccgaatattgtcgctaccctagaggtcgaggccaggaaggttagatccatcagcgggaggcacttcaggatgatcatctcctacgacgacaataaaagggaccctgcgaccatcgtcttcttccggcgatgtgagcggcaggaccgaaagaggacatagcatctagagccctcatgtgtgatgatggcttctccatcttcctcctccctctcctaccaaccacctataatccatcttgaattatgacgactctctccaaggatagagggcacatgtatcaaatcaaatcaatacaatcggggcaatatggtccatacgaaaatactaagtaaaaaaactaactcaagggtggctgaggcatatataatgatatattctaatttagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctga

SEQ ID NO: 43027 - DNA, 12012 bp, Oryza sativa
  unsure (1)..(12012): unsure at all n locations
tgagcatcgcacttcctctctgtgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcagatttggtcgcctagcttccttacctatggcggttcaacctgcagagcgcggcgtggaggctccacctctgacgctgtcgatattcgagttcaacagtaaggttgtgtgtgtgtgcgcctccggtgacggtgatgccgcccgccgcctgttgatccggttcaatgctttttgttgatgcgagcgagtatgggaattcttcgtgtctgatattgggtgtgcgcgcgcgccttgctctgcaggtgatgcaggacgagctgcagaagctggcgctcaaggtgaaccaccacgaggagaacatcaggtttctcaagtcggagctcaatgccgtcgaggactcgtgcgctgacctgggcagtgagatcctaatgccctgtgacaccttgcttttgtatatacttttaatttacggattcgtggttatattcgtgtactctagtaatgctatatatcggtaccatgatgcagaataactgcgtagatcattaattaaacactatagtgaataattcgagccttgcgatacctagtttctggtaaataaggcctgttaattattaactatggagcttgtggtcattaatttttagtatgtcagatatattttctgtaaacttgagttttatatgtatgttcaagttggccagatgtggagtcatggatctgtgaagaggatgaatgacccatatgttggcatgaaaatatttatgagaggagggatggggtgtgaaaccaaccatcaccaacttaaatatttaaaacagtgaaaatacctaaatgtagttagtgatgtcatcggaagaggaactcgcagtatttgggatgaatgagcatccttgtgagtggattgcattgtcctgtactttggtacacaatggaggatagctactgttagatgtgaccagtaggcatgggttaatgtagaaagagctaagatagcaaaggtactcagtggaggtagagagagatagagactcaacagtcaacatgaacaggtctgttgagccgttgtttgcccaatagtagctaatgtcttggtttactttatactagctctactcctttttacttgatgttttgggcatcaatacagtatccaatgcatatgtttgataattaacatttctaataatatatttataaaaaatattaagaatataattgcatgaaagtgtttttcatggtgaatctgtaatatcaattttttttgcatattagtatatcttaatatttttgtatatattgatgatttaaattttgaggttgactatacacattctgagacggcatctatttaagaacagggggagtatatgataagctgtaacatgtgtaggaactgatacaccctaatgcaataattctaatgctgacaagcaaatctgacataccttggtagaggtagaccaaaaaaacttgcgttctaattcatgtcttacttactacccatgcttatcctaaggtccatatggcaagccaactgtggcatttgctgcttctgcgtgtgtgcctttaggtgctagtgtgctactacttcgcatgacatatgcatctatctaaatcaattgaggcctctttgagtagaacattggaagttggttgttgagacaacatctctgcattagtggtaggactagcaagctattgcaaaatctttttattatcacgttggaaattgaatctttttgcatgagcctaacatatccaccattcctattatctaatgttcttagcaccattggattattgcattagatggctgtggtaaatttgaatttatcatgcaagtaacaccatttggataaagatatcaaagctatctataattccatatactctttctttaactcatttccataattccatatactttttctttatcttattgcccctatttatatgctgaaccctggaacttttctcagttaaaataggcaattattattcatcgatggcggcaattgcaaataatgacacatctgttgaagaagctgaacaacgcactattcaaagtatactcaaacaggacgagacagcagctgggattatatgccaactgaagattcgtcattatcagcatgcatcaaagctgccactgatgaaagatgtccttggtgtcgtagctaccttgggaaaaataaataatgacaacctcagcaggtcattattctctctttgttttgacatataataagatttattgcaccaactggtgcaaagttaatgggcagaattatttgtttacttttgaggtaccatgaatttgttatagggtactctcagagtacttgggattggacaatatgcttggtgtcgtctgcaagacttatgatggtgtcgagggtcttgaaacatatgacaaggaaggtatggttgataaaaccagtggcattcatggactaggtcgcacaattggaaaatttttagatggaagattcactgtcttttgtcttgaaaatataaggtgtgttttcattgtgccgttatattttggactctactggatggacaccttaacattataactattacactttgcaggccattttctggtgattttatgatcgatgatcctcagaggaaacttcttttgcataaaccaaggttgcctagtggagagttcccacctggttttcttggttttgcagtaaatatgatacatttggaccaggcaaatttgagttgtctcacagctgggggccacggtcttagggaaactttattttacagcctgttttctcagttgcaagtctataagactagagctgaattgcgaaatgctattcctttgataaatgatggtgctgtttctcttgatgggtctatactaagacctaatggctcattctgcctaggtaataggtatgcaattatatggatttatcctttaacatcacatcatatacttttatttgatcattagtgttctgcatattgtgggtccttcggtgatatttaattgtcctttcattttatgagtatatgcgtgatacattaccctggtttgcttactacataaagtctggtaacanaatttgcactgttctgtaacaaggcatattaagcttaattccacctcttctttttgttaatgattatacatgaccttacttttgaagggcaagcttacgaatacaatttcctgtaactgcaaatcttggggtctcaaacttacccgtaactatcactgaactggaggagcaagttaaacataagaattgggaaaaggaaaggcttctcgaggatataaaaagacaagaagatttgttgaaccaagttaaggatttgttcacaagaaaaaggaacagttcatggcttatatcactcaaccaggaatgttacaggtgaacttacaatttattctgttattttcttgactgtactaatttattagtaatttattgtcatccggagttacagttagataatgaatagaattctctatttctatgaagtgccactgtagcaagtacacatataggtcgcttgcttctaacaacggaggggaggccggactgctggaggggtctgctagagaatctaatacacttagcttttttaatattttttttccaaaactagatgtttgtaggatgcatgtagctgccttgtcactttgagagcaaatgggaggtcagacgtgtcttctatctgatacgctaagcttggtttttgtttttcctgaaactagatgtaggatgcaggtagctgccttgtgagagcaaaggggaggccagaggggtcttctagatagtatatgttccattttgaagaaaagaacttgtttgatgatataagaagtataactttgttgctgcagtcaattgatgatcgtttgtttgatcaaattgtggctgattgaatggaagtagcatgtgcattagtgcatagcaggatccacatccattctatggcttatgttagcaatgttaacttacatatgaactagcatctaatattgtaacatactagtacaagctatacttctgttaagacacctgaagagcaatactgtaaattattgtccatatattcttcttggatagggtaaaatctcagtcagctaactatttaacttgcccggtggaaactggcgaattctaggatgaggtccaggttcaaattgtttctttgaggataaattgcatttaatttatacttcatttgtgcccatcatttatgatatgtattttcttcaaatttctattttcccccaaaatatattgaattcagaagaatggaaaatggtgatacgacaatggatctgatgtcttcactttttcagagagcatcgcaggcttcaccgacaattccttcaccagctactcctggaagcaatccatttggatcaaggcctccccacctgcggtaatagcataagactctaggcatttccttcagattggagtttgccagtgatagatgatggcttgatggcttcatgccgtcagaatgcattgtgcaacaatcttgatggcattcgaggaaaaaaaacaatcttgatgttactggcataccatatgttgctaagttagtctgtcattttgctagttgcaagttgcaacagattatactctcttagtttttttttaaccctttcatcagctcttttgcatcttgtcaaaagaataccctttaattagctcttctgcatctttgttagaggaagataatagagcaggtagcgaagaattgaaggaacatgcaaacgggatgtaccttctccattaatttgttgaaatgcgtgtggtttcagaactttcctgctggatgatgcaaggaatttttgttttgaacatggtgtagaaagcagctttatcatcaatgaagaaacccaactttgatgagaatttaccagtttcaatttctcttgctgatctttaagtgatgatgatccaaagctgtagtagagatagatgtataactagggtgtcaccacctttatctggcatcaacacaattgcatgcgtggtgttgccgtttgattcaattttcaaatgactaatcataataacgttagcctatactttatgtccagcatttttaaagtttggttgtatacttgtatacattctgaaaatgatcttccgtctcaaaataagtttatttttcatctatcctacacatataccaatacaaaattaaaaaaataccctcaatcaaatatcaatgtaattatttctcaatttatctattcctaatgcatttatcctctacttgcttaaaaataaacttattttggaataaatagatgaagccaaaaatgattttattttaggacggagggagtaccagtctaatgttttttgccgttgttcataatacattcagcaacagcattaccaataatgtcgcagtgtcaaggctcaatagtaatcaagccagtaaatcaacaatctgatattgctactcttatcataggatagtagtactttcaaagtttcgatacaatttcgctattacacctggtagcaatatgcaacccatgaatgccatgaggcactgggatattacgtcagctacagagttttgcaggctggggttgaagttttgaacatccttgtccagcctagagaatgttaaaaatctgaaataattctggaagccatccttggtgatgcacactgcctcctacttgatcacctcatagacaaatttgcttacatttccaggcttgaaatttcttggactggatcacctctcagctctcgctgcaagttggaaaatccaagtgagatcaactgatatgctacaatgtacgagcaagatttatacatgtcatttcttatacaaaaggagttttttttcctcaggaattctctgttttctgtaaaattcctactaaaatcataaaaggagtgtgtttttttttcttggaacaattcttagtttcctatgaaattcctataaacaccataaactcataatcatgtgataacggaatgaattgtgctgtgccataagctcataatcaaaatactccctccatcccaaaatgtacgacgataactaacattataaaaaaacaaaaaatccctccatcccaaaatgtacgacgacaaccagcatcataaaaaagaaatccctccattctaaaatgtacgatgataaccaacatcataaaaaaagaaacggagggagtagtaataccttttgtattttttttgttgttggaggggaccttcttccctctgccggaagccacatcgtccatgctctgcccctgcctccggtaccggccgccggaggcgacgaagcccggggcacggccggtacgccttgataggccaccacccgaagccggggacggtggctatgccgccctggatccgcccctcgccgttgcaacccctctccacctcctcccgcccgcaccctctgcatccctgcatatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatatatatatatatatagagagacacacacagccactctagccaatatatatgaataagatgaaaaaaaatagggggattaagagtccaatgtcctaaccgctagaccatggaaccattcgttggtacggagaacaaaacaaatctaatatccattatatcaaattcaggaacccatttccacataaattccaaggatttattctgacattaaaatggaagccaagaaccactgattgatgctaataacatgccaattatagattctgaaacatgaagctccatctcagaaaacaaacgtatacacacaagtatgaagcatatatatttacctgaagttggggtcatccctgtagctgacaaattcagtctcagaaactgctactccttcctcttgagaggaggaagcagcagcaactgcctcttgctccttggtcaccacagaagcagaagagttggatgagctgctgctgctgcacagaatgctccctctggccgcctgtggatgcttcttgcagagcagtgaagagctgaggttgcctgtgaggaagacggggttgtggacggcggcagaagcaggtggagcagggagctgcagccacagggaggccgccattgttgcgcctcctgccctctcctctgcttcctcctcccggtgaggtgagagagagagagaaatggaggtggaaatttgggggtgggggggggggggagattggaggacgaactgggtgccacgtgggctacttacctttgtggtgggataatgcgtggtggatgttgctcgttggattttatttttcttccggaaataaacatattgttttacgtgttcttccatgaagaattttttttagggaacttccatgaagaattgaacagccactcgtgtaaatgactaaatgagcccccaaaaaaaaaggcagaagaatttttttttctagggatcttccatgaagaattgaacagccactcgtgtgtaaatgagccaaaaaataaggggcggcttcaaaagagcaattctcccaaaaaataaaggcaggaaaaaattgatgcaaaaaaaggttccaccgagatttgaactcgggttactggattcagagtccaatgtcctaaccgctagaccatggaaccgcttatatccaacatcctaacatatttaaattaataaacaaaagaacttgtccctgccgattgctaggtccaggaaacactgcattatgatcaatataatggtcctatagtgttcctgttcagttgattcttgtcttgtgctgaaactctgcatatactatcaccaacctaacgaaccaccaatacttactaaatttgttctcatttcatttggttctcgtggaatcttcatagaatttaaaagtcatcaagataaaaaaaacgctgtctcttctctcctctgaattccatcagttgcacgaacagaaactgtcagtcacactcgcatggcagctgacatttgatttcccaggctcgccgccggccggcggcgccggcacgctcgcctcgtccagccacgcaccgccgccgtggctgtcgtcgccaccgccggctggtgttctgctgcgcgccggcggccggtggacggcgctaggcacggggaacggccgcggtggcggtgtgccgccgttcgattgtctttgagcggtccagattgagtgatcggtgtttggtcagcgattttgtttgggccttcctgggtgttttctgggcttcaggcccaataccacacgtatcatttccaggcccacctctttaggagaggatataagaaaattgagatatttaaatcgaggttagatgttagcacatgattaatggatgagtattgattattttatatctagaaaattgattaatataaatttttaaagtaattttctatataacttttgatagaaaacgtacgtttaacggttcaagaagcgtatgtgcgtggaaacaaatcttccatctttctagttatctcgaacgctgtcttagtttaaattttagattagactgcagctgccggagttcatggcatggatgaagcacatcgtcgccggtcgccctcacccgccgctgcggccacaacgtccatcgctaggcaagtagaaccctaacatttttaatggagcgcactgtgcacataaatttggatatagagattgtacttgtactcttgtaggtgtaattggtatgtgacttctcacagttggtggataagaggtacctgtccttatatgcaaattgcactatatatagtctataaatagatcatataatgttatagataggacaggcctggttcattatcaaaacaattaaacctgaccaaatattaggaatatagtggattttggtatacttttacactagtgactttcgggagagatttgggattacaccatcatataaaatagaacccgtctaaatgttatccccataaatagacttcactaaaatggcattctcaaatagaagctacacgctaaaccttttgcaatttaaaatgatagaaatgtcatttgtccctctacttatcttccacctccaggctcggtgcaacaattggggtgggaggcggagtcatggagctgatagggtcaacgagatgatggtagatcccttaagtcaatatcatgtgtgttcttcagtgataaggcatgcactatcactaccacctaccacattggagctccacaaaggacagttggtacatgagcatgatgagaaaggacagccaacactggagttccgtgagaccaggaacttgaggaggttgtggctacataggagcttgacgaggacaatgatgcatgggcttgaagagatcacaacgcgagagctggatgaggacgacaacgtggaagctaaaggaggttggcgggacttgtgattgagcattgggccttgagctggtggcagtgcgagaaagtgcctaggacggtagtgaaacatcaaggactaaaggacggatccagacaacaagcatggtagaggagggtcttcacatggaggacataaggaggaaccatggcagtgaggggatgaggtggccacaacagcctacaccccccgaggagaagacatggatgatgaggttcagccagaactagaaaagaagtgaaggtccaagggcatttctagtgtgcagctctttttgcaaatggtataagagtaaagcccatttacataatgatatttaggttaaacctatttttacgatgacataatttcaagtttttcgaattttggtagtatggggctctgtttggtttaaaagttcacaaaattttagtatacttttaagaaagaaagcttccaaaactatcatattttagcacgaaaataatggtcggattttgtttattttgtgcccttaaaaaattggtaatgataaatcgataagatcaaaatataaacatatctacatctcttttcttttagagggtctattcgactgtttgatatagtatacacaacacaactagccagtatatccgttgccacagacataaattattgtgcttgctagctgtgttgcagccgaacacaaacccttccatatcccaaccgtatcctctgattgtataatgtcaccgcgtgacattacttcaatccacaccatccaatctaaatcaacggccacagattaattggtactccatctaactaatcaaactaactagcagagtatgtactatgtaggtatgtacttaataggtgggaaggatttttttttaacactaaagcagtctcttcatcttcattaaacattaacccatcggcttgtagattaagaattgccccgttccgacgacagaggatgtggcagcacaaaattgatgcacaggattcacttcctccaggataatgtgctaatcgctgcatctaacaagtactaagtgaaacctaattatcatcatgtgccgattcttccaccagtcaacgatgtttgcctcttgaaaatgcaatatctgatctagggacaattatagctgcacaatttactaattagtttgattaattgcatgtcaaataatctacggccgttgatttagaatggatggtgtggattgaagtaatgccacaccgtgacattactgagtaatgtcagaggatacggttcgttccatatcatgcagattacctatctttggtatcggtacaacagctatcttatgtaaaaatttctttatgaaaaaaaaacccgtatactttttttgttttaaaatatataatattcgattagccactatactataaatgtgaaagaagcacaaagaatactactacctttatctaaacttattttataacttgaaataaatttgatccattccataataataaatctacacatattccctcctcccctcttccaaaaaacccccaaccttagattgaattttttttagacgaaggtagtccttccatcccatgaaaaacaaatatagtactggatgtgacatattatagtacaaataaatcttgacacatatgtctttaaaaaaaacttaacctaggcaagtatgtgacatctattacaatgaatctggatagtcctttgtcccgatttattatactagaaaatgtcacatcccctcctaggtttagtttttttagaatagagggagtatgtatgtccagatttatagtattaagatgtgtcatattcggtaatagattgatttttgatgagagggagggagcggttcagatggaacagtagtccatccaggcaggcacctaggaaacccaggaattatggccgcatttatgttgtcggtatcacccgtatcacatcacaatacgtcaatatcacatccggatgactaggtaaaccagtgccggagtcagtccagtcactcacaaaatttactcgccggaaaacccaaaagaacggaaaagaaaaaaaaagtcaggcagtcgtcgccgtgctcgccgcggcggggtccatcggtgtcgccggcgccaccaccacaacccagacgaggggagacggcatccaggatccagcaataatagcgcgtcgcggtggtcgtcgtcctcacctaatccccccccccccctccccatccatctattctcagccaaaagctcccctcttctctctctccctctccctctcgct

SEQ ID NO: 43028 - DNA, 1246 bp, Oryza sativa
gatctgtgtgcgtctgggcttgggaggcctcggaatcggggttgaattttagagcgaaacaaagagaggaaaatgtcgttttcgccatgcctgtcatgatttgattcctcttgtgattggagcatcatatccaattcgatcattgatacaatgatactggcacaatggggggtagacttcctgttggtcgttcagaatttcctgggatcttggtgttctctgggctcccgattggtgttgtgtattcctgaataatttcggtgatctgttctgttattctcgtgcacgaattgctgacttagcttatcgatcggccgattattgttcaattcctgcattatttttctagtaattatagagctcctttttgacatatagtcgatgcctaagaagaagcaggaatgttgaatcttgcgaatgatcaactgttagaattagatggctaatatctattataatctggaatgagctgccaaaataatcatgccttcaggtcattcggtttatctttagcagaatttataaaaaatagtagtacctttaacatttagccatggtgagttttcccttttagcacaagttataaaagggaaggaagacgacggtacttgtgaagtatatatgttgggtagaagtatagaacttaattaacctaaaaatggatcattcgaagatccttagagaatacatgggctgaatttcaataagcaattctaaccatacactccctttcccaattcgttgtgtcagattgatctagtggtgtaaacctgaagagtctcattatgtagttctgaacttctgatctttggatatgattctcatctctttgaatttcattgcagtgccaaaatggacacactctgtgttccacctgcaaagctagggtgcacaaccgttgccctacatgcagacaagagcttggtgatatcaggtgtttggccctggagaaagtagctgaatcgcttgagcttccctgtaagtactgctctttggggtgcccagagatcttcccatactacagcaagataaaacatgaagcgcagtgcatgtttagaccatacaattgcccttatgctggttctgagtgtgctgtggtgggtgatatcccttatcttgttgcccatttgagggatgatcacaaagttgatatgcatagtggttgcacattcaaccatagatatgtcaagtccaacccacgagaagtcgaacatgccacctggatgctgacggtaagtacctatag

SEQ ID NO: 43029 - DNA, 4769 bp, Oryza sativa
cagggagaaataatatcttcccattaaataaaatgacaaggaggccaaattttcgtgccactgttcaagaataacatttacagatatataataaatatacatattttaatagtgaacattacagagccacataaatttcagaaaaactttcctcttcctctgtagttagcttgtaggcaaacaaatggatacatatgcacatgaaatttccacagatcaacacaacggcagagtcacattctccataatatccagcctcagcacgcaacatgatcacatttcttgctgcataatacaatgtaggcaacttcaatcatctcatgtgagcaaacagaaagatagaaaaacacaaaaatgcttttctttacagaacagcatcacagcctggttgcatttctgtcaggaatctcccaacctccatatatgattccaggagaactttagatcctctttaatcaaacaaaaaaatgtaggtaaaatatatacgtataaactttgtaaagagcaacacaacaatggaatcacattttcctatacacacaatatacttacacactacgccatccagtcatccaaaggatatagtgtcacacctcacaacttcttttgaatacttcctagaaaagttttcatcctaagacgctaacgcaaagagaagcaaatcacttctgtcaaaagggcaaaatgccacaatgatcttatttcttccacggttcaggctcatcaaagaacatggtcaaatctcctgtcttgctgttgcatactgccagaaaactttctatccttccatgtagagaacaaaaaacacaagaccttttgtgagcaaaggtaacaagagtcacattccctctgggacaatcctagtcacaaaatggatcctttttctttgccgcaagctttcattgcatccacccgtgcaaggaaacaacaagaagaagatatcaacaatttataccatacggcaaactcttctcaagcgtgatcctagctaccaactatttttattgtatattgcatcacaaaggttatcacaaggccacgtcaagactataggcatgtcatgctggctcgttttgttttgttcctttttttcaccgacatctacttcgtgacgaaatgtctctctctaatataccaccatgcccctaaacttggctttaatattgtgaaatgccactcaccttcgttgattctcccctcacatgtttcctatatttactgaactgccacttgctttctaagcttctatggggatcctctgtgacccacagatttgaatatttatgtggcataataacgtttgcaccaaaccaaaattactaagagcatatttaatgttaattttaccactttacatatgtcccattaatttacttttttagcattggatactatgggaggagtacagtgtatcaaaaatggaaggcccatattcggaagttcaagcaaatacaaaccgtcaagttgacatgtggatacgaccatcctttttttggcgttgctcagtgtggtacctcgacaagcattccaacaagttcctttcacgttttgtaatctcgccaaccagctctgaagaggaagggggtgtgggtgttctactcaacacatttctctcctccccctcccctcacccccgtctcctctcaactcttgttctttttctacttgctcccttgagactaatggctttccttagtagatgatacgattattttcctgtttttgcattttcctttggctcatggttgcaggagtcgattgttgatggtggcaagcaccatcggtcaaaccgtcgtgcttctcatcagtaaatgatctaaccactagaagaattatgtcggaatttgacagtatgacatatgatcttcatcatccaaggggtttcaatgttgtttctgagtttttttgttttacatggaggataaggaaaagaacctgtgtaagtatagtcacaatatctttttagaaaattattaagttctctataaggacctgtgtagtggattccctttcctatatattctatttttttatataaaaacattatcagtactatcaaattataatgtttcatgatatttttatatgaaaacacttagcatagtttggtagaatgggaaaatattgttttttataatgagcacaaatcatattttaatacttaaattaagaaagtatttgtaaggatattttttgaaacttgcatgttaaaaaatctcatatctattattctcttgtataagtgaaattgtttttgctattacaagaaacacacatgcctacacaccaccacgcatgcacaccatcacacacatgcgaagcccccccccctccacctccctcccaaaggccctaacacacgcttaaagagacggacacaaaagaaaaatccctgacctcactatttgattcaataaaaaaaataatgtttagcaaaacatttcaccaattcgcaagaaaacagaaaaaaatacttaaaatatgacataaaaatataaataaacacatctcctctctgtgttttggagtaattgactctattgattactgccttattgccatctcacttcgataaatgaaagttgtatgattataatttttgacgctgcacgcttcgatgacataacatattttcagctgtttatgatattttgctaaataaagtggtttgaaattaaatattttcagtgtcaattatttaagaaggcaggtactatcattttagagcatgcatgccatcatcgaagctcaaagttctagcaacaattaatagttgcactcttaataatcatatccatggagtatcataatgcataatatgctgcagagacaaatccaagctcatattctgcagaaacaaacaaaaaagatttggtgcaaatgatctggggacatagcaggaaaagtgatttaacgaatcctacttctcgcaggggcaatcttgtactcacaaaaaattaaatcctatgtcaacaattaatgttaaactcacctttattcctagttttaagctatataaacaagactagccactttgttatcattgccctctctcagctcccaaaaatctcactcatgtttgattgctttagttattctccatcaagaggttgaaggctaaactactcttagttcaatgtttaactaaacatatccatacccatcactttggtaagtatcatttatgtgccacactatatatgtatatgcacgtcatttattttattggccacttttctagaaatcttaacccccttttcttacaaattcatgtgttgatgggtatattctgtggatttttattattatttggcatttattatggaggatggattcgaaggtaacatgtagagtaaaatacattgttggtccttaaagttgttgtgtgatgtcatactagtccctaaactttgaaactttgaagatggagtttgagaggagggggggggggggagagagagagagagagagagagagagagagagagagatggtaaccacaccagtatccgaaggagtatttggtattttaataagattaggatgtgtacttttttctcaaagttaagggatcaacatggcaccatgcaacaagtttagggagcacttctagtgtattttaatctttacttaaatgtgggaaaattatgtcttttaagtacactgtaggtcttgtgggagctacttttatggatgtgcctttttgtgtggcaacactatgttcaatttatttaggatattgtgcttatgtagtgtgattaaaatgatcaaatcaaaattgtgattgatgtcctaacacatactcctttgtcccaaaaaaaccccccaatcctagggatgtatctggacaacgtgtatgtctagatatatatctaggattggattttttttttttggacggatggagtactactttaattaatttcacaataactatatttggaattcgaaatgcaaagttcctttatctatgttcttacaactatttctcttcatgtacttgatttctggagatggcttccaagatattgtaattaaaaacacatccctcacagcttccatagacgctactaaagtttgtggtgcatatcaaagaaactattgttgacaagagcatggcatcaacaggcattgcagtgagcccaagcaacaacgatgctttggacctagctgttgcacaattagatggtgatcaatcttcatatcatcatacaccagaggtcttcttactctaccttgcagttcccggtgttcctctagccaaaatgcaagtacttgagtctgattcggttgccgcagtgaagcttcggatccaaaacagcaaaggatttgtggcgagaaaccaaaggttggttttcgaaggcagagagctctctcgcaatgatagccatatccgtgactatggggtgaggtatggaagtgtgcttcatctcgtgatccgactatcagatccacgacgaaccgctgtgaggactgtttatggaaggaagtttaaattccaagtggaccaacgtcgaaatgctagatatatgaagcaagagatttcaagaaatgttgaaagtcccaatggtattggagagagcatgactttggtcaatggtgaaaagcttgatgaaagcacattaatctccaccatttgtgagaccaacacttctgataccgattttcttgcaaacaagtcagaaaattttaatggaaatgaaatagaagaatcttttgagcaattatccatttcttctgacattggaaacaatttacaatttgatgatg

SEQ ID NO: 43030 - DNA, 1377 bp, Oryza sativa
catacattcttgaccatcctattagtggttatcgcgtgagcgatgaactagggtttgctggtgttcctccgacagttcttgttcgatgtttgaatggttatgttgatcagactaagtatgattgcgcggagaaagaaccgaaaattgggtccttgcaaatgtttgtgaagaattctgggagttgtgaggagtttggtcctagggctttccctgtgcaagaggtgcacaagattgctgttttggatatgaggctagctaacacggatcgccatggcggcaacatactgattcgtaaggatgagaatgggcagattgagctgataccaattgatcatgggtattgtctgcctgaaagcgtaagtattttgttttgctttgaactgcattttttgtactgaaaattgaaatctatgatcacccatagtcactaatcgccataaagagttgctcactccatgtcaaaaatataagctgtataagtttcttacactgtcttcagtgcaaaactttgacctttaattccttgtatagtattaatatcaataactataaaattgacataacgtgaatgtactttcaaattcaaatcttatgatgccacatgcttgacgctaaacatatgtaccgctagttcaattattagtcaatgtttgcaaatgttggcttcctaaaattgcgggaggcttatatttcaggatagagggagtaattttcacgaccacacactatgtacacattttaatataatatccattgctaaattttttgtcctaatttggttactagcaatgattgttttctcatgttgtaaacaatgtttgaactattttagttttagtaattgatttgacttctaaacaatttatagtttgaagactgcacatttgattggctttactggccccaagcacgccagcctttcaatgttgaaaccctggactacataaagtcacttgacgaggaagaggatatcaagttgctcaagctcaatggttgtgaaccatcatctaagtgtgttcgtgtttttcgtctaagcaccatgatgttgaagaagggtgctgtgagaggtctaactccatatgagatcggtaacatgttgtgtagggagaacattacaaccaaatcaaagattgaagagattgttgaagaggcagagcatgttgttcttcctgggataggtgaaaaggcattcatggaagccatctcaggtatcatggatcgctatctcaatgaactcttcaaatgaaatgctcctcaagatgactgtgaattatggtttcgagtgtgtgtgataagtgaatttgtaagtaatgtaagtctcttttgtgtcaagatatcgcctccatgaataataaggaaggatcattggtccttctt

SEQ ID NO: 43031 - DNA, 8406 bp, Oryza sativa
tatgtacctatgcgcacacaccactgcaaacatcacgctatgcaatttttttcctaaagaaaacatgtatattactataacaaaacttatagttatcgatctcactttatttgactcccccctttgggcgaaaatgagtttcgacagtggcaggaatttcgaattcaaataaatttttgaggaaaaaaaaatggcattcacccaaccaaaatgctaagtgcacaccctcatcagttcatctacctctctccttcactttactctctctctctctctctctctctctctctctgctcccgccggaggcaacggcggcggacgtgctcctctcctcccccgatcgccggcgagcgggttcgccgggggcggcgacgcggccggctcatcccaccggcgcccccacctcgcggcccgattcgaaattttgaaggtagtattcgttctcgcctcgcttagccctccccccttctcctgtggccgcttcacgagccggcgtggcgcgtagattggggatccatccggtgattgaatcttcccccaaggagattggatgggatttgtttggaagggaatagttccacgcgtagtgaggtgtggtcctcctagggattaaccgaacaaagcccttggtttgattccggatttcttcgctgcttggtgcagtactgacattgaggggacttgttttgctagcagtttgtttgcaaaaataattggggattcagttgaaaccccatgcccccacattaagcggatatttgcttcattacctgcaagagtggtcaattatgtagtgttacagggaaattggtctgtagggctataggcacagactgttagctatctactttggctgaatttggtcaggtttctgcacttcctaggttgatcgtaacattgttgttactagtctcactagtgttatgcagggggtatgattagtttataatttctaggtgttcctgtcaagcttaagaatatcgaatatgcgcttatattttataatctaaagttttactggtattggttgtcgtaggcctttagcatgtgtagatagtgattgattgaagaatgcaaaagttcagacgacttccacctgttctgctgcagcttgtttgatcactatcatgcatccctgttggctttcgtatggattgcgtttgccctctgaaactaggaagcttaatgtgtgttacgctgttactgtttgagtagttggataatgaatcccatggtagcactatttgcactccggtttagacatagtgattaaaatggaatttctccaaaactagatctggcccattgcaataagtagaattcacattgaacattaaaactttgcagctaagtttgactatgggacatgtctaatgtatcttctaccctttatctgctttaccatgcaggtggcactttcagattgcctatgctagttcatttcacgctgcatatccaaaatggtgaagctgacaatgatagcacgtgttactgatgaccttccgttagtggagggattagatgatggtcgggatctgaaggatgctgacttctacaagcagcaagctaaactgttgttcaagaacttatcgaaagggcaacatgaagcatcaaggatgtcaattgagactgggccataccttttccagtatccttaattcttatgctatctgcagatttagagttcctgttgaaaaagattattccctcatgattttttttataggtgttccgtgccaattcccaaaagattaactcatggttaccctttttgtggttttaggctcaaatttgaattgcagcagcaaagacaatgattccaactagatatgttggttgatacatacactctgtttagttttcctctttagttaaatttaactgctcattccattgacaacatattcttgctgcttatgggggagtgagtgaattggtgagtaataagtattgtattagacattttacttggtctaccactctcccaatttttgcatcagcaagaacttgtatattctatgccctatatgcatcatctgcctttcgtcatatacttggatgttaatggcaccaagatgccaggaaagttgtgttactaatgccgtatgttaagaaactaaatcatttcttgaattttcatcctgtttgccttgtgaaaatcatttgtggtacacttgttgcaccttgatttaaccaaacagttacatcatcgagggccgtgtgtgctatttgacaatgtgtgactgctcttatccgaagaaacttgctttccagtacttagaagatctcaaaatgaatttgagagggtcaatggcaaccaaattgaaactgctgcaagaccatatgcttttattaagtttggtatggttcttacattcatgatatttttctttatactcattctctttattctactagttaatggcttatatttcctgtttagacactttcatacagaagacgaagaagttgtatttggataccagaacccaaaggaacctggccaagttgaatgatgagctttatgaggtgcaccagattatgactcgcaattttcaagaagttctcggtgttggtgaaaaactagatcatgagtttgcctttgcaccttatctgtgttatgctgcatcgttcatcatagtttttagcacgatggacttgtcaatgatttctgtgcatatgagattaacttgagtttacgtatttccttgaaagattatcagtgaataggtgagcagtcaaattcgcaaaatcaatttggtttcagcagactatcttgccctaaaattacttgagttgtgttttcattccgcactatattgttgttatattttgtgttttccttcaataggccattttgttgtttcacatcttattaatatttcttagactcatgcttccttttgaattgtttgctccagtacacaccaaagctgtttctttctttgtgttgcctgtaatcccacgctttgacagttttgcatgagtgcttcacttttggcaagacttgttgcagtctcatctcacatttcgtttcatgcttagaggtttacatttcccagctgttgctcagtgaaagttttctgtttgcagaggtgagtgaaatgtccaataggttgatctctgatactagaatttatgcggagaaggcgaaggatctcaatcgtcaggtgtgatcccttattccctttactgcatttgccatctggcaatctcaatctccaagcaactaatatgaaattaatatttcaataaattgtgaattaatattggacatgtgataaatcgtgactgctgtttattcatggaagtcttaagggagtctactcatttgctttctagaattgtgacactttacttttctcaaaattatacatcaacagtccgttgtttcctagaatgatcgatgggcaattgcaatttattttcaaaaaccgtaaaattgtattgcttagttccagcaactccacttcaaatttccttaccttcattgctctttgaggagaaaagggggggaatttgtgctcaagtagtcaacaactaagttggtccttttgcgatcaatttgacacagtaatgcttagaacatgtctacatcctttatttgttaaacatatgaattcctgccatacccccaaattatgttcaccaatgcacgtgagggatatgggaatctctcatgcgttactatgtcctatctatgtcatatcactggtggactgttaagcataacaaacacctgatctgcattaccagtttaccacttcacctgttttcacgtctgtgacaaggctttccttcaatggttttcaggcccttattcgcaagtatgcccttgttgccattgtgattggaatagtactgatgctcttttgggtcaagaacaagatatggtgactgagagtaacagtcaggcctcctgttacggtgctggaacttgagttctccgtgcaccccgaatcgattctggctcaacagatgctttgatggcttatcccgcatctgcccattcaagcgagtagtagtgtagctcttcttccgtgctttttgttttttgtttttttgttttttgcctattcctcccaacaaagatcatccaaactaaacccattgtagtataaaccctcgtcatcgacccagcctatcctgatggatgaagaagtccttgagttcttgcagcaccgatttctggctaattgttgtgtagagtcggcttttcgacctccgaaatggtatatgttctttgcaaactcaccatgtaagaattgatgtttcaggctgatggatggacaaggcacataccatccaaagctgcatggaatgtcttgtgactcagacgttttagctgcaatcgaatacgtccggttatgctgctggagaaaggtcattctcattgccagattatcagcttctgtagtcagagattttggcatgcagtgcaacaacttgagatagaacaacgttaagtatgaagggcctatttgtcttgagctcaaatgctatgctaaatatgatattttttacatgcaacaacttgagattatcttgatgtagaacatgaacaaccttgatgatacctttgagctaaaatgctactgatactctggtatttcaccgtgtcttaagaatggaacatattacatagtatatcatcatctaccattacaccaccagtttggagctcagaaacttaacgggaatgcttggtttctgcagaatttaaattaaattacattctttcccgcaaaatttcggcttaatttggatttcatccaaatccaaatccatagtggtgttcagcaccggaagccgagcaccttgccgtccaccggcgagacgccgacgcggcacaccttggccgcctcgacgtggtgcgtcagcacacgcagcacggtcaccctccccttgaccaccagcagcgagtcgacctccatcaccgccgccgccgccgccggctgctgctgctgcgccgaggcggcggcggcggcggccatctgctcctgaggcagcgacggcggggtggccgcggcgaacgccgggacggcgaagctggcggacatgtccttggtgcggccaccgtcgatgaggccggcggggatgtagacggagccgagctcgccgccggcgtaggcgacgcggagcgagctgtcgaagtgcgcgagcggcgcgcggttggggttgcgcacggcggccgtctgctcgaacgtgaacgccaccgtgccgttcgggccggacgcgaacgccggcagccgcaccgccgccaccgcgatgtcgggcgggcgcggccggaacagcacgaacagcgccgcccccgccccgcccaccgccagcgccaggaacgccgccgccacgaggcacgacgccagcgccgacgacgacgacctcgccgtcctcacgtgcaggtgcagcggcctctgctcctcctcgtagtagtagccgtgctgctgccgcaccggcggcggaccatgccttaccggcggcggcccgggcggctgcatcggcgggggacctcgccgcgccgcgccgtcgccggcgatggcgatggccggatcgcgggttcttggcggcggctgcatgcgtggtgagtgggaagtggttgctgctggcgggcgtgcgcgtggcgagcgcatttgttggcttgcgccggaggtggcgcgccgctttaggagtgaatgatggcatggagtggttgggggcggcatgtgctgcaaaagtggagagcgcggcgaagtggaggcttctcgcggcagcctccgcagctgctgctgtcggctgtcggggagaggagagagaggagttctagtttggagtgagatcggtaattttggtagtggttgtatcgtactccctcctttccctaaatatttaaagccattaacttttttaaagccattgattttttttaatatgtttgaccgttcgttttattttaaaacttttgtgaaatgtgcaaaactatatgtatatataaaagtatatttaacaataaatcatatgataggaaaaaaaattaataattaattaaattttttttgaataagacgaatggtcaaacatttttaaaaaagtcaatggtgtcaaacattttaggatggagggagtatctacgacctatgtgttggagcggatatgaaagggataatttcggacgttgaaaatggtgggggtcgatatcgaatttgttcggaaaataattaaaattctcagatgctgtgtgtaaataaaacaatgtcaagttgttcgtgcacaccatcaaccattgtgtggggttcacatcatctgccattgaggctaacggcaaacattttgccgttgtattcatccgtgccacacattcttctatcaacagctgcatgaagtgatcccactattgtgattaattatgaactactaataagcagaattacttatttctcttttgaaaaaaaaatcagcaaatagaatacgcactcggcggcaaagcgtgcgagcaatcaagcatagaagcagagcagagcaaaatactgcagcaaagcaagcttctattatactgagagctatccaaatcctcgaacaatagtacatatcttataaaatactatttaagtattcatttgacaaaaatagcattgccgcactactactatgtccatacagagtattttttatccaaaaactagcagcgaaatgaagctactaacaaaatccttgagaatacaactcacaaccatttgaatcaccctacaaatgtatagactgatataagttaaaaaaatagaatttatcaaatcttaaaaaaaacagtctactctacttttgttctcacacgctttgccgccaagtgcatattctgttttctgattttttttaaaaaagagaaattagtaattatgctgattagtaggccctaattaatcatggtgggatcactgcatacagccgttgatagaaggatgtgtggcacggatgaatgcaatggcaatgtttgccgtaagcctcaacagcagacgatgtgaaccccattgtgtggtgggagaagtgcttagggtcttttggctagctccacatggtggtgggttagccgaccaaagttcgaagcctcattcattctatttatttgatattagatcattctctaatattcacttttttttaaccatgtgtgtggtgggctggtgtcgttgctacgtaccttgaagatcacgagaccagagcctacatcagagattaattaggaggtggaaggggaagtgctgaaaagggtttccctcgcggctcattgcatcctgcgttatgtcggtgcgtgacggtagtatgcggtcgtgagaagagatcgtgagagctcatgctgataatagggtaactgataaattgggctattgaatgtgtcaactcataatatatagagtagatagtgtgattatgcatatattatttcataggatagtccgcatctattgaattttagggataccatattcgtattcatatcatattatttgaatccgtatccatattcgctaaaatttttataaacccatactataccgtcattttggacagactcaacgcagaactaacatacgatccgttattaccctaggaggagatgtgacgacgtgtgttctaagggcaaacgaatcctggccgttggttcgatggttgtattgatagatgcttcagcttcacgttcgttttctttcgtgtcagtgaagctgttactgtcgtgttagctagactttgttctacgctgaactgctgatcagctgatcagcacagcttcactgattagctgggctttgtcgagcaatgtgggataaacttgcaccgcatttagttctaaacttttttttcaaacttctaattttttcatcacatcaaacctttactacacacataaactttcaatttttccatcacatcgtttcaatttcaaccaaatttttaattttagcatagactaaccacagctttggtattacgagtgtgacttgactaagcaaagcaaagcatagcaaagcgacgagcgaaagggaaaagaagttaggacgcggactccaccaaacaggaaattaacaggaacggagttggggattatggctgatgaggttcggtattctttttgtagtaatggtatttctttggcttttttttttgtgtgtttcttttgggacgcaaagctctcgctcgcggggagcttagtgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaagaaaagaaacttcgacgcacatctggccatgtgaaacaaagaagaaataaaag

SEQ ID NO: 43032 - DNA, 10906 bp, Oryza sativa
aaacacgggtcgggccgtacatccagctgatgcattatgggctgcacgcacactcgtcaagtaggaaaaggttaaattgaggtccctcatcttgtcatcttgtcgttgagtttcaaaatcgtctctcaactataataccatatataacttatccctaatctttcaaaggtatcagcgtcgtgttacgacccgacgcgccgaacacctgcaggatggacaccccgtcgtgcccgatggcacgtacccgtatgcctcgaattgccacaccccagaagtgtacgtcttctgctcgaaacaacaaataaaatataataatcacaaaattttcaagaaatcaaagacgatgaaattcacagcatggaaatttagcccccattgttcctcgaaaaaaaaatagcccccattcgttttaaactgtggaggacggatggtagattattctggttttgttacaattatttaagggcacaaatgagtgaattaacattgaacatataaagtattccaagaaatctgtatatatagttttttctttagaaaaaaaatgccctacccaccgaataaggtgctgtcaaatttagaaatggctccaaaactaatctttaaccataaatctctcacatatataaaataaatttctcatatattataatgtttataagaaaaatcgtaatcataggaaattaaattaaaatgtcaacccaataatattaattgcatcaaataaaatttaatttataataaaataattattggccaaatgtttaaagcgttgaatattaaaatgcgcgcgccttgttcagtggaacgaatggaagcgcggaggaacgaaacggtctccatggcgcagttgtcggaagagttccatgcctagctggctgctagtcaatcggtgaaggggaaggctagggacacgttatatatgatactagctgaaaccccgcacattgctgcgaaaatttagtatgataacaataaaaaaataatgtgtaagatagctagataatatcagattaagtaaatcaatatggtttatgataatttaaatttaaatagtatgtagaatggtgattcaaacgtaaaaagtaaggtggtatgactttatagaagaagaaaagtagggagatagtttgtaccgtagattattcatctcaaggctaaaaacaattaatgtgatatgacttaattagaaaaaaaaggagaaagataatttggaccatagattaatcatttaagtactaactaagtaaggatgaactgtataagtatataggatataaaaaaaacataatacataaagatatagcatgtatcaaaaaaaaacataatacattgaaacattatgtgaattatgttagatgataatttaacaggtttgtatttgaaaagctcttaaattataaaaactataaaaatatagcatgtttgcatgatgtttaaatgtgatcattgttagtggatgatgatgtggcatcttgttaattagtggatgatgatgtggcatcttgttagtgaataatgatgtggcatctttgcatgttaagtttaaacagttagtgggggataactttataaaaagataggattctggttcagggacgattttgaaactcgacgacaagatgagggacctcaaatgaacttttttcccgtcatcacagtaccttcacggcccatccattacgggcttgttggccggccgttctctcttctcctcgtcctcctcgtgcggcggccggggcgcgcatgccaagctgcaacggcaaatgtagcgacagcacgccggcgaccacgcacgtacacctacaaatggcggccgcgcgccaggaagacgtacggcaacggcaagacgtacagagagcggggggcgtttatattcgaattcaaggagcagcagcagcagcttgagctatcgccatggccgaccaagccaaccagctcagctacaaggccggcgaggcggcgggccacgcgcaggcgaggagggaggaggcggtggagaaggcgcacggcgcggcgagcgccgcgcaggagggcgccgccgacgccgtcaagaacgccactggcctcggcggcaactaggtcggccgcgcgacatggattcatccaactggcgtcctccatcgcaaagctggacttaactgatgtacatcttcttaattgtcatgtagcattccccttaattgtgtccgtacttctttaaaatgctctgatatcacttgttacagaaaagtagaatatggagctctctatttgggcttctttaatttgcttttcaattgagccaattttaacatggacattttatttatgtaaattttaacatggacattgtccaccagattagagttaccttaattttgctttaaatttgtgcctgtgttctaacagttgcattatgcttgtaaatcatgagaatctgtcactcttcaggctcacatcattgtgctcaagatcaactcttccaagggctccacattgcctcaccgcccaagttcaatcttggatctggtacgtgtgatagctaccttctagttctactttgtcagcaaaagaagctgcacctttggaatttttttttttttttggggggggggggggggtagttgggaatacttgggataaaaaggctctgcttgctttcaaaaggcatgcactgatcgatggccttttagctaagtaggaaatgacagacgaaaacaccatggatatatcaacatgaatgctcgccttccatgcccaagcaagcagaattgaatcgcatgagaaagcatgggactatgtacagatgattgcacatgattatgtatttatgtgaaggtttggatccaattgtttatgtttagattttatcagttgtcattgttgataacgatacaatgctactgctttgccgggaaaaaatagctgaagattgtcgaacacaaatacacaattattcccctacatacaagataaggagcacaaatacacgatattttagctaagaatttgtgccaggaatttagtggcaatagcccatcaattataagccactctctgatattctctctttatgctagcttttggttctttcgatcttctagtggtaagccccacacccatctagcaggtactatttcctggaaatccaatgcaaagaaaagcatatattctcactgtgatattgtgagcagcctaagtgacaaccaaaaggagctttttggttggcatattttatttccagggtactagctagtacactattttcatctgcactctcattgcttgcagggaccaagtagttggacaaacaatttattttctcattacaccaacattgcaaaaaatatcgttattgtataatatttcacaggtttattcattcacattcatggtgtttttgtgcccaattcagaattctcatttctcaatccaaattcaagcctacaaactaatcattaatcataattttcctgaatcagttagcatgtgtagatgattacatcatacttgaaaaattacacctacttttactaccacctatctcccaattagcaaatgcaacttattggcttaagctaccatgagtcagtgagagtcgcctcacacggtcaggccggctacgaaggcgacgccggtgggcggcagccaggagtagccgccgatgaacctcccgacggtgaactccatggcctcctccggcagcttgatgacgcggtggcccggccatggcacgcgcccgccgaccgccgcgccggggccggagttgcggtactcgccgtagtagagcgtgtccggcgcgcgccccgacgcgtcccaggcgagccagccggcggcgtggacgtggcccgctatgtacgacatcatgtacaccgccctcgagtacggcttccatggccgcccgaggtacgtcgccgcgcggccgcgccgcgccgccggcgcgagctcgagctccggcgaagggaggaggcggcagccgtgcacggagatgccggtgctctggttcgggtcgcgccgcccctgcgccgtgaccgtgttctcctgccccggcagcggccgccgcgcccacagcgtgcagttctgcagcaccacggcggcgttcccgaacacgaagtccaccgtgccggcgacgtcgcagtcgcggtagaactgccgctgcgcgtgcgcgtacagcgtgtcctggtaccccagcacggcgctccggtacaccaccgcgtggtcgccgctcagcagcagcgccaccgcctggtgcctcgccgcgccggcgcggttctccaccgtcatgtcccgcatgatgaaccccgccccggccaccgctgcggcgacgacgaagaccgacacgacacgatcagcaacgtgctccgccgccattggtaacagtgctacgtagtacgttacgtacctagcgtggcggtgtggaaggtggtgtagttgtcgtggacgctgcggtagccgacgacgacggtcttgccggcgccgtcgccgacgagcatgaggttggtcttcttgctgccgatcttgacgttctcggtgtacacgccggccttgacgtatatcacgacgcggcgacggctgtgctccggcgccgccttgatcgcgtcgcggatcttccggtgagtccccgtgccgtccttggcgacgaccatgtcggcctcgatctcggcggcggccgcctggaggagccgccggtcgttgtgtctcacccaccttgggaagctcccgtcgtcgtcgtcgtcgtcgtcgatggtcagtagccgtctgtggagttggttgtggacggggacatcagagagctcgccgccgggccttcccctcgcggcgaagatggcgaggctgttgctgaggtgttccccgaggttgccgaggtagccgagcatctgcggcttgatgcggccgccgtcgtcgtcgccggcgtcgccgccggcgccgacttcttggaggctgtccatgcacgtgtcgtggctggtgagcgccgcgctgagccacgtcatgatgtcgtcgtcgtcccgtcccgccgtgtcggcgtcgaccgagtccggcggcggcggcggcgccgcgatggcgccgaccgaccgcgcgaggagctcctccgcggcgtcgagcatctccacgcagtcgccgtacgcggcgcccgaccgcgccccggcaagcagcgcggcggcgccgccgagcgccgtcgcgttgtacagcgcgtccaccacgcggcggtgcgtcgcgttcagcgacatcggcacgagctcggcgtcgccggcgccggcggcgccggggaacgccatgagctcgccgacgcacagctccgggtacagcgtcaccccgcacgtgcgcgcgatcgcctcggtcggcgcgcgcccccgtggcgcccggccaccgccggacgacgacgtcatcctcgacctccccaagacggcgatcgccaccgccacggcgacgccgacggcgagcgccacgccgacgatgcacaggacgacgataaggcggcggcggtggcggccgtcggcgcaccggagccgaggctttgccgccggctcaggcgagccgagcgtggcatgggccatgcaaaatctactcgcaaatctctgttggtgtaagtggagcaaaagcgagacaagtgaagcatagaatttatagctgtgaggagagtgttcgctgagttagtttcacactggccactctttgcttcggaattcaccttttttttttgtaatttcggtgattttcatattgccaagttttgggtgtgtcgactggatttggtgtgcatttagtcatttacacaccgattttaaactacgaagggaactcatacaattcgcaatggaaaactcaaaattgtgatcagacacgatagggttttatgtacgcatgttcataagaatgagtatgtgtgcgctttaatgtgtaattaaaaaaaatgtgcaaccgaagcaaatagaaaaggataagggccccattgaattacaggaatgaaaaaacggagaaataggaaaaacataggattctgacaggaatgcaagtgtaaaacagaggaaatcaaaacacaggaaaaacatatgaatgattgtttgattgggccgcaggaaaaacacaggaatttaaggagagataaagactcaaagtattctttccatgaggttctacctcatgttaaatttcctgcaaaacttgcataggaaaagacaatccataggaatttcataggattccataggatccattcctttgattcaaagggctatataggaaaaaatcctataggaataaaattctctgaaattcaggctgtgtttagttcagcgtaaagtttggattttggttgaaattggagatgatgtgactgaaaagttgtgtatgacagattgatgtgatggaaaaggactaaagtttggatccaaactttggatctaaacacagcctcatatgaatttcttttgaatcaaaggggcctgaacctatggatgtgatgccaatagggcaataggagtaaatggtgatgtggtatcgcattactcccatccgctcgtgccggcgactcggcgagtgcttagcttgttcgttgccagatcggtgtgtgcgtgcgtgcatgtgcaatcatgcaccggccgccgccgcttcaccgacaccggccggccactggtaatccgccattccggcagccgctccggtggtccgtaacatggccgcggccacctccaatccggatcgggctccaatgcttcaatttgtttggtttgtgaaggattggaggccgctccaggttttatcaaggttttgggggaaaaaagaacggcaatgtgtaagttccaaaattatatagtaattacattacatgtgtaagtggggtgtaaatttgtataaagtatagtatgcatgcgtgtaaaaccttgaactaatgaagacgttaagttttaattaatcatgttgacagccgtaacgttagcctgccatagcaatatgcacggacatgattgcattggcacgggacaaaggaaatcgaacgcttcaaaacaccgactgtgatggaggagaaaatgtgtcgacataattatagcgattccgtaaatttgttactccctccgtctcttaatataagggattttgacattttgcttgcactatttgaccactcatcttatccaaaacgatatatacgaaggctccaaattcatgaaatttactccgaataaaacgaggcaaccgcatcttctctcccccggatctctcaattaattccacgagtgtgaacacacaacactgacacacaccacccaaaaccctagcgccgccggccacgcgccatgaatcgccaggcgccgccgcggcggaggtccgccccatcgccgccgcgcacggcggcggcggcggcgacacgacgctgcgggagcgcatcctccggcggccagacggctacatcggctcgccggagaagcgcagtacgcagacgttctggatcaacgacggctactacatggtgccacgcgaggtgacctaccgcccgggcctccacaggatcttcgacgaggtcctcgtccacgccgcgagcaacaagcggcgcgacccctccatggacaccctctccgtcgaggtcgacgtcgtcgagcgcagcgtctccgtcttctataacggccgcggcgtcgtccccgtcgagctcgtcgacgaggagcgcggcgtctacgcgccggagatgttcttcggccacctccatgacgacgacgaagaggatgatcagaacaaggcgacgaacgacggcggcggtggctacggtgtcaagctcgccaacctgttctccacggagttcatcatcgagaccgccgatgggtgccgcatgaagaagtacaagcaggtgagtgagccaattctgagcacacactctctactctctctcggcagcgtcacaccctcacaaatcaactccactgtgccaaatttgatactaccttcgttttttaatatattgatgtcgttgattttttttatgaacgtttaatcatttgtctcattcaaaatttttgtacaaatatatataaaaagaagtcatgcttaaagatcatttcatgatagatcaagtcaccataaaataaacgataattacgtaatattttgtagtaaaataaatcatcaaatctacctaactgaaaaagtaaatctctcaaagcaacttggatgaaccatgtaatgaacaaaacagcaacttggatgagccatgtaatgaacaaaacggtgaccatccgatacagaaaacgacaaaacagaaatgacaaatcgtagccatccgttcaaatgaagagccttcctgaaggtaaaaagagagagatagtagtagaagaaagaggattaaaaaaaaaggaaaagaaaaagaaacaacgctccgcctcagctatcgcttagcaagcatgatcatgggatgggatcggttgagttcagtgggccgaatgatcgtggggttaagcaacatgttcaattaaatctaaaagagacacaaaagaaaaaaaactacttcctccgtttcacaatgtaagtcattctagcattttccacattcatattaatgttaatgaatctatatagatatatatgtctagattcattaacatcaatatgaatgtgagaaatgctagaatgacctacattgtgaaacggagggagtattattaatttgcaactcaaaaaaactaatcaacgattggacaaatcaaattccaataaattaaattttggaaaaccgcctattgtttcctgtcaattatattctcttaacacctattcaaatatgtaaaataaaattacatttgctaaaacatatgtatcacaagtaggaggatagacggaacatacaaggagaataaggtggtcacgcataagtagagatggcgaaaattcggtggctcgcacagtacagcaactaataatatgcatggttgtttatactcaaattttaacatcaaagaacttataaattttgattccaccgtgaaaaaattaaaaggacccatgcagtgacaagacgatgttaataacagagtccataaagtagtatatcttattaaaaagtcaacggcgtcataaattggaaagccggaaagagcatgtggcatagtttggtacacctgatactgtttttgactcttctaactgttagatcctgcacactatgaccagtatctcctaggatcatgatatgttatatttgcctataccatgaccagtatttcctgggatcatgatatgttttctttgcctattccatgaccttgttacttggcaggggttatcggctttgttgttgatatatactcgctgtcatttatttgatgtccagatctgatccagctgcttggttggcttttggaggaatgtagttgccaggtagtagtcaatgagtcaaaaaactctgtgtaagtctatctccatttctactaatggaaatgggaggcctggcctcttgctaaaaaaaactcatcgtttataggcatgcaaattctgtattatcaacaaattttctgagttttagatgtagttactactttcatggagcattggataggtcagtttactatcaaaacaatatagatcatgatgttacttactccttgaatactttaatttccaggttttctctgagaatatggggaagaaatcagtgccccatattacagactgcaatcaaggggagaactggaccataatcaccttcaagccagatcttgctgggttcaacatgacctacctcgaagaggatcacgtgacgctcatgtggaagagagtggttgatatggcaggaattctaggagactccgtgcaagttgagtgggatggcgtgaggctgcgtataaacagcttcaacgattatgtgcgcctgtatatcgattcccctgtcagtgacagatcaggagcagggttcccaaggttattgtgctgtgttgtttcgaacgagcatattagtttgttgagtgatcgaaatctatccataatggttttgtctttttaattagctgaattcacctttgccttcttgatcgatttcagagtttacgagaagttaaatgattggtgtgaggtctgtttgagcctgagtgatgatggacactttcagcaggtaaatgttttggttatgtttatatcagggtagcttcttagttaaatgccatggttgttgctgcattttactcctgttttttatggttttgcaggtcagctttgtaaatggatttgagacactaaaaggtggaacccatgttgattacgtcacggagctgattaccacccatctgatgaaccttctgaatgagcactatgaggagtgtaacttcaatgtagatgatgtgaagcgctatctatgggtcttcctcaatgtgatcatagacaaccctaccttcgattcacagaccaaggagacgctaactacacctccaggaaggcttgggtcaaagcttgagcttcctaaaagtttctcgaaaataggtgtgtgcacatctgacgatgagtcggctaattttggctgactgcattatctgcagttgattaggctttacagctaatggtaattaacgcttattatctcttgcaattacagcttttggcaatggtcttatcaggcgtctgtttggctaccgtggcccgctagatgcaaagactggagtttcatccagagactagccactgactggagtttcattcagagactagccactgaagttgttagttcagaaacacatgtcagaataagatagtttgtgcatttatgtgggattatgtgtatatatacatgtttgcatcaggaacaacaaatttcaatggtggtaccttccttgtcggtagggtcgatctgcaacctccaaaactcgcaagttcaaatttgaattagaaagctgaggtaactgtattttgggtagggaaaattggttctatattatcatccgataaaacg

SEQ ID NO: 43033 - DNA, 18969 bp, Oryza sativa
  unsure (1)..(18969): unsure at all n locations
nnnnnnnnnnnnnnnnnnnnnnnnnnnnnnnnnnnnnnnnnnnnnnnnnnnnnnnnccaaaagaatcatatctgtaaaaacaaaaatttgaacagatacattccgatttgcctatgaatgaataaaaacactaatggacatgagctaagggcgtttacagtgcattgagttggcattcggcctcagcgtttcccaataaatatttcgtgttacgttcgcttctgtcgcacctacttgaagtccccgtatttaactttgatcactcgttcttcagcctaatcctgggtaagtaacgtggggagagagagagcatcatcctgtggaagtcataaccccgcttcctccactcctcaaccgcatggggatcagatgtattatgaatggcataagaaaacttaatgtacttttatcattttccatactcctttcgaaagacttgtggcgatgatgccgccaacaccactgacgagtggggccatgagagcagtacaaatgtgagtcctcttgctttgtgtgttgcagtcattgctcttcctctccggaaagaggaaattgggtgcttctaatcgggttgcaaccctttaatgctatattgctttgcttctttctcacctctattcaagttaaaaaaccatgaaaatttaagtttcatttgtacatttaagttaattacactgcacaatttgttagtaatgagaatttcattgccacgtgaaaaagggtttatgtctcactttaagaactatactatgtcccttttctttttgtctttttaagataaagaatcccatttcaaccaaatagaagcaaccatttttttctcaacaaaaagactcgttttttttccttatatataaatcattgcaatacacgggtatttgaccagtaaaataaaatacaaggcaaagcaaggaactcatgcattccaccataaaatataccactttctccgtttcacaatgtaagccattctatcatttcccacatatatattgatgttaatgaatctacatagatatataatattaacgtgggaaatgctagaatgacttacattgtgaaacgtagggaacatctgaattggaaacatatggaaatgcaagcttgctaaaagaaatgacaaatttgttatatgtaaattagaacaatctgaaaattactgaaggtggcatccggtattcagatcacgcctcctttaccgaccaaccaaacaggcaccaagaacagggtgcactgaatgacggagtctgaaataattaagtagtgttctgcatttcttcctcgcatttcctgcactgcttacagcgcattcgccccccaaaatttacaacttctgttatacgatttaccgtgtaaaaacagcatcctgattcctagacaggtttgctgctgaaaaattctagataggcactgacctgcgtggtctccactgaagaaatgtacaccaaaatgtggtcagtccttgagcctagcaggattcaccactcaaccgctcaccacgaaggtttcccagtgcatcatcatcatcatcatcatctgaaaccctgaatgacgaacccaaaatgtttcagacaagtaccccagatgtcaagcaggatcaccatggcgcagtggcgatcttccgcagcgcaatgtcatggttcctcacgctcgactccatctcctccatctcggcatcgatcttcttcagcacatccttcactgtcaacatcatggactccagagccttcaccttctccccagcacgagaccgctcaagcttcagctcattgtacttgctacactccgatggatccctcggttgctcggggaggccgagaatatcgtcaacgcgcttgagcaagaacgcaacattcattcccagcaggtcgaatgactgcagcgtcttcttccagatcaggaagtcctcttgcgaggaggtacccgccccgcaggccctgatgccctcagcgatgttgatcgtctccatgatcacccccacgacgagcgtgaggctcagctgcctcagcagatgcctgtggaggaacgacttctgggcgcagcacagctcatagtacgtcctgcgctggtgatcggggaacttgcagtcaatgaccaagccgtccacgacgatgttgaagttactgtagctcatcacgtcgtcaaagctcatctctgagtctgaaaacctgatgccgtctattgcttcatgaactagattctgggtatcatcatgagccactttgctactgactctagtagtctctggatcctccttaggcttggtggcattatcagtagcttcttctgtcatgtagaacacagcacatgattcgggagattcaatagttagtgtatattcccatgtctaacacatttcaaggtgcaaaactaacaacataaactttgactcactagatatcttccgtttcttgcaggcgtaaaaactcttgagaccgggtgctctgtcagttgggctgatgtttttatctctaattatatgcacctgaatgtaaggcatgaagaaacaagaggtaattgtattgttggattagggaagactgaacccacaagggaactcaagaaatgggtatgaatgaagattataaaggaacaatcaagtagtagtagtagatttggaagaaagttatcaagcatttcagaaacacttgccttgaattttgttgtgctcacaagctcaaagaccacaacatcgccaaccttgatatcatggttaatcgcaaaacctctccatccagcactgagtccctgcttaccacccaggtaatttgtgttatggttgttcccattctcatcttcgagcacaatgtcagtgtcatgctttgggagatacttgttgcagaagccagctggtagaccctgcagaggagaacaataatcagatgcagagaaaaccaaaaagaagtttctaggtggcttgtgcagaactagtgtcagccattttcataaacacaataactcaagcagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaaacttttactttctaattttagtgagagcatttgtttgacaaataaaatcttctaatagtaaatgcaatttgtatgtttctgcagaaggtgcttctccacagcctgttcataagaaacaattatctaaggcttcataaattgacaagcataagaaaagttagtaatctacaacccttaccagccaaaatccgctgacaacatgtgaatgtaacatatgtttaacaaagctaggatgctctgctggtaacttcgtttgaatctcttgagctctcttcatagcagatccacagaacgcctgaacactagatttttttggaagataactgcgtgtgattgaacaagcttgtgagctacataagtagtttttttcataagaagaacaaggagagctggaataccttgcacatttattttggcccttaactggcacctgttaagtcacaactcattcagttatgagtaatggagctcaaaagtgcaacggtttcgtatacattatacaggaattggaaaggaaatggtaaagtccactgaataaagattggagatgtgttccaggattacattatgtgatctttttttttcgaattggaaaaccggagatttcagccagccaatcgaaatcctaaatgctatggcttatgatataaaaatctttaggggtattatgagctttatagatgaaaactgaaagtcctcttacaattacattcatactgcattcatacaatacagatagagttggtgaacatatcttacttcagtggtgttagtgcgtccattgctagtgttctgggtattgcatgtttgaggaatgccaggaaccgttctttgctcattttccacctcctttggcatcagcatcttgcacagtaagaaatccaagaaaaatcagaacacttaatcaataagttgtttttgagatgagaattaataaatgaagttatgagataacaaggaggacagatattgtgagtttgtgcaattgaaaatattgttgctacatagagtgctatcaatgatgtagcatcattgacagggatgctctaaatagagcacatgtagtttatatcatataaacttacaccattgtaaacagataatcatataaagggaaaagtctatttgtcccttgaggagacatccccttgttttgtgcatgtcgcccaaaacatcataaaaaagtttaagaagatttgacattatagatcaatatgtgacacgatagaacaaaacacactatttgtaatcaaatttattgtttttgtttttctacttgtataggtcgaatttgaacttgcatgtttgtgaagagatattttacatattgatctatcttatgttttcaattttttatgactttttgaacaacatgcacaaaacaaggggatgtcttctcgagtgacaaaattccacccgctaactaaagcagcactgcccttactttcaaaggaacaacctccatcacgtcatccgtatcatcttcatcacaatcaattattatagcctgtggagcaacaacaaaagcaagattataattctgcaagtacaaaaagaacatatattcttgatatcatggtaaatacatgattcttataatggcatagatccaattaacccttgattattataggggctaccagatgttaatgagcattaacagaaaaaagaaacataagctagaaataccccctcctttccataattcaaggtcttttagttttgtcctaagtcaaaacttctctcattcgatcaagtttatagagaaatatattaacatctatagtactttatagacctggataaaattcacagttaacacataaagtgaccatttaagcaaatacagcatctgataatttgtcatgacttacctgttcagagttacaaaatttgtgaacctacgggaaactctttttaatccctctttcttgtatgtcatccaaatagttatgaaaaaaatttgataagatactacctccgtcccaaaatgtaacagcttttggctatgaatctagacacacagttgtccatattcatagctaaaaatgcttatattttgggacaaagggagtagattaatatgtgatatgtcacttcataaacatgcaagaacgagcggatagaatccagattgtgaagtgacatatcaacatacagatgtgctgcgatacatgaattattcagggtagcatttaagtagaagtagataatattatcaaattaagaatccagattgggcatacacccaggtattgtagtatatgcctctcccattttttccagttagaacctgtcctgatttgaatgccttgcaacaacaacaatgtatgtatcgcatcaatgggaaatgataatgcaagaatctcaccctcggcccaatatcgtcatccctgtcgctgccactgctgctgtcaagtaaggcgagcctttgatggactagttccatcttctgctccatcttgttcttcgtgttcttggaacctggtggtctccctctcttctgctcaagaacaaccaaccaaaggacaagcgaattagattcagattacccatggaagtaaacaccaatatttcagtcattaaacagaaaacaaaaatcgtatccaagaacgagcagtacaaccaaattgatcaaagaggaagcaaaatctccaagaagatcacagataaccatataacatagctgaaatatcagatcactccgtcatccgaaaaaaaaagcatggggaaattttcaagaacacgtctctctctcacacacacagaacactctcttcagtctcccactcggatcgaagaatcaaaacaagaaaagcagctaagaagatgaaatctaacacaaaagacaaaaacttttagcccccaaatccgccgccattaatcgatgattcaagagagagtggaacaaatcaaagaaccctcggtttctaatccccggtatgcactgtatataagcaacgcatatccccccaaaaaaatgggttttatttagaaacgagagatacagatatagagggagaggaaagaacttgctttgatgggctgatctatcgccatcggccggcggccctcgggttgatctctccgaactcccgctcacctcgattccgaagtttgtgggggctttgaggttttgaaatgtgaacgggaaggagaggaacgagccggctcttcagctccgcgcaagtggtgactgatttgactaggtgtcagcaatatcgcaggagatttttactacaccctccgtccccaagtgcctgtttggatcaacgattaaatttgatcttacatgtcacatttgatgtttagggcctgtttagttcgcgaaaaggaaatttttgggtatcacatcagacgaccggaagtcggaaggagtttttggatacgaatgaaaaaactaatttcataacttgcctggaaaccgcgagacgaatcttttgagactaattaatccgtcattagcatatgtagattactgtgacacttacggctaatcatggactaattaggctaaaaaaatttgtctcatgatttcttccctaactgcacaattagtttttaaattgatctatatttaatactccgtgtatgagtctaaaaattcaatgtgatgtttttgggaaaaaaattagaactaaacagggtcttagacactaattagaagtattaaatatagactaattataaagcttattctataaccctacactaatttgcgagacgaatttattgagcctgattaatctataattagcctatgtgatgatacagtaaacgtgtgctaattagcatatgagatgaatttattaagcataattaatccgtcattagcaaatgtctactgtagcaccatattatcaaatcatggagcaattaagcttaaaagatttatctcgcaatttacacgtaatctatataattagttatatttttaagcctaggtcttgtttagatccaaaaaattttggccaaaaacgtcacatcaaatgtttggacacatatgtcgacgtttgagaccgcgacaacggtattttgcatagtatatggatcgttggtaccagggtatatgcgagattgaagtaaaagagacggagacaagggtttttatacaggttcgggccccttatctgacaggtaatagccttacatcctgttggccgaagccggtattgctcttattcatcataatcacaccaatacaataattaggataacctatctagctgtcgtcgacttggcggcatggataaccaactcgtagtcgacgacagggtagccttcctcctcaaatccgcactcggcgagatcagagatagcgctagatccctcttgttggctttcgcagacacaatattgggtttgtctagacttatctttgatgtcgatattcggcggtttgtcttggcatgtgttggcttgtattcatctatgttgatcttggtcttgtggcttaacccctctcctcctagggggtcttgtatttatactcatagatgccctcttgtccaaatagaactagggagataagcatggatacgatccgagtagtccttttcgtttccatatacaactctatttgctttccttatccagaactccttctatatacgaggtatgattccgtatgagacttggtatatggtgggtcctatcgtgcttagtcaactattattaggtatgtggtacccataaccctgataacatgcataaggcattaaatgtgggaaacaaaaccaattgcacagtttgcatgtaaattgcaagacgaatcttttaaacctaattacgccatgatttaacaatgtgatgctacagtaaacatttgctaatgacagattgattaggcttagtaaattcgtctcgcagtttacaggcggaatctgtaatttgttttgttatcctatatacctatacaagtgatccccactaactgcagttattaccaattctctgcactgtggttgatccacgtcatccaaaaagatagcagccgttggatgaaatctcaatggtatgatatcaatgcatatgttatcctggtgagaacacccaagtattacacacgaaaagcccatttgacagcccaacaacccaaccttttgccttccccaagctgttcgctccccttccccacgtagatgcggcgccgcatggttccccttcccctgcgctgcttcccctccacccgctcaactccctccctccctccctcactccctccccgtgcgtcggttcccttacctggccagcagtacaccagggagctcctcactcccataggctgtggctccctggtgagtattttactgctaatccgttttttaattcctgtaattgacggttatggaatggcgttggttggaaatattttcagatgtccctgtcatatgttaaacggaatggctgaatgatgatcatattataaggatggatctttctatatccttcaaccctgttgttgtcatcaaatggtggctttttcatgttaagagcgaattcaaggtggactggtgttttttcataattcgtaagagctggtaattatcacctcaaatttgttcatttttatgttggtttcttaatcgtattgaaatagttaaattttacttataccttcacactatcatctttgagtcactttgtctcatgtggccatgacctttgattatagaaggtcaccaacggtcaatggtggcctgattgagtttgcagttttatgtatatgtatatatcaccaacaaaaatgtcgttacaatgaaacagatggatggttggttcagtatatttcttttttttaacaaagaattaatagttcagttttacccgagtgtcagatttattactcaatacaattcttataaaaaaatcctttagttaattgtcttgcgcactgcacatactaccaacatttggcaatttatattggtatttcctttgtattcacaccacaataattcgtgtagttgctactgtctaatttgttatactccgatgcagagttatattttatctaatgttatattttattttcctattactatttactagaatatgcaagggaaagaggaatcaataattaaaatattgatatggcaacttgcttcttgctggtgaataaacacttgaacaattctagcagctaacttaggtgcggtcaatcacagaatatttgttattgatcatatagtttcttgcaaatattcctaattgattgtgttgtaagcctaaagattgtatttactttttatttaattcagtatgcctttcatgctatactgcgcaaattgtgttgtaagcctaaaattctattcactttttttttaattcagtatgcctttcatgctatactgtgcaccactaaaaagcacgtcatagtttagattttaatagtaccgtgacgagcagaactgttgcacgttgcattcgttttgcatagcaacaaaacaagcatgtggtttctgttagtctattgatttattttttttgtcttttgtctctgctaatgttttatttgttgctcccatgtctcaaaatagatgtcctcttatagaaggttcaatcaagtgatgctcacgcaactaatatttttatttcctaattctctatatctgtacaatttcactctttttcgatatgatttaaattatgttctccagttaaattggatggtttatgggtcgcatttaactttgtccatattttcagtattatgcatcacacgaatgcaatatatactgatgtatgctatatatgatatctaactgatatagttcttaaaggtacaaatatgatttatctttatatttttctcaatgaatcctttgcaatcccgtagcaatgcgcggggtatcatctagttagtctacgtttaatactttaaatgtgcgttcgtacacttcaaaaacattacacccaaaaaactaaacacaccctatatttaataattcatgcaggtgttcaagtattcgatgtgacagggtgtaaaattttgaggtgggatctaaacggggcctacttttattttcgctaaatctgtttttatatcccctgtacttcctccgtccaaaaaaaaactcaaccaattatttagatgggacataatctagtacaacgaatatgggtagacgtacttcctccgtccaaaaaaactcaacctggacataatctagtacaacgaatctgggcaggctctatccagattcgttgtattccctccgtcctattttaagcgtagccatgattttccgtgttcaactttgatcgtccgtcttatttaaaaaattttagaaatataagtcacacataaagtactatttacgttttatcatctcataacaataaaaatactaattataaaaagttttcaaataagacggacgatcaaaattagacacgaaaattcatggttacacttaaaagggatggagggagtactaaattatgtcacatctaagtggtaggttgggtgtttttaggacggagggagtacacgcagaaagaagacaaggtattcacgtgcgtcacacatatttgacaagtctgggggtgtcacgtaggctagggttatggatgatccaaaatctgaattcttgatagtgcaagtggctatatgtaatattttagccactaaaattttttgtttcagttcttaattttttttgtttcgattcagctttgctgctgctgcacagccgcagcactgcaacagctccaattcaaaaatatgttattgatactgtagatgcagcacagttgcagccgtagccaactataccaatcaagcctagggtgatgcggagctcgctggtatggatctggtggtagacgacctcgagctcctctccgatggcgcggatctggccggtggccggatgctacaaggggaaatcgaccctgaggtcgatggccggcgacatggtggagtggcctcggcggcgagtggacatcgaacagcgaggctttttcctcctttcttcggccctcacctcctcccccgtctggcggccctcctccctggttgctggctggaagcacggggctatgcctctcgcaatgcgctgtgtgggctgttcttcgccccatctcacgaatctccgacggtttctgacaaagaacccgtggtgtacttaggctccgagttctttagtttgtaatacattacgttatttgaataaactttttataaaaaatttatttaaaaatcattatattaatccattttcaagtttaaaaaattaatacttaattagttacgcactaatagcttatctcgttttgtgtatcttctcaattttctcaattcctctcttcttaaacagagtcttagggctcctttgaatcgtatgaatgaaaagaatagaggaataggaaaaacactgcaattaccatttgattggactgcaggaaaaagcacatgaataggatgagagatatacaccgtgtttagatcccaattttttctttaaactttcaactttttccatcacatcaaactttcctactcacataaacttccaacttttccgtcacatcattccaatttcaactaaacttccaattttggcgtgaactaaacacagccatagactcaaagaaagttttccaataggttgaaactcttactaaattttctccgaaatctttataggatggttaattccataggaatatcaaaggataggatatgatttaatcatttatttcaaatgtctccatatgaatctttttctataagataaaatcctccaaaattcctatggttctcctacaaatcaaaagacccttaaaatatctaataccactgtatttattcaagtgatcaggaaaaaatgtctttgggttagtatatcttaatattagcacgcatgaaaatattctttataaaatgccttctgtttgaggaacttttcaaaaagtattactgatctaaaaggacccgttagctgtactgcaaacttgggaagcaccgttttgaaatggatgtgatggagacagggagtacagggagttatgaaaaaaaaaatcatgttttctcgatctttttattttgtaggatttgaactagattcccactattactattagtgagatagagatacgactccaccattgaacttattaagacttttgtttataaattatataatccaaaaggctaacaacttaagcctaatgccttgtttgcctaatgtgttagggaaatgatttttcacccaccaaaagacatctttaaatcctaaccatttattctccctcttccatttaattataaccattcattcatttttcactcccaatcccactcctcatttcccattatccaaacataccctaaaagattagataccattagagacgaaaatttacttatggattttccaattaaaatcacagaggctttggaacacagtactccaagtccgaatgaaacatattcctccacgtgactcaaacaccagcacatcagggcaagtactataatgctttatatgttgctcctacaagtgccacattggattaagtgatgaggtggaggagaaaagtgaagagagagatgatgagccacccctaaattaagaggcaacctccacacaaatttcaaaaaggatgtgagagtattagatatattggtatttgtaaactagaggtgatacattgtatgggttgcctcttgctttatgagtgaataaaatagataaatttggagacaatagtcatatctatcatagcacttaccctcatgcttatgggcctggattgaggctcattcaaacaggcctaaattcaactgcgccagaaggacaggtagcccagccagaaccgtttgtgttcaccggatcatatctgggccttttgccagaatcccagctgaaatttctgtcggtttccatcagtagaaaaacaaacccaaaaaaagagaaggtaaatctttgtcgcatctcgccatgtaaaaaaaagtactccgtactctataatctttttttatagggatggattacattagcagcaaaaggcttgttttggttactactactacgcatcacgcccagaacgtcgcgagatcgcccatagaattatccctatacgtggacacgtagggcctatctttttcccgtaatataccgtatggctactaatatactccctccgttttaaaatatttgacaccgttaatttcttagcacatgtttgactgttcgtcttattaaaaaaatttgtgaaatatgttaaactatatgtgtacatgaaagtatatttaacaatgaatcaaattatatgaaaagaataaataattacttaaatattttgaataaatattttgaataagacgaatggtcaaacatgtattaaaaaatcaatggtgtcaaatattttgaaacggagggagtactccgtactaagatttccatagagatagggtctacttcctctattgtatattataaattctttaatttttttctagtcaaattttattaaatctgatcaagtttatattaaaatttagcaacatctaaaatatcaaattagttttattttaataatttataaataaatttttatgtatatatttttagcaatttagaaactaatgataagaaataaacttggatgaaaaattaaaaacggaaataaattttgatttcatgcaagggaaacaccggtgaggccgtggcgtggccgtagcggtcgtctgattgggggaaagcgccagacttccttttctgccgaacgagacgtcgcgtgccgatacggctggggccacactccggtacacgtacacgacgagacgacgtccgtgcgacgcagcggcggagagatactagtaggagtagtactacacttttgcttggttcttttcctcgcggggcacgcaagggtgcggtccaccccctcctcgcggccattgcgcctctctctctcgccgaagtggtagaggcaacgcagcagcagcagcagcagcaagtgtccctgtgtccgtctccgcttctcctcctgcctcctgcagtctcgtctccaccgactgcaactaaaaccctcctcctccggcccctctcaactgcagagcgcgaccaccacctcagacaaacccgaggttttcttcttcttcttcttcttgatcgatgcagccagcagccatcgttcttgcggggaaagggttcttttttcgttttcttttttttttgtggctgctgatcggggattatcaccaccttcgcgcgatctctcgtttttttctctgtggaattgggggtggtggatggatggttgatactcctgttcatagatggcgatggtccaagtttattccttttttatttttatttttttcggatttgttctgttgctgtagttgccgtttcttggcttcttgctttcaatgccttctctcttctccttttctctttctttcttttttttttattttttgttgttgttgttgttgttgttgttgttgttgttgttgttgttgttgtctgttcttgggggtaatggtgtcccgatcgtattggacaagccttcgtgtatgtcactgattggaattggagtgtggagttagacgccgacaggtgaggcagatgaacaagagttccaacccaaaagttcactcatgaagtgttgtgtaaatagaagtaaatataagggagaaaatactagttgcttgggggagttgggattctccaaaagattgtgttttttttcccttttcggttacgcttggtgagaagatgatttattttggagatggtggacgacgcctatatttctgttttctggctatctaattctgacgatggcgtctcatgtttttcaggtgcgtttcgcgtgaagcgggttttaaggatggttctaaacaaggtgctcgagctgttttgtgtgaagaagaaggattccaagaagaaaggtgctgtacagctgcactactgcccctatttaacatcatgtttacatcagctgcttctgtttgtttgattgatccaaggatgctttcctcttttgatggcatattattagttgtcttgtgtactctttcttccatgaattctgcattttttttaaaaaaaagtgaaaatattaatgtgttttccggtgaaaggatactgcagatcaaatgaggtggtcataatggattaaaattgttggataattgtgggtgctgtacattggtctggattgctataccagatgcttcaaagtataccaaaatgtgatgtgtaaagtataaacttaatcttgacaaattcagagtgctattagtgtggttggatacatccactggagagtgaactagtggatagtctggtgttatgaatccatgagtcttggttgtcaacactgttttgaagtttgttaaactgtataaagaaaaaacaaacttaatatttcattagcctgtatacccatctccctctgaagcacggagttctactcattttgtttcagaaagataaaatcaagtgttttgctcttctgcctggcgttttctaataaaagaatatttttcatgcaggcaaagccattaatcctctttgtaaaggtatcttttcatgcaacttgttcctccttatttgttttagtaattctcatgcttcatgttgctgaacctgttttttaaagaataaaatcaatgaaaatttagggtcctcccctcccgttccccaaaagggggatatttgttactttaacagaactacacattatctaaatgttcatcactctgtttttctgccagtagttagtactgatgccaagtacacctctttatttttgcagttaagcgagcttccatatcccattctgtatctctgtctttaagattgatgtgctttttttttataacatcgtggtttgaaattagttactctactgactttcagttgccgctccacaccccactgcaaatgtcagtacaaacaacagccttttggatcccttttcaagtgggaatggtactgtgctattagtgcaaaaacatgagcctgaatgttcaagtgttgtatcatcaatgacaaggacagaatatggatctgaaagtgatggctacaatttgtttaaccaatttgatgttgtgcaagatttttctgatcattactatgcaaagaattcaccagggaaggtaagctgtgccgctttatgaactctatttctatcactagatccaactgtgaattaatttcctgtctttacttgtgaccactgaccagacctccaaagattgggtgaagacaatccaaaatgaatggaagcttctacagaaagatctacctggtcagtacatgcttttatatggcaaatcaatgtatgcatttttatcaaaccgccagtgcctagatggtgaatacatataatggtcctttcttataatagacctgctgttttatgccaattgtatctgatcacatgccaacagaatacgtttgagatatttctagacttaaagatagttggatgccctgtatgggctataccaatttgcttgtgtggtttgtagtcttggcatgactggtgctgagtcccaaactagctaatgacattgtctaggtttgatgtataaaatactttattggtgccatatctattagtttctgttgtgtgccacatatcttttagttatggtctgcatttgtcacccttttccatgtaatcttgtgatagcagcatataacatgtattcagaaattaatcttttttaagtttggggaatgggacaaatagaaattaatctctacatatatcaaatcatgtcaccgaagggtatcacaagtatcattacatacaatttacttttgtgccttaaatctttcgtttagaggagctgtgcctgaaattatatgatgtcttcagtactagcaacttgcatctcagcatggtttcaatcatgcagaatctatctatgttagagcttatgaggataggattgatctgctgagggctgctattgttgggccagctggaactccatatcatgatggtctgttcttctttgatgttcgctttccttctgaatacccacaatctccaccggtatgtaaccacttcacagttcacacacgctttgcaccattattttcatgttactaccatcattaatataatctctttaaaatcatatccaacatgtacagaaagttcattaccattcgggtgggcttcggctaaatccaaacttgtatgagagtgggaaagtttgccttagcctgctgaacacctggtggggtactggatgcgagaagtggggcaagtcaaaatcaaccatactgcaggtgctggtttccatccagggtcttgtgttgaatgataaaccatactttaatgagccaggcaacaaaaattcggctaatacagctcctggagaaaagtactcgttggcttataatcagactgccttcctactatcctgcaggacaatgatgtattcacttcggaagcctccaaaggtaactacagaacccccatctctcgtcaagttaaaagtggtaatttcacaagtctctgtgctggaaaagatagtaatagaagaatttcagctgtcagggttatatcagtgcttctacagtcatccagataaagtgaactgctctctgtgcctatatgcttttaaatactgatatacagttaggaactactataacattagtcatgctgtaccaaccgtacttgtcactccgtgaaactctttagcaggcattcagttgccaggagagcgattttccggcttgagaattgtgttgtgttgcgtcatgaaattgccaacttaaaaatttatctgtgggcacatttaactaacaaagacacgcattgtgataatgtgttttggagttttgacagtatgttattgcaaataaacagctgaataagtgagcgcatcagcgcaagaacatttgattttgaaacatcatcagttcatcaccatatgtacctatgaagtcctataaacacaattcagttccatatacctcttgcagatcgattcgctctcacacacacctttcattcactgcagcattttgagtcccttgttgcacgccacttccatgagcgtgagcgcgtcatcctggatgcgtgcgacgcatacatatctggcgcagtcgttggatcatcctctgcgaagggcaccaagcatccccgcgacaacaacagatcgtttgcagatttcaagaagtcactggagaagtactctgaactgctcaggaaggacttggccgcgaaccgcacacacttcctgaaactgacaagagactcgccggctgccgcagatgagatcgttgagtgtaccagcagctagaatcgtcagagcatttgaccattgcagttcacctgcctaactcaaaagtgaaaatggtgtatagatcatagcactcgttacacatactgtgtaggttttttgtttggaggcaagatcgttcggattaattatgcaagaattcgggttgagttcagtgctagccattttgtttagtagctgtttctggtgatacaccaattggatgatcgaaacgtggtccaattctgccagcctaggctttgaacctgctgcattttaaatttttaatagaacctgttgcactagtttatatatgcctatatttacgtggtaacagacagagcagagcgtgttctatctttggttttgaagacgtccattttgatgacgtctttcaactccagacattatttatgctcgaaattgtaaagtaccgcaaatttggtttatgcggaggtttagccagggttccaaatatgaaatgaaatattcacagtagacatatcgatgctggtctggtttgtgagacctcctgaacaacaaatcaagctaaaatcaaactaaaatttaaatttttg

SEQ ID NO: 43034 - DNA, 2715 bp, Oryza sativa
  unsure (1)..(2715): unsure at all n locations
agttcattaatcattgttagcaacaagctatcacattgtttgtacatgtgtataccaggatcccaagaatcatgtatgggtgtactgtaattaaggagcaatacaacagtaacaaagaatcaatagactgtatattttttttctgtatctaaatgtatttttcagttcctagaaatactcacagatgggagctagaaatactcgaagtcgccggaggaggaatcgctcgccgccggcttggccaccttcgtcggcgccgccgccggcttctccctcacgccgaactggctgaagtcgacggggtcaggcaccgatggcgggtgggcgctgcgcacgagcgcccagttgacgccctcgaagaagggatgctgcttgatctcggtggcgcccctcctcgacgcgatcctcttgccggggtccttcaccaggaggccccggatgaggtcccgcgcgacgccgctcgccgccgccggcgccgggaacgcgccgccgtcggggaaccggagcggctgctcgacgacgttgcagagcgtggcgcggttgctgctccccttgaatggcgtcatgccgtggaggagctcgtagaggaacaccccgaacgtccaccagtcgacggcgctgccgtgcccctcgccgcggatgatctccggcgccaggtactcgtgcgtgcccacgaacgacatggaccgcgcgtccgtcggctccgcgttgaactccagcggcgagccgtggaggagcccgaggtccgacttggacgtcttgcggctcctctttgggaggatccgcggcaagaacgccgacggctgcatgcagccgacgccgacgccctcgccgtcgccgccgccaccggcggcgaggcccttcacgacgccgttggcgcccgcgtgcaccgacgacgacttcaccagcatcgggcacacggagcaccgcagcgacaggtcgaagtcggagagcatgatgtggccgtcgtcccggacaaggacgttctcgggcttgaggtccctgtacacaatgcctagcatgtgcaggtactccagcgcaagcaacacctcggatgcgtagaacctgatgaaaaaaaacattcagagattttcagaatcatggtgagcaaatgatttaaaggcaatttacaccgagtttagcatgcattttcactttataccagggtgttttgaaatactctgcagtttgtactaggttgcatcgtacatcgttgtgaaaccttgtgaaatatgagtggaacttttgaggcttcttcaatttagaccatgcttcagaaaattccattcagacttttataaaatttcttcaaatttatataggtttaaggatgtgtcctagtgtttttagataatatgtgtcctagtgttaagtgaaacttacttcctccgtttcataatataagtcattctagcattgcccacatatatatagatgttaataaatttagatatagatgtgtgtctagattcattaacatctatatgaatgttggtaatgctagaatgacttacattatgaaacggagggaatacttcaataatccctggtgtaaagctaaaacatgtgctaaacctcttgtaaagggaaaacaaagtagtacgttttacctggtgtaaagtgcaaatttactcaatgacatatatccatgtcaatgtgcaagcattgtatgtagtatgttgaggcaaagaggatatatgctggagtgatcttgaaaatgtgaccaaaaccaaccttgcagcttgctcgttgaaatgcttgttgagctgcctctgccggagcgaatggaggttgccgccggagcaatactccatgacgaggcagtagaacttgtcggtctcgaagtgcgtgtacaacgtagggaggaacggatgatcaaggaggccgaggatctccctctcggtctgtgccctgaccagcttgttcctgctgatgagcgactccttgtccatcaccttcatcgcgaagaaggcgtcggtgtccctgagctccacgaggtagacgctgccgatgtcgccgtagccgagccgcttgaggagcctgaagtggacgaggccgagggggcagtccacggagctggccgaccggacggcgtcccaccggctgtcgccgccggtgtgccgcttcgcctggccgtagctgaagctgtccaggctgttgcttctcgcgatgctgcttctgtccacgctgatcgccggcgatttcgtggtcgtcgtgacggtcgctgcttcggatcttgttgctgatgatgctgaattctgcgctggatttggggttgttttgtcagcttgatccggtttcttcttggagcgtgctgttggtttggaggctgaggatcgattggctgaaacacctgactgattccgatctaatttgccattggggactgcatttccacgggtattgaaatccattctgtcattcgttatggacagcttgttgtatgacatggagttcatctgaaacttgcacaaaatgcacagattaggatagtaacaaatcagtgatgataatggtttattgatcatttactgcctgacctcataagtatcagccagaagcagaattcaatggatttcaaaatcaagcagaatgtgagacaacagaatttgttccagatacatttatatggaactcaaacagacaaggccaatgaggcannnnnnnnnnnnnnnnnnnnnnnnnnnnnnnnnnnnnnnnnnnnnnnnnnnnnnn

SEQ ID NO: 43035 - DNA, 10950 bp, Oryza sativa
  unsure (1)..(10950): unsure at all n locations
nnnnnnnnnnnnnnnnnnnnnnnnnnnnnnnnnnnnnnnnnnnnnnnnnnnnnnnnnnnatttcaaaatcaagcagaatgtgagacaacagaatttgttccagatacatttatatggaactcaaacagacaaggccaatgaacaagagcatctccaagaacggtaaatgcaggtccgacaaatgcatatatacggatcatcagatcatatgcgttcaccttttttttaattcttttttttctttttacatttccccatgtctcctatagcatactgtccatcatgatagtttttcaatatcgagccaaacagggcatactatgtgtttagaatataatacaacatgcaggtatatataatataggtcgtgcaaatgtcttgaacgcatcacaaaatatacttttgaagctttataattgaaaaaaaaagaatcagctagaacaacaaaaggcacatctatacttgatccgttttgagtttctttgaacaaaacaacatgtgtgccatttcctaccaaaggtcaaaccagcacgtcgacatgatcacgatgcccaaaattgtaaattctaactaaacagatacaaacgaacatattaaatactccttccgttttttaatagatgacgtcgttgactttttctcacatgtttgaccattcgtcttattcaaaaaatttacgtaattataatttattttgttatgagttgttttatcactcatggtactttaagtgtgatttatatcttatacatttacataaaatttttgaaaaagacgaatggtcaaacatgtgagaaaaagtcaacggcgtaatctattaaaaaactgaggtaatataaaccaatcaaactgaagaactgaacctaaccgatcgatacccaattccctacctccccaatgcatgggagagaagaaaaaaaaagagaattcatcatccgcagaagaatctcccaccaatcacaacaaattcgagcaaagaatggtcacacaagcaaagaacgaaatttacggacctagcagtgaccgaaccaacggcggccttcaagctccacggcgagacatcgcggtgacagaagagaggccaaggcgcgcaagctccatggacgcaccgcggtcgcggcggccggcaagggatcgatgagccctcatccagccgcggcgggacggcctggatgtgggtgcggaggaggaggaggaggaggaggagagggtggggcgagaataggtggatggagaggaggagaggagaggaggcatcggctaaatttaagaggacgcgcgcgcgcgtggggcggcggcggcggggggaggagaagagtggagaagagaagaggagaggcggtggtggaagcggtcgtgtcgtcggcaggggagatggccaagcggcggcggtgttcccgagaggctccggtctccggcgtacggccggcggcggcgctgggagtgtggttaggtgggcttgcttcgacggcccaaggcccaggttacgttgctatacgtcatggttccatacgattttttgatccagattgtatttcttcgtgatgaggaggagaaaaatatcatcattactccaggtaaagtgatttatttatttattgtgaaaaaaattgatttatatagcaatgacgtagcattatatgaagagaaattctacattttgctattggtaggcgatcgatcatatgaattgtcatcgacaaacatggaatatgttggtcgggaataagttcacttttactcccttagaagtgacacaaatctaatccatcaccaatttgactccctaggcggttttggaggacggttttgctgaagtgacgcctacgtggcggtattgaccgggtcttctttacacgtggtgttgacgttgcgcttaagtggcattagaattaaaaaatatgtgtgggacccattagtcattcacacaaaaagaaacgtgggcccactgacatgtggagcccacatgctagtcctccctgactcctacctttttcctcctccatctctccccttcgtcttccccttcggcctgtggtgcgtggtggcagaggaagcgacaaaggacagcaacaggcgggagcaggccgacaacggcaagggagttgggtggcaagcgggggaggagatggggggcgcagctcaccgcgaggagcaggacgatgtggtcgcagcgccggcagagtgatgtggtcgcggcggcggggttcccggcgagccgcgcagacgagggggagcagcgagccacgcagacgagggggagaaggcggtggcgcaacggcgtgagggcggaggcggagcacacgaccggcctgcacgccatggtggcggtggaggacgttgtcgaggagatcccccacctcaccctatccatggcagccaccgccaaatgccgccgccgtcttcactccccgccacgcccgcgtctcctccgctcgccgccggctccacttgcccaccgtcgtgcgccacagccgcctttccaccgtctcccaaccgccggatgccaccgccgtcactgccgctccagtggtgaagagaaaggctgggggagagaatgaaagaaggcagagagacagggagcaggaagaatggtaggataaagcatgacatgtgggatccacatgtcatcctttgtgtgaatgataaatgaattattatttttaattctaatgccacttaagcgccacgtcaacgccaagtgtaaagaagagccggtcaataccgccacgtaggcgccacatcagcaaaaaaactgccctccaaaaccgccaagggagtcaaattgcaccggtttcaatagttcgggggtcgagatatttagttttatgggttagagtcatggattagatttgggtcactttttaagggagtcaaagtgaacttattccatgttggttgcctacactaacccaagtgagcctagtgggtgcaagcactccaatagcccaacaatccgcctcctcctctctctacattacctttttctcgatcattcgatccccatggctccacgccttcacccaccatgcacgtgaagacatgagagcgagcgagtgagcacgtccttcctccgatgagctcactgcacctctcttcggtgagcccccttctaccctagtgagcttccactaacgaagaagaggagatgcaaacgagctacctctctcaggtgacgaagggctcacttcttttctccaccagcaccccccaccgtgtcgccgccgacctcgccgacgccaaagggcatcaccatgccaatgaggcccgcctagccgggctccttcccttcccattcgcctcactttgctccacaccaacaccagcccaccacccgctgccggcctctcagatgccttgccacccgtccttgtccaccacccaccgcctgtctattgcctcctaggccatccctctaaacccgatcctccactttcccctcccaagtgccaacctccccctcccaccctacccatgaaatcctaaccctaacccggcatttgtcgttatgctattggaaagcattcgcgagatgcccatgttgagagcgttcgcgcattaggctttccgcactaaccttgtgcaaagagtccatttttccttacaagtgaaatatcagccaatacttcacatatagacatgacctcatgccaataaggacaagtatctcactgccacgctagcagggcctagctttctcaaactttgttaggtcattcacagtgcggtatcatgtcgcgtggattcgttgcgccatgtaggacaagtgttgtggtggaagagagggaagatgggggaccatggttttgtgaggttgctcggatcctagtaaagaaccaagtccatcaactgaaaagcctgcaaaggaggaggaggaggaggaggaggagagagagagagaggaggtctagaccacccataccaagccccgggaggcggcggcgaaggaagctcgatgatggtggcgacggtagctcgatgatggcggcgatcaccacgcgccaccgagctcaccagatccagcatggggctcgccggatctggcctcgggaggtggcgacggcagtggctcgacgacggcaacgacaacgacagtgggacctccgtttacccacttccactacctcgttggatttggctaaagctcgataactgtggcgaggaagctcgacggtggcaacggttgaagatcaggaggggaccggctcattgggaccacctgacaatttctgacgaggttcgcgcatccaaatgaggcttcgcgttcttctttcaggcacgacccacgccaagctagctcagaatctccgagctggtgaggcgagtccaaacgccaagtcaccgcactgtgaatggccttactagcgccggtgttgctagcacactagtgccaattgcaatacaggggtgcgacgtacagggacaaaccacacaggacctgaaggaggaggaataaactaatttctgttagtagttttgtatgggatccacccttttgttctagggagttgattttacccaatctaatggaaagagaaccattttcacaccttaaattttgtttaggattcccataaacagatattgggggtaagatttagccattctcttaggctgcgttcgggaggaggggttagaaaccccttctccctggcacacaaaacaaagcacgcgttgttgcataattaattaaagtaccgtattagctatttttttaaaaaaagattaatttgatttttttaagcaactttcatatagaaacattttgtaaaaaaatacaccgtttagcagtttgaaaagcgtgcgcgcgaaaaacgagagagaggggttgggaacttggagataagaacacaaccttatagcaagtttaatagtatagccaactactaactccaattcatctatagccaatctaatagctcacttatacaatagttacatactacactattagagcacccgcaatggtaaagtaaggtgttatctataaaacatgtacacctcaacaatagactagattaatagtaaaccacttcaatggtatgtctacatgagtatctatagctctctaatccattgcctcgtttttctctatagactatctccatgttagtagatagctttgctctctctctgcatttaatctcttccaagtaggaaaatatgctgacatggatctcttgtagagagcttatagataaccattgtgggtgcccttaacacctggttacacctgtcatacacacagcgtcttggagtccgtgttacagctggctacaaatctgtagcccactactcttctctctccttatttatctccttaaaatatgtttataactgacttatagtctgctattgtacctgctcttagtgatgctctaaggctgtgtttgagggagaggggattgggaagatacgcaaaacgaggtgagccattagcgcatgattaattgagtattaactattttaaacttcaaaaatggattaatataattttttaaagcaacttttctatagaaaatttttgcaaaaaacacaccgtttagtagtttgggaagcgtgcgcacggaaaacgagatgcttttctctctcaatcccccaaatcgcccaggaacgaacgaagcctaagaacaatagtgtttcgttctcaccaaattccaaggttgtactccaaggatcttcaatacacaaagcacttgcatttcttttcatggaaaaaaaatagtactaccgttctattcctacgaacaattcaattctccccgaaaaggcattaccctaaatcaagagaatagaatcacacacgtatcctttttagcatttagtctcatttacaacataggatttgccttctatttttagagaagctatcaaatcatttcctacaaaatccaaagataaaaaaaagatgtgcaagtgcaaacacaaacatactatgcgatttttccacaccccgttcaccagttcactacgcacgcatgaacaaacggtcactgaacaaacggcatcgcggccacggcggcaggcaggtgggccccccacgttgtctgtctgcctcgccctcaacgttctttttgaactttttgaaatttgaacgaatgcacaccccgagatcccaaatcacactctcctagtcctcccccaatcagttcaaaaaaaaaaagaagattcaaatccagacgaagccccttccgctcacctccccggtaatcctctcacccttctgccctctcacccagacgaggtggggcccagcacgctcctccacgcgagggcgtttccccgccgtcgctgagcggatggacggctgggatggatcgacgattcaaacgtgcccgtttccctccactagatgtggcgataaacaaatggggatttgtttttttcttcttctttttttttgaataaagaaagggagcgcaccgttgaaggttgaacagaacactccatccacgcagccttttgctgttgctttgctctctttccatgcagtaagtacattgatgagtgatgacctctttcttggtcctccctaaattgcactgtgacaaaggagtcctccaccaccatctcaccctggggattcagatttcaaaattcaaaaacagaagcaggagtatcaactggccacaagggacaaaagtcaaatcttaatcttagtgctttgacagctgatgatttgagagtcaatgaacaggaatttggaataaccaaagcaaaaaaatgaaacattgtccatgtgaaactgtggccgcaaagttttctataggtgcaggattaggtaaatggtgtttatatggggtattttcattggcaatattgtgccattatggtgtaattaaatttttccatagtagcctttcacacagttaagaaaggtttaatcttacgttttgacccgtctattaattattaattataaatatatataaaacatgtctattaggacatattttaaactttccgaccgttggacgttattttaaacttctcaaccgttagttataaatatatggtattatatcatggtactccctcaaatattaaaaacatgtcgtttttgacacattttgaactttcagactgttgtacacattttaaactcctcgaccgttagttataaatatccggcatgtatggagtaacagagtaacgccttcaatctttaaaacacgtcgttttgcacaaagttccagaccttcctgtccgtttgtaataaatctccggtatgatactcatagcgctccatccactatcgaaaaacaaagttattttggacacactccaagctaaaaacatgaatatctaagcatcaatatcatgttaaatatccgttaccgtccacgaacaaaagaagtaacacattgcaatcaattcagctctacatccacaatatccataaaaaaacggtcggaaacataataacccacccacgaggtgaccgaataactaaaaaccgtttacggataaaataaccgcaacccaacccgatgattattagggcctgtttggtttccagggactttttccaagtccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatatgacatgggctaaaaagttttaaccccatctaaacacccccttagtagcaaggttgaagcacatgccactgcttgaaatttgaacaactgaactgcttaccagtacaaccctagaagaaaatgtgagtagaatggtaggcccaaaactgcaaagaatcgaaagtacaggggtgtattcttaaagtagcactcctcccccttttctttcatcccctaccctcccctctcctcccaatccccctggcctctgtcgggaagagcacccaaaccctcgcttccgccctcgcaaaccctagcgcccggaggaggaggaggtgggttgcggtggtagtttgccgtccgccgatgtcgagcaacctagcagcctcccgccgctcgtcgtcgtcgtcctcggtggcggcggcggcggcggcgaagcgacccgcggtgggggagggaggaggaggaggaggagggaaggcggcagcgggcgccgccgcggcaaagaagcgcgtggcgcttagcaacatcagcaacgtcgccgctggtggtggcgccccagggaaggccggcaatgcggtgcgtgatggatcgcttgtgggggggttggggagtttcttttttcttttctcgaaggctttgttctttgcgcggtttgggttcgagatctttcggtccgtgatgtggttggaatggtttttggcttggccttcttagtttcttttgcttttggtggttcctcctgggttcttgggacggatcgagttcgcttttctgcagttcttggattgggggatttcttgattcggaaattgccgaagcgatctgtatatgattttgcttctttttttttccatctttgtggtgggcatatgccttgatctgttggtttcaagcgaaaaatagtgtttcttgaatccgtcttcttgagttcttccagagtacaagattttcgtttcttcaatttctcgttgtttaacctacaaacggttcttctcttccaatccccaagattttattgccttttggttttctaattgctgttcccattcaaatttggacctctgccaaatttttccttgctgattttgaggattctcctctttcaatccacaagatttttccttgctgattttgaggcttcttttcatggttatttgattgattgatttcttggggagcatccatggtcaacaggcataaagtttattggcaccttcaaaagttcaaaaatcaagctttcttggtatttgtgaagtgttttgtacgtttgcttgctttggaatcttctattggtaatatgatacttgcgtgctgctaatgtttctaaatttttattccttttcatgcttgtggtctgtggaatcccaaatgaacagattgaaataaattataaattgatttctcttgtcccatcctcctgcagaagttgaatttagctgcctcagctgcaccagtgaagaagggatctttggccagtggccgcaatgtgggcacgaatcgggcctcggcggtgaaatcggcttccgccaagccggctccggccatatcccgccatgagagcgccacacagaaggagtctgttcttcctcctaaagtgcctagcattgtgccgactgctgcactggcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaaggtgtgttttggttgctgaaatgcacagttatagctagaaaaatttgtgctatatggtgcattctattggaatggttgattgatcttatcccttgtttgtttcgcagaaactaagtggaagaaggatgctccttccccaatggaaatcgaccaaatttgtgatgttgacaataactacgaggatccgcagttgtgtgctactcttgcttctgatatctacatgcacttgcgcgaggctgaggtaatacattcttgtctacaccttatttctctgaaaacatttcccttgagcaccttattgtagtatgttttcataggaaggctttgttttgcttcctcatgatttgagacttgattgcatccatatgaaacacaagtaaaaaaagtttactttgatgagaccataaattaagaagagaataagtgcacatcactgatataaggcagtattccaatgtaatttatcaggatatttttcacatttcaccacaatccgttcttttctgcttttcgctttgttggtgcaccttatcatctaataccagacatgctttgtgaccatcaattttcagtagttttgttctgcatattgtgtaaacaccttacataaaacattctagaatactttttttttctgaatagtgggttccatttaatggccatcatattgaaattccttatagaaccagtagaagcacagtataatatggagaaattttaatggagttatctgcttaaagcattgactgaaccgatgaattgatacatttcaattgttgtaatcaatgctcttgaagtatttttcaattgctcattgtttttgctgtgacatggactgcactactgcagtcagtttgaccaaatgacaattaatctgacctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgt

SEQ ID NO: 43036 - DNA, 12997 bp, Oryza sativa
tacataggcttttccttgtaaatttgaaacagaattccacccttgttcactacacccaatacaagttgtcaaagttaaacgactgtgtaaaggcattgccccccctttttagcgttggtccccggagtaaccttcctgcaatcagggagaagtataccccacataaggtataaacggcaaatcctccccattttttcagttatctggactgtttttaaagctgaccttttgtacctttgtttttgcagtacaaatttgtggcgaagaagccctgcccaccctcaataccgaccgaattctttcgcgacgcaacatgctgaactagaaaaataaaccaaggattagttacagttgctgactgaattcttcctccagaggcacctatgccaggttgtgccgtagaccgttcagataaccttgatgcaaggcatgctgcttgcccccccccccccccccccccctggttctttcaggcggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgcttttgtgaaattctcaataagagcaccacattttcaacagtgctcattctgaataagtgctactagtgttcttgatgtttctagtaaaaaaatatcagcttcagctttttttttttcaacctgttctgttcttctgttgacagatatatgcagctgatgtgatcgacttaaacatgatgattcagcgagattcttagataaaagcttctgacatcttttccaagaaagatgttttcatggacaaatgcatttaagattttgaaaatgaaaaatactacctccatcccaaaataagtgcagtcgtggaaaccagtgtccaatgcttgaccgtccgtcttatttgaaaaatttatgaattattttttaaaaatagtcacacataaagtactatttatgttttatcatctaataacaataaaaatagtaatcataaattttttttcaaataagacgaacaatcaaaaattaaagataaatagtgcaaaactgcacttattttgggacggagggagtatttgtcaatgcaacctgttgaagaagtgatgctcaagctatttccatacttgaagctaagcacagctgtttagacatgcatgcctgcgtgttgcaccatcatattgtacttagactaatcacctatactaatataaaaagcattacttgtagtctttgctagctacactaaaaaaagtgtacacaaattaacctcaggcaccctgcaatctaatggttgagattacaagttccagcttgtcttgcaatgcaacaggtgaactcacagattcaactccaccttggcccttgcaaacgtggcggtgtgccggtgtgctagcaactacacgtcccaaaatataaaaacctataatcagatgagacatttttttctagtactaagaattggccaatccagattctcgtctcgctggagtctcatcctcgtctcactggagtctggaatctatagcaacgttgtttacagtagagttaacagaaattatcaccgtctaattaacctgctactgctttacaaaacgggagacaatcagacaacgccgaggtgggttgaaaaggaagaaaatgcaagcacaggcaaatgccgatgataagatactagatgagcaaggctactccctggggaaaaggctttgcttgccatggattgcaacacaagattaaaaaaaattacaatacagaaagaatgactcgaagcatgagtctagcaaggttaaatcatcactgagctaggcctacaacatgtcgagttagaagtcctcttcatcgtccagatctggatcatttgatggccgtattctcttgccgtctctccctccagggcgacctcctttctttggttttcctctgtccaaacacacgaggggtcagaactaggcaattcaactaaaagggttgttcctagaaacactggtatttttaatataaagaagtgttagacaaacactgcccctggcaagaatgtatgtaaagttgagaacgatagcacattttttgccgcaaaagtaatctgagcacttactgcccgtttgcaggagtggttgcgcctttcgaacgacctgatccatattctcttccatctgccaggatgcagctggtattgagcccagagtctcaattgttcctggtttcagcttaatgaaaacaagaaagagaacttaccatctcgtccagccatatgttcatcgacctggaatgaataaaaaataatggtatgtattagcaacctcacaaatatcggtatagcacagggggaataacaatcatcgatcaaagcaaaccaacagattaaaaaaacgggcactggcttttcagtggcattaggatttaggatcattagtcataccgctggagatgtaaccgatgacagggagaacagcctctcatcagcctggaacttcctggagcgcttgagactgaaattaataagacagaaactgtcataactaattctatgtgacctattagcagaacaggcatgataaaacatttgcttgtgcagaataatgaacacggaagattatgccaatggttatcataaatccaaccctcccttggtgatgctagatagtgcatatagagcacccctgcaattggccacaactgatataacactatcatagcatattttgggttatgaatctgttgtataatacctgccactgccactagagtgatcagaggatcttttgttcatctgatcattagtaaataaattataagtgatcagaggattttttgttcaatatctataactataaattattcatctgaatattagctaaattatatgtgatcagaggctggtagaaagttcaagggcaggacagtaggtcattcaatcaacagtcagaagtaagcaaagaatgtggcatgaattctgaaggtttcgaactggtaagtatacagtgggatgtcaaaagaaaatgaatgaagacctccaaatagtaaagggcatagcagtctaagaaaaggtttcttacttggaagtgttctttgacgatgataagaatgattcaaaaccctttagcacacttccgaattgattagactcttgtaggtaggttgtctccatttcataaacctgcaacatatggacataaacatcatttgcaggttgtataagaacaattctgttaaaagcatgaatagatattttgttaaattatgagtgtttaatatcatatacaaaacttccccttaaagtcaagcaaagatggttgacattatagatcatgtgttgttcctggtattaaagagcgactgttttgttctttctaaaaaaaaacacatatctgtgccattaaaatacttgatatgagagcaatacccatttcctccctttttaggattatggtttctactaaaccaaatgctcctcttatttaatgattttggatgacacaccaagattcaccatcacaaacatagattggaagttggagcacatagtgtaactttgaaatactttgaatagaagtagctcatttgatacttgttgcaaataatttctgactaagacacagtagaaactccacatcttatcttgataataagaacagatggaatttacaggttgtagctaactgattttcatttttaccctagagcaacaaagtgttctcaggcacaaagaacaacatacaagaaatagaatggtcatattcgacaagaatatcaaattgatactttcttcccttcctcctaattctatccaaattgttcgtcacaattgatcctctctgtgaaatgacaatcagtggtcactggtccagcatattggttccaaataggttcatatttctatcattcccaaggcattaagaaagattgcacaataaattggggactgtgtgtaagacctaacctggcgctctatggagcggagctcctcctggagcttggcgcgcttgctcatcagggcggagagcatcgctgtggggttcgcggccgccgcccccgagggcgcagagcctgacgctgccttgtgcgatgcccctcctccgcctcccgagtccatggttagggtttctagggttcgagttcgtggtttgcctgtttgggcgttcgttctgttttggctcggacacagttcactgttgtggagacgactagcccctcctctccaataatccgatcggtcctcttagccaaggtaatcaatatcgagatactaggtaggatcctttctcttcttgatttgatccttctcgatcggtttgatcccttctaatggagaaagattcttgtttgctgcaagtcacacctaagctgtcaaatgcacatgtgaaaatgtttagcaatcaatgcatacatacgcatgagtataacacagaaaaggttaatagagtatttagcagaaatttgtgtttcaatttttttttctgttgatggataaatttcactccaaataacattattggaatacatttctgcctataatctaagatgcacatgttttatgagcgatttgatcatgaccacaaacatgagataatgtccataccctagttaggtgcccatgtgttgcaatgggaaaagaacatttggctatgtacaatatgaataccctaatactccttcccgtcaggattatttgatccaaagtactgaggtatcccgcgccaaataatgactcgaggggcaacaaatgaaacatgcataacagttcaggaccttgagctgttgagcatatagaagaaacaaatgatacaacctatgtcacttattatctacaacacgttgacctctgtaataacagaatgacattatcaccatagatggtgaaacttccttgaaaaacacacaaaaacgaaatccagaacaaatgtggatcccctggcagtgatatcacacaaaacacataaaaaggaatgaaacctctctccctggcacagcaatcagcacaatcctttctttttcttgatttgcaaaccctttgcaggcaattttaaacattacgaattctgagtgcataacaaaaataaaaactacattattccactgtatgtaaacaaattagtgaaatgaatgaaataacaggggcggatccaacttgggacatgggggttcagttgaaccccccaaacttttgggggaacaacaaacaaactcaaactgttacttgtattaaggttaaggctctggaattaaaagaagagcttcttccagatctacaagagaagctagggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagttggcaaaaagccgcataaccgttgactcaagattacgacatgtagcttttattaacttgatatcttcttcacacttttgcagttgtgctcaggaccgaagctagtgtgttgccctgaaaagaacctgcatataagatatagatggtgatttgtcaaaaaccatatcatttctattcaaccatagagcccaacatatagcggaagctcctaccaggataagtttactggttttttttttatcaatcccaacaagccaagcaaaattgtgtttataagggtatttttcattggcaatattgtgccattatagccgtgttaaaaattcgcataatttcctttggcacaactaagaaaggtttaaccttacgtcccgacccaagcattcgttgtagatatcctgaaacactaggttcggacctgttttacacttttcgaccgttggacacattttaaatttatcggccattagttataaatatatggtcttatatcatgttactccctcaaatattgaaaatatgttgatttggatacattttaaacttctcgacctttggacacattttgaacttctcgacctttagttataaatatctggtatgtacgagagcaatggttttaatttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaataactaattgtacagattacgaataatttgtgagacgaatcttttaaacctaattgctccatgatttgacaatgtggtgctacagtaaacatttgctaatgatggattaattaagtttaataaattagtctcgcggtttactgacggatactgcaattagttttattattagtgcccgaacaccccatgcgacaccctatataatacccgatataacacgcaataattttacactcttggatctaaacacccccaaagttattttggatactacattccaagttcaaatataaaactctaatggcaggtacaataatagactataagtcagctacaagcttatgtggtgaagataagagaggagatagaatagaagcgggctacagatttgtaaccagctgcagcacggactcctaaacgctacggtggtgtttgaatctcctgaagataaagataaagatgaagattaagtgtttcacgtaaaacgaggtggtaataacgtgtgactaattgagttttaattattacaaacttgaaaagtggattaatatgttattttagaacaactttcatatagaaagttttcgcacgaaacgcaccgtttagcagtttaaaaagcgtgccactttaatccaaaatttaattcacccctttcatgagtttctaacgggctctacgtgtgtatgacaagtgggaccagtaattaatgatgtagtgtatatctgtagttaactattgtataatttactattagattagctataaatgatttggagctagtagttagctatatactattaaaattcctctaagtagcaaaggccgtgttcgattattagtgttagaaactaaccctccagcacgtaaaacaaaacggttcattaatacataattaattaagtattagttatttcataaaaagtgagttaacatgatttttcaaataactttcatacatatatttttttttaaaaaaaaacacaccgtttaaccatttgacaaaagcacacatgtgaaaaacgagagagataagtaggaaaatacgatgaggaatatttcctccgtatcaaaatataagtatttttagacttcgacacggttctaaagatgcttatttgacaaacgatatttataaaagtaaaatattttaaataaaaagagttacatactgtgatagtttatttaatgataaatctagtaacatcaatttcttttatgattgatcttttttattttttttcttattaataattaaagttacaaatatttgacttgacactatgcttaaaaaatacttagggcccctttgaatcttagggtagaaaaaaacagaggaataggaaaaacacaggattctgacaggaattgaagggtaaaacagaggattgcaaaacacaggaaaaacacaggaatggtcgtttgattggagcgcaggagaaacgcaggaatcagacgagagagatagactcaaaggaatttttccaagagattggagctcttgctaaatttcctcaaaaatccatatgcaatgtgtgccatttcatagaaatttcataggatttggaaaacttcaatcctttgaatcaaagggccaaatataaaaatttcctataggatttgaatcctatgaaattcccacataaatcctttgatccaaaggtgctcttacattttaggaatataaggacggagggaatacaaagttaaaatccgtcatcttctacggcagaagtagtaacgcacgaaattaatttagctctacatccgttctgtttatgaataacggtcgaaaacgtaataacccaaccacgacgacatgaaaaaaagaaagacagacaaaacggtcgaataactaaaacaacttgctactactatttgaaatttgaacaactgtaacggcccaaaaactggaaataatcgaaagagtcgtcgccattttctttctcttctcctcctccgctcctctgagtcctctcctctccggctctcccctcctctgtcgggaagggaaggatccaagccctcgccctcctccgcctctgatccccgccggccgccgccgccctcgcaaccctcgcagcagcagcaggaggaggagggttcgggtggtggttgccgtccgtcgtccgatttcgagcagcctagcctcccgccgctcgtcgtcgtcgtcggcggcgatggcggcgaagcggcccgcggcgggggagggaggagggaaggcggcagcgggcgccgcggcggccaagaagcgcgtcgcgcttgtcaacatcaccaacgttgccgccgcggccaacaatgcggtacgtgaaggatcgcttgctgcttcttcttctttttttgtgctttttttttctctctccaagatttgttctttgctttgcgctgtttgggtggagatcttttggtatgtgaggtggttggaatggtttgggggtggcttttttttttttttttgcttcttggttgctcttggggcataagtgagttgctgttgcttgattcttggttcctcttggggcacaagtgagttgctgttgcttgatgcggaaatggctgaagcgatctgtgtatgatttttttttggtttttttccatcttgtttgtggaggacatacgcctcgatctgttggtttcaagcaaaaataaatagtgtttcttgaattcgtcttcttgagttctttctttcagccaacaacaagattttcatttcttcaatttctccttgtttagcctgcaagcgattctcctcttccaatccccaagatattcttgccttttggtttttcagtgctcttcacattcaaatttggacctctgccacattcttccttgctgattttgaggatactcctattccaatccacaagatttatcttgctgattttctggtttcttttcatggttaattgattgattgatttcttggggagcattcaggtcaacaggctaaattcacttgagggtttattggcaccttcaaaagttcaaaataaaagctttcttggtattcgtgaagtgtcttgtatgtttgcttgctttggaatcttctattggtaatatgatacttgcgtgctgctaatgtttctaaatttttattccttttcatgcttgtggtctggaatcccaaatgaacagattgaaatttaagttctaaattgatttattttcttcaatcctcctgcagaaatttaattcagctacctgggctgcacctgtgaagaagggatctttggccagtggccgcaatgtgtgcacgaatcgggtctcagcggtgaaatcggcttccgccaagccagctccggccatatcccgccatgagagcgccccacagaaggagtcagttattcctcctaaagtgcttagcattgttccgactgctgcacccgcacctgtcactgtaccctgcagcagcttcgtctcccctatgcattcaggagattcagtttcggttgacgagacgatgtcgatgtgtgactcaatgaaaagcccagactttgagtacattgataatggggattcctcctcagttctaggttccttgcagcgaagagcaaacgagaacctgcgtatctcagaggatagagatgttgaaggtgtgttttggttgctgaaatgcgcagttatggtgcattctgttagaatggttgattgatcttatcccttgtttctttcgcagaaactaagtggaataaggatgctccttccccaatggaaatcgaccaaatttgtgatgttgacaataactacgaggatccgcagttgtgtgctactcttgcttctgatatctacatgcacttgcgcgaggccgaggtaatacattcttgtctacaccttatttctctgaaaacatttcccttgagcactgtaaagaattgtttttcattgtagtatgttttcagacttgagacttgattgcatccatatgaaacacaagtaaaaaaagtttactttgatgagaccataaattaagaagagaataagtgcacattcctgttccagtggttataacggatataaggcattatttcaatgtaatttatgaggatatttttcacatttcaccacaatccgttcttttctgcatttcactatgttggtgcaccttatcatcaaataccagacatgctttgcgaccttcaattttccgtagtgttgatctgcatattatgtaaacaccttacataaaacattcttgaatacttttttttccctgaatagtgggttccatttaatgaccttcatattgaaattccttatagaaccagtagaagcacatcatatgttatgagcaccggtgagcgaacaaattaggtatgagtgggacacaggaggtcgaggattcggtagcctcttcgacgccctcccgtggtggccattcaggagaaacgggggatgagatagaaaagtggagagagaagtatagattgaatcttgcttgcctttaaccataaattcgtggttctaaatagccttacatccaaactaactctgttaataaaaagggataacactcgaactaatcgctagcaatttgcgtggtactgttcctcatccggcacgacatcagtcggtcgcttcctcactttctttgtcgtgtcgcttcctcgaatacgtgatgccgaccatgacatgtctcccctccttcgcaaacagctcgtcctcaagctggaacgtaggataggtgcgacaaaactcatcttcgtcttcccacgttgcatcgacagccggtttgccggcccattggatgagcacatggcatactccggcgcgtcaattgaccatgaacagccgtagctggaagcgggagcactctttcgttcgagagcgccgacaacgcaggcagctggtctagcggtgtgtccttgaacaccttgaggagttcaacgtggaatacatcatgtatcttggcaccggccggcaacttgaggcgacatgccacatcgcccacgcgagtgacgacttggtagggaccgtagtagcatggtgccaacttgttgcgacaaaagcatagtaggaaaaaccggaccggtgggtgacccggtcgacctttgggttcgccggtccaaccgtgaaccggacggtcaaaccgcgatttaatacatatatgtgtaacgtatgtaattgctaaatcacaactgcttggatggctcggtggtctacgccgcttgcttctatcctaaagaccagaggtcgaacccccacaggtgcatatttcctctgatttttgccaaccaaaacgctctttgcaggctaaatgggcctttgatttttgccaaccaaaacgctctttgcaggctaaatgggccttgagagtctgcccggtgatggtttaatggccggttcatagaaaaaccgtccgattcagccggttcaaagcgggtcacatgcatgtcctgacttttttttaaccgaaccagaaagacctctggtaacggtttttcctggttgaaccaccggcccggtctggttttttccactatggacagaagccgggaagggatgctgcttggtgatggagtagacgcacctagacccagtcacagacctagaaggtgacatcacaatgcttctcttcgtagtagagcttccaataatcctgtgcttggaggaggtgttcccggatttcctcaaggaattcgtcccgctcgacgagggcttgattgacagcgcgcacacgtgctgtgccgtgatcatacacacagacctggaatggcgtcgtgcgcagcgagctctggaacaccgtgttgaagcagtattctgcccacggaagccatcacagccagtgacgaggatggtctccggtcaggcacctgaggtacatgctaatgactcggttggctgccttggactggccgtcgcactgtggatgaaaagctgaactcaggttgagcttgatgtcggccaggtgtaatagttcggttcagaacgtgctggtgaacagggtcccgatcggcaatcgctgacaatggagcttgggatgcatggagcatagttattaggaccggactggaccgacggtccgaccgggaaaaaccggaactagggcctcggccggtctggtccccttaaaagatcggatgtgtaattgaaccggagaa

SEQ ID NO: 43037 - DNA, 10829 bp, Oryza sativa
gctgcacgcgctagccaccacaccatctgttcacttttgttggtctaagacatttgcatcctataatacatcgaatcgtggttggatcggcctaaccagtggttgaaccgctagaccagtgaaccgagagcttgaccggttcattctccggtccggttttaataactatggcgtggaggcggaccaccttgttgaagaacacacgcgccactatcgtcaccgtgtaggggtggccgagcagaatgaagtgggcgtacttggagaggcggtcaaccacagtgaagatggttgtcttgccgtgcacgcggggaagtcctttgatgaagtccatggcgatgtcctcccagacttgcgtgggcaccgacagtgactgaagcaggcccgccggatgaaggtgttcggtcttgttgcgttggtaggttgaacatgtgctcatgaattcttggacgacttgcttggcatggggcgtgaagaagtccgtgcacagcctgtgaagtgtgcgctcgacgccttcgtggccggtgtgggcgtggtcgagcagcgcgggcagtgtcggggaagacgtcggcacggacacggtcattgcgaaggataaggccgccacggaaagcccatggctagcccaaccaacccagcgtgccactggaaatgtcagcggcgatcttggctaggtcctcgttcgtggtcacctcacgcctagggatggcaacggggcggggccgagttgggctgaaacggcctcgcccccgacccctgactacatcccccgcccctggccccgactggagatgtgggccaaatcaggccccgtccccgacccctctagggccccgcaacccgactagggccccgcattaggtagtcgagaggccgcaggggagagggagagggcgaccgggacgacgagaccaaaggagtgcgtggtgccgattcgtgggacttgggaggctggaagagagaggaggggaggggagagggagcggacggcgaggggtgcatggtgccggtgcgcagtgcgccgcccctgctgccctgtgctccgctgcctccgcctatgtgatgtgggtgcgcgtacgggagaggagaggtcacccgcgggtgaaatatgtcccccgttccctcccctcccaaattgccatccctactcgctccggaggttgtcaaatgccatgaacgtcagctcggagattgccaaggcgatgagctcggcgtccttcgtgcggtgggtcagggcgtccgccacgacgttcgtgcgacccggtcgatattctatagtaaagtcaaaaccaatgagcttgcttaccaccaccgatgttgcgagattgtggaaaggcgttgatccaagagaaacttcaggctgtagtggtcggggcggacgaggaacgcccgttcccagaggtatgcgcgccaatggcggatggcttggacaaggctgatcaactcctgctcgtaggcggcgagcccggcatggcgtggtgctactgcccggctgaagaaggctagtgggcccgtcccttggtgtagaacgactctaatgttggaccccgacgcatcgtctttgacgacaaacgacatgatgaagtcgggtagttgcagcacgggacccatccacagggcatgcttgagctcggtgaaggcttgtgctgcgtctggcgtccaatggaattaggggtgaaaacggtaacggtaattaccggccgaccgacgttcattttcgactttctaccggccgagccatatggaaatggtaatcgaccgaaacaaaaatggaaatggcaaaaaatatggaaatgaaaacggaaatggttttgctgttataccgatcgtttccgtatttatcgtattctcgtggaaattaccgtttcttataatgtggtaattaccgtattctaaatatatcgatatttatagggcatgtctatacttatgtatacatataacatacttatgtaaagttaaatatatatttttatagtttaatatttccgtatttgttaccgacttccgatctgtaccgatatgtttccgtccgtattgttccgtttccggtttttcgatatttccgatatcgtttccgagaaaaatatggttacagaaatggttgaggctattttccgatcgtttccgactgttttcatccctaagtggaatgcttcgcgcttaaggatagccgtcaatggtgctgcgatcgcaccgtagttgcgaatgaacttacggtagtatccagccaggctgaggaagctgcggacggctcccacggagagggttgcgaccagtatgccattgcgcacaccttctgcacatccatggccaccctgtttgcgaacaccacatggccgaggtagttgatctgctgttcgccgaagtggcacttggagcgcttcaggatgagatgattggcgcgaacgacgctgagcactgcccgaatgtgctgaaggtgttggcccatgtcccgctgtagatcagtatgtcgttgaagaacaccaggacgaaccggcgtaagaatggggcgagtaccatgttcatcagcgcctggaatgtcgccggcgcgttcgtcaagccgaatggcatgaacaagaacttgaaatggccttggtgtgtgcggaatgccgtcttgttgacatcgtccgggtgcatgcgaacctgatggtacccgaaatggagatccagcttggagaagaagtgggcgtcgcaaagttcatcaagcaattcgtcgagaaccaaaatgggaaacatgtccttggcagtcaccgtgttgagggctcggtagtccacgtagaagcgccatggcttgtggaccaacagaaccgacgacgagaatggcgacgtgttggggcagatggagagcttgtcagcgcattatttctccaattcgtcgttttgaagctgtgggtagcgatacggtcgaaccactaccgggggcttgccgggcttgaggtggatgtgatgattgatggatcgggtcggtgggaggccggttggagcgcgaagaggtcgtcaaattccgccagcaaggacggaaggagatcgtcggcgtgcagtgcagcgcaggtggatgtgaatcggttgtcgaggataccatagagtgtgacccggcaaccgcaccagatcgccatgcgcatgttgacgaagtcccacaggattggtcccaatattcgtagccactgagtgcccaagatgatgtcgacgcagctgaggtcgagggcgaagcagtcgacgtcgaacacctcggtggccacctacaggcgaagcccgtgcacgacacccgcgccgcggatgcgatcgttgtcagccaccaccacgcggagaccttggcgtaccggttggagaggtaggccgatgcgctgggccagcttggtggtgatgaaattgtgtgttgaagccggagtcaacaagggccatcacctgctcggccgcgatacgcgccacgaggcacatcgtgctagtgccattgacaccgaaaatcgcgttgagcgagatgtgtggttcatcggtgtcgtctgtgtcgtcccattcgctgaaattagccgtggtgtcgtcgtactcaaggtagatcaggcgagtgcacttgtgacctaatgaacttctcgtcacatttataacagaggccttgtttacagcgctctggtaactctgctggcgagagacaacgaaattggtgtcctggtgtgtcagccgccgtggttggtgatgaggttgcgccagtcatcggagttgacgccggggcaggagcgcgcgacgcgttttgctggcccttccgttcgtaggcacgagccaaggccatggcctcctggaaatcctcgggctgttggagctcgacatcgatgcagatgtcgtcggtgagccccgctgtgaagagctgaacttgttggcggtcggtgaggaggtcggacgtgcggctacccaacgccaaaaggcgctgctggtacgtcgtcaccgtgccaacctgagtgagatgcttgagttcacccagggaattgttgcggatcggcggtccatactgaccgtaacagagctgcttgaacgtatcccaatccggaggacccatgtgctgctcataatggaagtaccattcctgtgcagctcaagtgagatggtatgtggccatccagacacgatccgtgtccggcgtatgttgccttcaaaagaactgctcacaatgattaatccaattgagcggatcatcggtgcgatcaaacttgggaaactccaatttgtgaaaaggaggaacggcgccaccggaattggtgtcgtgcaccgagccggttccagtcgacggcggaggtggtggtggtggcggcaggcaagatgccgctgccgcccaggcgaggcgcggacaaggtggtggaggactgctcgagggccgtgatgtgcgaagtggccacgcgacggaacgactgaggtcggcgaggtcgcttttggaagccaatagcgaaatgctgctcaacacatccgccatggactcctagagcttggccagtgcatcagcactaggggatggctgcttggaggaagaagtttcctcaagaaccatggtctatgataccaagttgttacgagcaccagcaagcgaacgaagtgggtatgaatgggacacaggaggtcgaggcttcggtagcctcttcgacgccctgccagtggtggcaatttaggagaaacaggggatgagatagagaagtggagatgagaagtatagattcaatcttgcttgcctttaactatagattcgtggctctaaatagccttacatccaaactgactttttaacaaactcgaactaattgctagcaatttgcgtggtactgttcctcatccggcacgacatcagctggtcgcttcctcgcttgctttgcctcgtcctttgccgcgtcgcttcctcaaataggtgatcctgaccttgacagtataatatggagaaattgtaatggagtaatccacttaaagcattgactgaaccgacgaattgatacatgacttcaattgtcacaattaatgctcttgaagtattttcagttactcattattttttctgtgacatggactgcactactgcagtcagtttgaccaaatgataattaatctggcctgagcacagtggtttcaaatctaggttgaatttcatatttacattgtgattttctatttgacttgaagcagaccaggaaacgtccatcaactgattttatggaaacaatccaaaaggatgtaaacccaagcatgagagcgatcctgatagactggcttgtggaagtaagcttttataccaaacatttttttagttgattggagcctaaagaccacactcgttacttaccactgtatttgtgcttttcctttgtgcaggtcgctgaagaatatcgtcttgttcctgatacattatacctgacagttaactacattgatcgttatctttctggcaatgagatcaatcgtcaaagactgcaattacttggagttgcttgtatgcttattgctgcgtaagatctgactagcaatttttttaaatgtgtttctcagtttgcatctgagttttgtgtactgattttggcttgttcctatatcagaaaatacgaggagatatgtgcacctcatgtagaagaattctgctatataactgacaacacatacttcagagatgaggtttgttttgcatatctgttaacattgctgtgtttatgtccatgactaacacatagattatcaggttttggaaatggaagcttctgtcctgaattacctgaagtttgaagtgactgcacctacagcaaaatgctttttgaggttctattccctttcatctcatcgatgtctatagtgctggaatgaatcgaactctaataactctcttattgcctacaacaggagatttgtccgtgttgcacaagtatcggatgaggtgctgctctcttaatcatctcctgcttgctgcaattccataatagttatatggtgcattgcattaacagcttttcatcgtgcaggatccagcattgcatcttgagttcctagccaattatgttgctgagctatcactgctggagtacaatctactttcttaccctccttcactagtagcggcatcggctattttcttggccaaattcatactgcagccaacaaagcacccttgggtaagtggtggcatcatcgtattgaactttccatacatcttttatatcagcattcaaataaaaaaattacaagagctaacatatgcttctcattgtaaatttgaagcagaattccacccttgctcactacacacaatacaagtcgtcagagttaagcgactgtgtaaaggcattgcaccgcctttttagcgttggtcccgggagtaaccttcctgcaatcagggagaagtatacccaacataaggtataaacggcatatcctccccatttcttcagttatctgtactgttgctaatgctgatctcctatacctttgttacctttgtttctgcagtacaaatttgtggcgaagaagccctgcccaccctcagttccatccgaattctttcgcgatgcaacatgctgaattagaaaaaaaaacaggattagttacagttgctgactgaattcttcctccagaggcatgctgattgcccccctgttctttcaggtggtttggccgagtgtagattctaagatcgatgctgcagctgtgtgtggtaacttttatggtactgatgttctttcttctttctcctcctgttcttttacctgtacctagtagatctatggttttcagtacattgtacatcttgtttgtaatggcatgattcttggaaatattagctgccaatctgacctgggcgtctcccaggttgatgtatgagggagtctctgttcgtgttgctcttgtgaaattcccaataagagcaccacattttttaatagtgctcattctgaataagttattgatcatgtccttgctatcaagtgctagcgttcttgatgtttttagtcaaaaggaatatttggacgaattgcttctcatcttctacacatatcggctttactttttcttttttcaacttgttctgttcttctgttgacagatactgcatgcagctgatgtgatcgacttgaacatggtgattcagcgagaagcttagtagatcattgtatctggacatatctttgccaagaaaaaaatatgtttttataggcaaatgcatttaagaatgtgaaaatattatgtcaatgtccctgtcaatgcaaccttcttgaagaagtcatgctcaagctatttccatactggaagctaagcacagctgtttagacgtgcatacctacgtgtagcacaatcatattgtacttagaactaattaatcatagggaaaaaaaatgtaatctacagagatcgtgccaactgtgcctttagcaaagcacggttagcaacgacaggtatatatcgcctctcttccagttgttattatggcagctaactaattggcctggagggttcgagaagattgcgttgcatgttcaccacagcaatattttgaacttgcatgattgatttgaattaatttgagccttgatgggttcataagcatgattggttcatgtatttattagttcctgtatttttcatgatctgtggttaagggtcattgtgtatatatgcgtgtacttcactgcttacctaagagaatatttgcatgtattttgtatattcgttggaaaacaatagctagcctactaaacttttgtgttttagcagaagtagttggacatagatgctcagggggtgtcactgtttataagaattttattagtgtaaaagcaactaacactattctttatgttgtgaaatatttgtaagaaattgtgattgcatgattcctagatcactgtgatcacttcatacgtacaaaggaaatatgattacaaatgtatcttcaatcattgtaagatggtgctcctaaatcgggtggcttgaataattaatatcaagtgttccagaataaatagttgtacaattaggaatacatgtacaatgcattttttttgtgggggcagatgattacatatgattgatattctattgccaagaattttagggtgtgaataagtgttttcttggcaaatgccatttgcatgtcccattgccatggcaaatgcgctggcacaaagaggaaggaccttaatatttctcctcacgaaaaatccctgcaatttctcttttaattatgaggaaattgcaatttctgtcctcaagaaagcaacaaaaaaacttactatttggatggatggttggttatcctgaataataacctgatttgattgtagtgacacaaacagcatttgcaaggaaagttttattcagttggtattaaacaaactaaatcttagctcatcagttgagtgttcagttatcacaagtaacttgacctggaaaatttgattcctggggctccctggttatctttttcaggaagccatttctgacctaattaatttgtgtgcaggaaacagagtagaagtacaccaccattgttgcttgtgtgctgcacacactcaagcatagcttgctgactagaactaaaaaatgcttaaaaaaataattttcgagctaagaattggtgtgttgattgaggtatatgcatcagttagctggtctcgttacctggctcataaacaggtgacagcaaatgagggctgtcatgtgacaagtggatacgaattttaaaattatttaggacaatagagaatggcctacgtttttgttttgttttctttcatttcttttcatggtagttatcagtattattagactaactcggcagtttgtcattcaaaatacaacaaacattggttttaaaaattttgagtcttgtgaattctgtataaaacattttattcgtgcttataaaattcataaaagaaattcttacatccccaaaagatcactctagacacgcatgcttcttctacttcttcttcttcttcttattgacgagtgtggaagttctcaccatttaccataatttgcgagaatcacttaagaaatactttgctataatttgcaacacattgctatagtttgcaagaatcacttaggagtacaagagaacacaacaagacttctcccttaatgtagacatacatggcgtacattcgatgtggcaatgcatacggtcacttgggaaggagaggagctgtcatgctggtagatgtaccattcatgccagcacattggagtacaacaccctatttgtgtattctccctcctctcctctcctctccttaaaactctagcaataaaaatcttggagaagatcacaagagtattctactatagcaaataataatataatgatgcaagttaactaaacaataataccagcatggctgctggattttgtccaacctgagaccattaggtggcactatggcaggttagctggggcattgttccattaaacttctgattaatccaatttctttttgtgattgcgagtactctcttggcttcttggccaggatgaggcgctgtgattggcttgggtgtggttgcttcttcgaggtgctcacgctacttctctctcggaaggtgtgggccccaccgtcgagcaggtgtggggccacacgcaggaatgccagtgtcatggacagtgttaggattatctatctggctgtccctgatcttctgtgggggcaagggtgtgtgttaatgtgtaggtagttatagccgatgacaaaggtgaaattttaaatggcgtgttaacatattgtactcgtgatgtgatcgcacgtattttttctcgatctatataaagaaatctagaacaattcggatagtgatatattagttaatgctatttagcaaaaaaaatcaattgatatttagttgaattaatttgctatatagacaagtgggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatccagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatg

SEQ ID NO: 43038 - DNA, 709 bp, Oryza sativa
ggctcggctcgggatccaatcccaccggtgtagaaaaggcaaaggcaccctcgttctcctttcacacctctccccccctcttcttctctctcccacatcacaagtcgcctccctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagatccgggcgtcgccgtcgccgggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgttgatgatgtggctgctcgctgttgcggaaacagtggaatggatgggggtttgggatggttggggtttgacgagctgggcgggttgaggcggtaggagggtttgcttagggtggaatctgattgaccgcgatcggcacgggtgttttggctgtatcctatagcgtgaaaaagataggaaaactactggttgtatcactttttgctggg

SEQ ID NO: 43039 - DNA, 3101 bp, Oryza sativa
  unsure (1)..(3101): unsure at all n locations
tgcgacgaagcggcttggcaagcgcggccgatgggttgaaatctaaaccaaggagacaaggatagacgtctcaccgatccaaaatgatcggagagggagggatgatgacaacgttccgatagcaacacatggagacgacaacgacgctagggccaaaccagattagattaaattggatcaagacccgatggataaactacaccatgaacgacatcggagagaggaaagctcactgagggacggcgtgacgatggatgatgacggcagacggccggcagcgaggtagaggcggcgacggggtcgggtcagcgatggcggcgacgtttcagcgatcttcggtgaagaaaaaccggtggccgggcttcaccttgctcctgcgaacccaaggattcgacggcgaccgagggcgacgacggacgacaacgaacggcgcgactgaagatggaacagatcggcttcacggggacgacggtgctccgatggcttgcgtcttcgcggaggtggctgccagcttctcctcactgctgcgatgccgacagtggatacggcgaggtccggcgaccacggagtcgacggcaaagcttggttggagatcaaaacatggcaacggttcggccttcacggtgacggcgacttccggcggggttcagcgcaaaagaacgggtggccggggtagagctcgacttggcggggccgagggaagtggcggcgctgaccggcgacggccggggcgacggcgcacggcagctggagcggctgccggaggtggagagagagggagctcgcggggagagcgtttccggcgatggcggcggacgggacttgaggggatgggtagaggacgactagggggtcctttatatagccatgggaggccgggatcgagcccacatcgacgggaaaaactcgggaaagtttatatttgccggaaaaaggaaaggatcttcgccgcctcaacaaacataacaataggggacggaaacacggtgcgattttgggagtccgcatggattggtgggcaaagacccaaagacctcatgccgcttgtctttgcgatctcaaaaaacagaggaaaatcccttcggcaaggaaaggaggaggacgcctaggtgcaagattttaagcttgattcacaatcatctatcgcagtcgacctcgtcgaacagctagtcgcactgtgggaagcggtccgaaatgtgcacttagatgttggagaaccggatcagattacttggaagttcacaaacaacgggcactacacggcctcctcggcttaccatgcgcagtgctgcggggcgccgagtacaaacttcaattccttgatttggaaaccctgggcgccggggaaatgcaaatttcatgcttggctcatcatcagaacagagtctggactttagaccggcttgcgaccaggggatggcagaacaatggttgttgccctctttgccgccgcgagactgagacggcattgcaccacgttgccacttgtagatacaccaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcgatttttgatcacaaagaggtggcaacgaacttcctactaatgaaaatcaaagaggaggcgagcctttgggctttagcaggagctaagcggttgcgtgagttaatcccacactctgtatagtgtacagctatagtggttctccgtttttcttttcccctaagggtttgtatttctcctgctctattcgatgaaaaggcactctagtgctgttttccgttcanaaaaaaaaagaaaaaggaaaggatttgatccgcgaaatggaaaagaattccatatanacttttggggatttctttgggaaaaagaaaaggagattgagaggattcccattcccgcactaatttggaaaaaggagcaacggggaggccggattggtgggaggaggcggcggcactgtgcacgagcacggctggctcggctctgtctggaggaggaagatggagtactgtagcgatagggaggtaaatcagactttggctgggctgagaggaagggagagaatgggctgaattcggcccaagctgaggaggaggatttttattacttttccaataaattaaccaatgagatgatctttcaattgttaaaaatactttcaatgctcaaataattccaagaaaaatcttgaacatacttggacactcaaagtatttaacaatattaaaaccagaccatttaatgattaatttgttaattaaataattgctaaactattctttgtattattaaaattaaaattgagctctgagaaattcgagaaaattccaaagagtataattaatcatggagaatttaatacaaattaaatccatccatgctttatatttaggaaattttatttcccacatttaacttcacttgtaaattaatgaacatttaatatatattctattaataatttattaaataatttttaaatcctgaaacaaaaattcaggctgtgacagtgtaggctttggtggcaaggaaggagaacgtatggattgtggattccggttgttcgcggcacatgaccggtgataaagattggttctcctccctcaaaaaggcatccaagactgaatcaattgtctttgctgatgcttctactagtgccgttgtcgctacaggtttggttatggtaaatgaaaattttgaattgaagaatgtagctttggttaaggatttaaagtacaatttgctttcggtttcacaattgttgatgaagagtttgaagttcactttaagaaaactagaagtaaaatttttgattcttgtggtgattctgtgctgaatatttctcgttatggaagagtgtttaaagctgattttgaaaattctgtttcacctgtgataacttgtttggttgctaagtttgataaagatgtgatgttttggcatcgtagacttggacatgttggttttgatcatctcac

SEQ ID NO: 43040 - DNA, 705 bp, Oryza sativa
ttcctgcagccctgctgctagttgttgttcacagattctttggcttttatctactttgaaagattatggtcttacttttgaaaaagtacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatctctttgcttttcttcgtggtgaattgggcataattcatccttttggcatggtttgagggggagtttgcacctcatggttttatcaagcaataatatgacaatgaaaaaaattgagaaaagagagctttgtttatgtatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatgctttattgacttgttattcctcaaatacctttaattgctcattgtgaaaaagagaataaaaaatataaaaaaatgaataccgaa

SEQ ID NO: 43041 - DNA, 1735 bp, Oryza sativa
aaccggtgagcaatagatcgatcacttgcgcatgtttttctaaccttcttcctagccgatggccctaactcgccaacgccgtccgtgcgaaaccaccgccgccgtacgttgagccgttcccggagtagacttcactgtccaagcttcgtcaatccccggttaaccatcggtgagtctcattgtgcacatcagcaacccatgcattgatgcatgcactgatttggctcgattaatttgagccggagatcgattaatccacggtatgtaccgacgtaccgtacgccgtcggctagggcaaaacacggccactagggctgaggtgaaaattttataaacaatattactattggatgaagaaatgatcaaaataaaagttacagatattttgttgttgatgactttttcacttgaaatcatttagtatttgaaaatgttgtttgaagttgtcataatttgaaattcaaattgaaattattgaaacagagtcatatagcaaaatgaccaaaacaaaagttgtagatcttgatattcataattttgaagtatttaatattatatttgtaaatcgcgacgaaattgatataacgtcacagtttttgggccggtttacgatgaaatcgataaactgtcacggtattatgggccttgtatcaatagttgcatatccatgacgatttctgaaaatatcacggaaattttgtgacagattaaatatattcttgtagtataagccgccacgtggcattcctataaacactcctaagtcgccacataggcactatataatctcaccgttgattttcattaaaatttgttgatctattattttacaccattagattgcatctattattgaaagtaataacttcattctgtttagatacaaacgctactatgtactaccgttctccagtacttacgacgtacgagtagtacatgcgattttaacgggaaaaaaccatacgtacgaacatagatagaaaagacaaccaataaacatagatatataaaaatggacggttttttctacaatataaatatgaaatatattacttcagaaatataatataaatatatatagttaaactaatatctataataaaatataaaatacccaataaatattctttaaaccatcttctaaattattttgaaattatatatatccaatttgcgatcatgttgtatttctttaattaaattataaaagttatattatggtcctaaatacaccacggcacatgaggccaacatatgtatgataacttttcaaaaaaatcacaacatattttagggagggcaatatcacttcacaatttaaatcaacatatgtaaaaattctattatatactaaaagtccattaaacctcctatggatgctcttaagtcgctacgtggcactcacttctaagccaccacatgggcactatataatctcaccgtgattttcacttaaattggtggactcattattttacactattagattggatctattattagaaaataataacttcaacacttgtgtttttcaagtagttctgattaaattataatttgtttgagattaagattctcaaaatgtttttatatttttagaactatttcactatacatatttgccaaaatataaataataaaatgatgatatggatattatcgtggtggtatgtctcatgagctataattttttaaaatatcatcgaacgattaccctcggtcattttcaaaagag

SEQ ID NO: 43042 - DNA, 798 bp, Oryza sativa
ttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcggcccaattccccccccttctctccctctcgggctggccttctcccacggcccgctcggctctctctctccctcaagtctgctttacctccctcgcccgttttccccactctctctccccgacaggtgggacccgaggccccacctgtcagctcctcctcctacctctggctggccggctgcaaccgccagggccgcccgagccaccccacgacgccgccgtttccgacctcctccaccccgcgcgcgagcccgccggtcgtgggaccccgtcgccccacgtcctccacccttttccccactctccccacgaaaatcgccgccggttaacctctccaccacccccaagatgccccgcctatctcgtcggccggttgccacctctctcgagcacgatcccatcgctccaagcccataaaaagcatccccggcctcccctttccatttcccccaattttcccgagcttctcgcgccctgtactgctctcccctcgctgctcccatcgccgccgctcaccggcgactctccatccgctcgccaccgctgctacagccgtcgccgtactgttccgccgccacctgcggcttcgccgtgccttgccgcacctcggccccgctccgttttccccattccatcgttggaaccc

SEQ ID NO: 43043 - DNA, 706 bp, Oryza sativa
cttgtgggggtcgtccgaagggcccagagaaccgatagcaattcttctggccatttgcctttctttagtgcttctaggatcttgccatttgtacgttcggccgccccatttgactgcgggtgggcgaccgacacgaacctgatttccaggttaagccctttgaacatttctctgaacttatcagagtcaaactgcttgccgttgtcactaatgaactcttttggcactccgaaacggcaaacgatgtttttccatacaaacttctgtactgctgccgaagtgattgccccaaggggtcggcttcgatccatcgagagaaatattccacagctacaattgcgaatttatacccgtttcgtgccaccgggaacggcccgatgatgtccagtccccatctggcgaagggccatattggcgcaatgggctgcagatcatactggggcgtggcttggcttcggccatggcgctggcaactttcgcattcttgatttactcaacacagactttcaacacagtgggccaatagactccttgtctaaatactttggaggccacttttcttgcagcctggtgcgcgccacatagcccctggtgtatctcctttgccatttctttgccttcggcaaaagagatgcaacgaagtaagggttgaagtaccccggagcggtaaagttgacccgagaccatcttatacttcgtggctctg

SEQ ID NO: 43044 - DNA, 1232 bp, Oryza sativa
ggagaagcaggtggctgatagtaaggacttgacagagggcagtgcaaagggtaatatggttggctgtctcccatggttggcacaggggaataaaaactgtacatcacctgaacatttgcatatcaaggagattacattagtaactgacccttcttgtaaaatcatggtagcagaacaagatggtgaaagcattaagaaagaggggaggtgtataataaccatgtacttacaggagatgcagcatcagttccatctgcactggcaacatgcggatattcttcccattgacccagatggttcaagtatcctgtcgaaagaacattcttcattcaaatcaagcagttgtaattcatgaacagggtaatgtgctatcatctcaaaacaatagagcaaacatgttctacagaatcaacaatggggaaccaaatgactacagtttcctgactatagtgccaagacagaaattagtcaatcaatttcctcaaaatgtgtgaagtaaatgtgcaacgtagagcagcacattagcaaatgccccctcagatagaacctgtgcagctaattaaaatctaaatctatttcagtctagaaacaaatgctacagtttttagtatcttcaatgcatgacaatgtgttggtgggtgtaagcatcaagacagagaaacaaaaaaaatgtgctctaacctccagaaaagactgtatgtggctgaggggtatacacattgggctggtagatgaaatgttgttctccacctttacccaaaaagcttcccttctcttgagcacttttggttgattttaaggaacttgcgccgtgcaaagcagtactagataaattatgatcttcactagagagaatctgacataacaccaatcaactgttagtagtaccgaaacatttgcgaagaaaaaaaaaagctacaaggattatgactgtaataacctgctttttcacactcacacttgtagaaggacttttctcaaccacaaggcgtgactctagaggctccatgtgatctattcaagagggacatccatgtataagtctcagcacagtaaattaagccttttatgacaaaatagtaaactaagttgcatccgggcaaattagaaatggaagttaacaaaagggaactattgcgtataggcgcataaactaagtaaccaactttcatgtacaatcgtacagacgaaatgatgaataatgctgctaacatgttaaaacaaacaaagaa

SEQ ID NO: 43045 - DNA, 30351 bp, Oryza sativa
tgaagaaatcactatcagcaaaatcgattttggggataaatggcatctaaaattgctattctccaatcaaccctaacaaaaaaataaagaaaaaacgaaaagaaataagagagagaagagaaggtcgagattttacagcatcagaacagcagcgtcgtacaaaatctcagtcctgggctaattttaattttgaccagaaaaccatgaaaattcgcaaatttaccacgatccccacacgaacaaacaccgccaagatcgcgaccttcacagataaactcccacccaactcctcaaattcaacacagaagatatgcaaagtgaagcaaaaaaaaaaaagaactccaaaatcaacaagcaacccaaataaaaggggaaaaaaagcaacgaaccagctgaatcttgcgcctgctgagctgccgccatctccaagatcaacaactggcaagcaaataggcgcggagaatgagaatcttgcggcgaaatctcccggcgagggtttaagagcttaaactgaaactggggaaccaaaagaggaaaactcgggcaaatttattgggaaaaaaatcgagcgaattgtgagcaactttacccccgctatatatgctccataaaatttgcaatacgccccttcacgtttcacgtattacctaaacacacaccccaaactcccttgtccctctcaactacggctattggcacgaacacaattgcgatttgggaacgagggcaccgtgtttatcattagcttaaacaaggatcaaatcaaatccagttctatactagtatatcgtgttgttcgctttgatgaaaaaaaccttaacaaaatttagcaaatatttggcaactataccaaaaacatgatttcttatatagttactaaaatttggcagtatactaaatatagccacttttttttataactgtatcaaaatttggtaagattgaaaatgccatcaaagtaaacagaccattagttatgctactgctgcatcttgtgcttgtccttgtcatctcacctcttcacccaatgtcccttaaagagaggttttagattgcacaaaagtaccacaagtacaaccaccattcgcgttcgttttgtaactaaaaaatatatttttgagtcccatttgtctctggcctttcttttcttccacttagggtacccaatgtggctactcaactcaaaagtcttttcttttccacctctaggataattaagtatcgcgttctaaatagttgaatgtggtatagattattcatgcgacgctttcaaaattatatgtttctcttaagtatttctatgtcagcattgctttaaacaagtttttctaagctatttataggccctataattgtgtagtaattaacataatcatgtaaccaatatttttggatctatattctatccaaccatgcagttagagccaccaagctgattaaagtttttattcttttcttaattattattaatcgaactcaaacgacaatgtcatcaacttgctcacttgccctttgaccgtccctttcttcctcctgttgttaaccatcttgtcactactcacgctgatgccgaccttattcttgggaggaaagtttggagtagcaaaaaaataataataataaaactgttaatctggagtccgagtgtgaaagccgtgagtaatccgcgtctccatcgtcctctcatgctgtaatcaaggtcaagaccaagcaagcaagcaagctctttgattcgaggctaaggtaaaagcagaagaaaaaccgtgacgacttgacttgtgtgtgatttattccttgtcggaagcaaccctgtggattttttttaactttttaaacattcttaatcttaattttaattttaaaaaataaacattctggtcacgtcaactatcctggtgcaggtgacgtgctgtttaaattttgaaaataagtttagaaataatttatttttaaaataaaagttaaatgattcaaaaaattttaaaaaaatcaaccatgtgcggtgcgtccgcggcggggattgctccgtgctaaagaaacaaaagcgttgcctttccgggtcctgtgactgtgagtgtgaaagagatggccgtgagaaacatgcgaacttacacgtagggacaccatcaaaccagccaatctcgccaatcaaaccagccaatctcgccaacgagtttcatcagagaccgcgtaaacttcgttgcaagcccatgggagggatcaccatgatatttgcatctgaacaggccgtgtttagtttcttccatattcctaactttccatcacatcatattacatcaaaaactttcctacacacataaactttcaactttttttctaaactcctaactttctttaaacttccaacttttttcagaaattaacactaactttcaacttttttccaaactctcaactttcttcaaacttctaacttttttcagaaactaacaccctgaactggtgaagttagtgcaaaactctcaactttcttcaaacttccaattttttttaagtaactataaccctaaactggtgaagttagtgcgacaccaatggcaggcaggcgggcaggtagccaccatctgaagcaatcaggatgcagcagggatggatggatcattttcaagacgggtagtagacgaagatgtattgaaccacttgtcgcatcgaacttctgcagtttacagtgttacagttttacttgctgaaaccacagaataacaacagagtttgcgactgtatacttgagctcttgttatgcatgtatatatagcaacagctgcttcagaaaatcagaagttttgcattacagtgaattggaaagaaggaagattattctagcatcacatgatcaactgatatatatcctgttggaacttggaatagacaggtatatatgttgccctgctatacagacaaattgaggtcaggtggaccctgacacctgcgacatccaaccatggcatatccaaagagtccccattcgagacaaggcctgtacaaaggaaaagcattaaccaaagcaaataatggctcaagattctggtcaaatgaaagatacgattcttgacagcgacacataattaaattttctaatgatttccaagcagtacagtgctatacagaaatatccgagccaaatatctaaatgtaattatattaagtgatctaccgataaccttttctttagttattattttccagggtcttaacctaggcctctgggtgatttcttttctcgaaacaaaatgatccgtgcagtgagattacaaagcatgcttaacacagtagggaataaagtatgacatagcaagtgcatagctggagagcgaccctcactgagaaattttctcaaaagagacaaaatccctggtggaaaatttctctaatgccgtttcatttctcggagaatgtttagtacagtaggtgatagcttgggaaggaaaccatatatctgaaaaacaactaaacaaaataaggatatcgaagtgcactctcttcttgttatttgaattacatgctgtgtttgtttggtttctattctgaatgaaggcaggcctcattttagctgggacggcccaaggcaggccgcccaaattgtattaagatttgaaggaagggtttgaaaacatttacaaatcgacattaaacagtcgagagaaaccgaaaagaaaggaaaacaaaacaatccgccaccagcgggctctttagccgacttctctcaaaatgttggtctccctccacactgcaacttcattcttaatatcactgaagagctccgctgccgttctcgccttttgttcaaagatcctgaggtttcgttctcaccacacgaaccagcagatgaggatacaaagggagtcaaaagcgcccctgtagcccgtctgaaaacagagtctggttttaatccaccagtccgcgaactcccagtcgtcatcgccaggcagggggaaaggagttcctagccacgttctcagcagaccccagatcctattcgtgaaagggcaacccagcaacaaatgatcacagctctcctgatcgccattgcaaaggacacaaccatcttcatgcggccatcctcttttctgcaaattgtctgctgtcaagcacctgcccttggtgattagccacatgaagaacttaagtctagacgggcccctagcttgccagatcaattccgcacattgagatcgcacccgtgccgcgaagaacatctcatacacagaggctgtgcagaaaactccgttaggagtgagcttccaactgatagagtcttgggcatcctcttgcagctgtacctcctgaatctcatcccacaaacgaaaatattccgataaggccagcgcagagagactccctcgaatgtcgcgcacccagcgattctgcgagagcgcctccgccacagtcagcttcgttctgcccaggtgtgtgaagagcaaaggtgaggagacagagatgcagcccctcggcaaccagttcgccctccaaaagtccgtatctttaccgtcccctacctgaaacgacgccactgattggaacagaccggtgatgtcgtttgtcggtactgagtttatcagagtccacggccttcctctttgctccaatcgtctagcgagccatttcattcgcatcgcttggccaaataattccagatttttaactcccaatcccccgcactccttcgggctgcagacgatatcccaagccactaggcagtggccgccattaacctcctcttgccctttccacaggaacgctcagcatttcttgttaaactctttgattgcccattttggcagcacaagcacaaacatgaaatgaactggcagcgcggtcagcaccgatttgatcaggcgcagacggccgtcgggagagagcagtttgggcttccagccggccacttttttggacagctgatccaaaatcggttgcacttccgccttcgtcggtcttctcagggagagtggaagaccgaggtaagtgatcgggaaattctcaaccctacacccaagcagctgttgaactccgaccaacacatcatcatcacacctaatcggcgtcaaagcactcttgctgaggttggtcttgagccctgtagcttttccgaaaagctgaagaatggcgtttaccgctgttgcctccctctcgattggttgcaggaacacaatggtgtcatcggcataaatggatgtgtttgggatggaacgtcgagtgtccagcttggcaagaagcccccaggaagtagctttggcgagcaagccttgcagcgcatccatgacaaggacaaagagtagcggcgacaacgggttaccctgccgcagtcctcgcgccggcttgaagctgtcactttcatggccattgagcaagattctggtttcagaagttaagagcagggcagctatccacgatcgccacctggacccaaagcctctgtttcggagcaagttcagcaagaaacaccaagagactgtgtcgaacgctttagtgatgtcaagtttcaggaggatcataggcttctttcttcggtggaattgcagcgctaaacctctgacaaaaatgaagttttcgtgtatcgatcggccacggatgaaggcagtctggttttcagcaactagatcgcccattctcggcgccaaccgggacgccaaaatcttcgttgcaagcttggaaaagctgtgtatcaggcttatgggcctgtaatctttgatcaacgtgggcgcatccttctttgggagcagagtaatcaccgctgtgttgagattgtcgagattctgatgattcccagagtgaaatttcgtcagtgccgccagcacttcccctttgatgacttgccaacaccgttggtagaaaagcccggtgaatccatccggtcccggcgccttctcgtttggcatctcttttatcaccttccaaacttcctcttcagagaaaggcacttccagctcttgcaggttcggcgccggagggaagatttgattgaattggagctcagccgagtcgggatccgccacacccaaaattccctgaaaatagtccttggccagagcaattttatcttcctacgaggttgctgtctgcccttcatactcaaagactgggatgaatagcttacggcgcctcgcattcactttcatatggaagtatttggagttggcgtctccctcccggagctgggagatccgagcccgctggcgcactctgattcgttcgagtgacgccaatgccaggcagcggcccttcaggattgccctgaaacggcgttcaagaggggaaaggagtcggttctcttgcgccacatcaaaacggaagatcaattcattcgcaatctggagctggaggcgaaagcgactgatcttcttttgtccccaggaacagagagacatagcaagacgcgccatcttgacgtacaggatgacgtagggatctgtgctctcaaccgtctgctgccaggaatccgccaccacctgatcgaagtcctcaagcttcgtccaaaaagtttcaaaacgaaaccttcttctaccccgcggggtttccccgcaagaaagcagtagcgcacaatgatctgaactggacgaactcagcgcttgcaagtgcgcgtccggaaacgcatcctcccattccgttgagacaggcaccctgtccgatttgaccagggtgggaaattgttgctcgctactccaggtatacctcctcccgaacagatacagttctttgagctcaagttcattaatcttgttgcggaaagcattcatgagccgcctgttcacccgcgagttgttcttgtccgccgctgccgctattaagttgaaatcacctgccacaagccaaacctccccacagattcctctgatttcggcgagttcctccaagaacagaatcttctcgttatcatcttgtggcccgtagaccgaagtgaggaaacatgaatggttgcctgcagtccactccaacttcgccgtcaccgaccattgtcccaaatgcacttgtgatccacggaatacggaccccttccaggccacaataaccccgcccctggtatgtgacgcgggaagggcaacgaaatcatcgaaatccagcccacacagttcatggattacaagcaaatcaactacctctaatttagactcttgcaagcaaacaacagacgcatgcgaattaacaacagactcctttaccactcttctttttgcaggattattcaaccccctcacattccacactagcacactaagacgagacatggaaactaaaaacagggaaaactctccaccaccgccgcacgccgccggaacgccgctcaagcaggggattccacccccgccgccaccagcgaagccaggtccggcggtggaacatctgcttcctccagcgcaacatccacatccagcagctccgctagcgccttcatgtgctgggtcgataacggctgatcaaacacggtagtgtactgctggaaggtgtcttgatccgcttcttcttcctcttcaatgatgcccatcttcttcatcgttaccttctgcgcttttgaagttgaatggcgacgagctccgttcccttgttgttgcagacgtgggctgcgccacggcgtgaacccctcagggatcacattgcgccgacgaggcttggatttggggactgacgctggcggcctcctcccgagcagggaggggggaggctcagtagcgaccgacgcgaggaagccctgaagaatctggtccgcctcggggggtagcggcgtgttcgccggcgacccctccgaggttggccgcgcgcgggcgagtgctgtcgacggcgaggcgggaggtgggagcatcatctctccgctgagcgcctccctgctgctctcgatctcagtttcctggaccggccgctcgtcgtcgctgtgggccacttcttcttggtgggcctgaggtggctcgtcctcgccacatacaacttggcccaccgacatttcctgtcccacgccagccacagcccgtcccaggtcagcctgccccagatcctggcctgccaagcccatgaggccgatcccctccggcccaggttgctcatggctcggtttcttctgggcctgcttccgcacatagacacggaactctcccgcctttgccgccgattcaaacccacgatcactcctgctctcctgcgttgagctcagcgcgtcgccagtcgccttcaatgctggccgctcgcacccatgctccacgagcgacacctcagccatcgtatcctcaaaagagagcttcttggccaacgtgccaaaagacgactggctcgctctaatacgcggcgaggccgacgcaacacgcgttaatgcatatcccccattcggagttaatgcgacttcctgccctgaagccaggtcgtccccgtgaacgtgaacgtggtccacagtggcctcccggacctcatcactgagctcagcacggtcgccatcattctccgtgccgagcgccgacagttcaccgccggttaactcgtccagggagagttggagcggcgatgaaagaggcgacacaccaccggccacgagcgcccagctgcagtcgtcgtccagaacgataagcgcctttgccgttgcaaccacaggcgccgccagcggggtagggattcccacgtcggcccctggttgctccactgcttgcaccgcttgcggagagaaccacacacccggcgcttgcaaaaccaacgtcggtgaatgcggctgtgacgccaacacctcccccgcctccatgtcttgaacaacaatgtcagcccggtctagaacccggtccgccgctgccatgtcaatgacccccaccaccgcagctgtcaagacagcatcatcctggctctcctctgtcaccgactgccccgccgccggcatggtcgccaggcgttgaagcaaccgccttggcggggccgagacctcccctgggatgggggcaaaggagcgcgcgcctagacctcccgccgaaccggtcgcaccgccgtagacatgaccgcctcccacctccgtcggccagggaccagcgccatcgtagcgacctgcccagcaggagaaagtgttccgccgggtgacgtcttcatcatcggagttgtcgtcgaaggaggtcggcggagtatgcaacggcgtagggtcaatgacttcttctacgtggatgatgaccggataggtgagggccggcttctcccgcggcggggaaggtggtgtcgcgctcgtcccctcccgccatcgccctgcggccgggcgttccgggatttccacgtccagatggtggggaaggtcggacggattcttgaaccaagcgaagagaccgaggcagcgcgcgtccgccgccgggatcagctcggcaagctgaccgtccaagctgttgaccagcttgtgcatggcttcctcctcccaggcgtgcgggggaaggccgtcgagggagatcttggtgaagaactggaaagccgaggcctccgcccagcagcatctgttccacggcttgaacgaaacaggcacctcattacagaacagcgccttcgaacaccgcaggaccgcctccttctccctctggttccgaaacgagatcaggaaatcctccgggcgcgtgacctccaccctgaagtaacgctgctgcacgcctgtgtgcagctcgattgtctccgcaagctctgccggcgagacgggcggccgtcccttgagcaccgacgccatcagggagagttcctggaggtacctctcatggcgctccatcccggaggtccaggacagcaccacccgccccctttctagccacgagtcgggctcgccgatgcggtacttttccacgaactgcggcggcgtggccgcacagatctggtacccgcccaggttagcacccgccatggctatcaccgcgcccttttctgtcgcctgtggggccggcttgacgatcttcgacttcgccggcggcacctcccttaccaccacctgcttcaccttcccctgttgttctcttctcccagacggccacctctctgcgcccagacgcactgccgccccggattgcccccagagaccgccttcctctccggacacgcccacgctaggtgacccgggtaccagcaatggaaacaccttgtctctcccttgcagtcaagcttgcgatgacccaatcctaggcacttgaagcagcgccccagaagccagcgagggatctccttctccgaattgaatgccctgtcatggttgctgaactccttcctcggcttgaatgctctgtcctgtttgttggaggttgggtcacctgcccgcagtgaatgctccgtgctccccttccgccggacctccgtccaagctgcctcctcagcggcggcaaggcccctatctttcttcacgacgtcgcgccacgagccgaactgcggcttggatggtggccggcgggcaccggagtggtggtccgccgggtggtaggtgagagcctcacgccccatcgctcctccctccaggcaggcctcattggaatgcattttcactcacagtcactatggtggcaacaaacggcacaatcacttaaaagttgcaattgcttggtagaaaaagctattgaaagtatagaatcctaactccaaatctaatttcaactgcctaatcatgaaaatgtattattttttgccgggccagcaaaaggatgccggccagagtatattaagaaagagtgcaagaatgtgcattattacaaacacgcccccgaaaactaagggcgagaagacagaaaagaaaaaaggctacagcacacggccgcctccgccgcttacgaagctacaatcaagcccgctgcaatccaagttctccattcatcttctatggccgcacaaaggttgacaaaaaaaatgaaacttactgatgaagaaatgaaacttactgcagtatcctggaacgaacaaagagcaaaagacaagcaaaacctacccatatcttcacaaatacatccataacaattggaaccacacgtacaaaaatggtaattgcagcttgatcagcttcaaggccatagtgttcgagaaccacttctactaatgtgtgccaacttgactccgaatgattatgcaaaattgtagaagggagaacttcagagaaaggatgacgcaattaatatgcacagagcaaaggagatagataaactagattggcaatcatggatatatgacttttcctaatttttgtccctttgtaaatattgtaacctttttattatatatttaatatagcgcaataggagcctctcctgctgtttcccgtcaaaaaaaaattaatagtaaaatcgtgataaagttcaatggctcatgaggttcatataaggatggcttctgcacagactagttccagttgaaagaagagatactggcattcattttcagttctttctcggtatatcgtgaatgaaaagttcctgctatgcacaaggtgctaccacgcaaaaggagaaattatcttctatttttggagtaaaatatctgtaagatcagaaatttggtcctatgatgatgtcaggcaataggatgtggacacttgcatatttgttgaatcgttagcactttacaacatgctaaaatatacaatacaagaataactaaaagggaaaatatccagtgtaaaccatcgaaaaggtgaaaacccatgaaaacctgacctaaaagttctctaaattcatgaaaaaaatgctagagataggtataggcatgacatatattatcacaaaatctcaagttcaaactcaatttcatttgggagaagaaaaaaaagactattcacctgaaatttgtgttttttcccttccaaataaagtttagtttggacttgagattcaatgagccaagctgcctgagtcaatccgatcctcccatgatcgtccttctgaattcatcgcctcctgttgtgcctaccacagctcaacaatggcctcacctttcccttccactctttaaatttctcatcattaggaagctcttcctctccatcaaaggcatcaagaacatcatctgtgctccaatcaggccagacccatgcatcggagaaccaactcttccatcaacgctgcctcttgctactcctcctcctcctcttggcaaacaccacccaattcctcaccctcctcctttgggaaccaacaacaaacaccttgcatgcatgaaccctcttctgaagagtctcctcaacagtgagccggacagtgttggcacttgggcgcagcatgcagcagctcataaacctcatggaaaagataccacatcttcgaggtgcccatacaacatcagcatcacatcaccccgagtacggctaatggagccaagaaacctcccagagaatcacagagcatcacaacttccttcctctccttccagcacgtgctgttgcaatgaagcacgcaacaaagaacgataaacagtcaacaagaaggagaagaatcactccgattatcggtagatcaacctgaagaatcctgtaccttcggagcctgaaacacctcgaggagaagaacacgatgagaaggtgctcctttgcgtagcagctccaccaggtgtcgagctaagcacgcgattccacaatggcgtcgtcgccttcctctgatccaccagaaatccattggagtggacaagagaaccacacacacgacagaccgtacgcgcggcggagcactcgcgaatttgcgatagcgatggctgatgaactgtaaaagcaatcggatcatggagattgttgggcttgggcctacagcctcctccctgctgggcctgacccaatcaaggccacatcatgtcttgactcttgactccttttttttcatcagatttctcaagataaagaatgaaatatgtgatactaattcatagtactattcaagagcacattttctcatatatcaaagataactagataaggtattctattctaagtaggcaattgcgtcagaaaaaaagggaaattacagggcacaaggtggctgtccacatcatctgcatccatgctgactggaaggatgatcactcattctgtttcaccttctcctgttcttgataccaacctttatccttatccaaccttcttgtgtttttcaccccaactgctgggattctgggagcatattagtagaatattacctaaccaatttgcacacactagctgccaaagatgccatccctaggaagccatgttggaacagaccacttgaagcatcggtgctcacacgacaaaaccataaaactccagcagctgtttcttttcttgttgtcattgccagacatgggagagacggcagaaggtgttgaagcaggcgagaaatatgtgagcataccacagttggctggagttggaactcttctctccaatggaggaaaggtgagactgatcatagtatttgatagccctgatcttcagcttagcttgtgttctgttgttctgaataaatattctctaattttcttgtggatatactatttggcatccaagcatgatttaaatatagcaaataaacatcaatacatagaagtactccagggattggctgttctgtttcatgatcaaatctgagatctctgcttaagtataaaactgctaacatggcatagtttttccaaattagtatcagtattaaaacttcacactatgcagtactgcaaaaatatgtttgcttttggtttcagaaagagaagaattagttgtctcctaaatttgtcattgtgtatcaaaaacaggaaatacctctgtcgtccattgaagggaagagaatctgcctcttcttctcggctcactggtgcaggccatgcaggaactttaccccaaagttgctccaaatctacaggaaactcaggaatacttgcaagaatatggagataatcttcatatcacttgaccgcgacgagatcagcttcttggactacttcaaaggcatgccatggcttgccttgccttttgacactggcctaaggcaaaaattatgtgtgcaatttgacattgagcatatcccagcattgattcctctgtcaacaacgctatctcatggatttcgagtcgaagaggatgcagtgaagctggttgaggagtatggagtagatgcctacccctttggtgcaaagaggagaagtgaactggagggtatggatgatgccaggagacaaggaggtaatcttctgcaacttcttggatgcaaggaaagagaatatgtcataagtgcagatggcataaaggtgaccaaaatcataacctataaattcgtaatttgcttgtttatgcattgcgtatgtttaggtaaaatataaggctagatgatgcagacttgatagatggtgccagtatatagatacatgctatgacagtaacctgctagcaagaaccccaacagattgcactaatacaagctaatatatgagcacagtcatcaaaatcttaatgattgtataaccattaaactgagtaaactggcaatgctagattaataatagtaatctagtcacaaaacaatgaaaccaacaaaatatgaattaggtgaagctttatgaagctacatgagataaaaaataaaggaatatagctacaggtgcagcacaacagtttttttggatactatgatccttgaaaggaagcatggaccaacaaacttaatgtgtaacatgcacaagcggaaattgctttgaattcctcatccccatcaggtacaattggctttgctttaccatttcaccttctattataactctttcagactcctatatctgaccttaatggcaagacaattggactgtactttggagcacactggtgcccaccttgccgtgccttcactaaacaactcagggaggcgtacgatgagctgaaagccttgagacctgggaatttccaggtcatattcatttccatggaccgcaatgaggaagaattccaagcaagcctgagtgcaatgccatggtttgctatcccctattctgacacaactgtgcaagaactcagtagaatcttcactatcaaaggcatcccaacactcttgatacttggaccagatggtaaagtgttcaaaacagacggaaggagaataatttcaaaatatggtgcaatggcattcccttttacagaatcaagagcttatgagttggaagaagttctcaaaaaggaaagggacagcctgcctcaccgagtgagagatcaccgtcatgagcatgagcttgagttggacatggctaaggcttatgtatgcgatgagtgccaacagaaagggcaaaactgggtcttctcttgcaagcagtgcaacttcgatctccatccaacctgtgcgcaagaaagtactgatgtaaacatctgagatatttatacttcaaatatactgacaacaatgatgtatgcgtttatgtatattgtgtccaacagatctagtgctaatgtggcactggaaaaaaaaaacttttaagatctagtactacgggactcaacactcaatagaaaaaacagctaacgttctgtgtccctgaatgcaagattaacagatggaatctatgggtgcacattccaagttccaacaacaaaatagttatgtaatgatttttttcaatagaagtattcatatgtgactatatataatcttggcaagggatgttccaaagatttatgtaactcatgcactcatgaactgatggaccatctcatatagctatccacgcagctatttcatcaaacacctagcgtgcagccgtgcaggctcaacctcaagactttaagagaagaatatcatcttattttcacgaacagcaatagaaaaacatcacgaccgcaatcctcatataccaggcaacaacgaggtagtctcagaactgtagcgtgattggattctgaacggctttttcagatttgaacaacctatacagcgatccgaagcacttaccacaacttcacaagcacttcgaccaatcgaatgtggccacagctgaaaactctctgagatttctcaacggagagcctgaaaacagcgacatttcctcgatccacgtagccttcgcggatttggcaggaaaaatcaggggagaggatgataaaagagactgaacaatttaaaacgggagaattggacggcagcaaatttagcaaatatccccttgtacatattcacaaaagggactacatttgttaaatattaaactaaggtcctttgtcatttccaataaactctttgacagcctcaacccattgcagccatggtttttcacgtcaaactttaactgtctgccttatttaaaaaaaaatttaaaacataaatcacgagtaaaatactatttatattttatcatctcataataacaaaaatactaattataaaattttttaaataagacggacaattaaaattaggcgaaaaacttatggttgcacttgaaatgagacggagagagtattaagtaagggtaaagggtccgtacaattggttatttttttctaatatttactttgttgttcttatttcttattaggagtattttttttttccaaactactaaacgatatgttttatataaaaatattcatagaaaagttataaaaatcatatttacctatacaaaaattaaaattaaaacttaattaattatatcctggtgaatcatttcattttgcaaattaaacttgcaccgccgtatttttttagttttgagccattgatgatggttgatagactaattaattactggcatgtactaatgttcttcgtgtcgattaccaatgctaaattgcgattaatcagcattaattcgcaaaaatctactatactattttatttaatcaaatcgctccttatccgagtcagagggggaaaatcagggtgtgattattacctttacgatttacccctcgctccatctctatatttgcgtagagctcctcccgcacttgattcccttctcgcatcgtcgccctcgtctcgaagccaactcgcgacacccaaaaccgaaaaaaaaaccaaaccctcgtcacttcccacctcttcggcggcggcggcggaggcggccatggcagcggcggcggtggccacggtgagctccgcgagcggcatcctcgcgatgctgcaggagccggcggaggagctcaagctgcacgcgctcgccagcctcaagtccgtcgtgcacctcttctacccggagatctccaccagcatccccaccatgtgagcgccccctctcccaaccgctcccccgccatctctcccttgggtttccccccgccctacctagtttccgcctcctcggcctcggcgtcggccgccgttgtggaggctgtagctgttcgatccgtcccggtgccgtggctacgcctaggcttgttggtgtgttgattcgattgcccgattgatgagtatcgtggaggggaagtttccctagttgcagctgatgttgcgtgattcgctagcttggactcggttcggttcgatctgcaattggaaacagtaggttaggttttgttctgacctgtaaacttagggaattcggtagtttaatgcgcggctctgtgctgttataccttactaatctataagatttggagtgcaattcacatttttcttgctggtcatccgtatgtttgaattggtaccccagtgtaaaattctgaaaatttttctcttaggactagctgttgtattgaacagcagttggttttaactgaggaggaatgataaatccaaagggtttaaacattcagggttccaaaggtttctgattctgcaactattgttctttttatgtgtactaagtgaaatcgtatgagttaattggaactatagggattgttttaacatatagcaaggaaaaaattgcctgctttattcttttctgtcaaaatttatttctattgggggccaatgtggttctgttgaggtggaacagatagttcagttgcagtataagttttgacagctagttgttactgatgtattgtttgtggttttgacagctagtgtgtttatctttatgttctttatgaaactgttctagcttggtctattttgtgaagcgaagcttcatacaatttttatttacaaaatatatttgttagtagctagtacctacaaaatcagtatgatgtgaaaggactttgaagtatgaatataatggtataattttattcactaaacttgctaactgctggtcaaaatctacaaagtttaaatatttgaaaaatcatgaacatgctaaatgatgagcaaggaaaaggagtacttggtatgttgagaaaatataaaaaagttacatcatggagcctgtataatcgctttctactgttcctttttctttgcagtgagagcatgtatgaagacgaggattttgaacaaaggcagctcgctgcacttgttgtttctaaggtagcactccgtacataattatgtatacattttaacgagctttttatctcgtttactgatttttggttgtatatcacacaggtattttactaccttggggagctaaacgatgcactgtcctatgcacttggtgctgggcctctgtttgacatttccgaggattctgattatgctcatgctcttttaggtgaggagttgtctgatgttctcaaccattaggatgtttgcttccagactaatatttctttgtcatctactcaccatgatgaattcctgattttcctatcttcagcaaaagcattggacgagtatgccagtttcaggacgaaagcttctaaaggcgccgaggaggaagaaaatgtggaccccagattagaggccatagtggagagaatgctggagaagtatgataaaatcctcttattgttgatatgtcagcatatgagatggatcattcacctattgtttacattatctgatattctgttgattattctttattgcaggtgtattcttgacggtaaatatcagcaggccatgggaatggctgttgaatgcaggagacttgacaaactggagtcggcgattgttcgatgtgacaatattcatggggctctttcgtattgtatcaacctttcccatcaatatgttaaccaccgtgaatatcgatttgaggtagggtcatggaacatcaaattctctgctcttagtttacttctgtcaggttggaatataattatcattttagaggtggaatcccaatttagcatacagcaagtactgctaaaaaaactaaaatatattccaactgaccagatctccaatatactgtctttacaggttcttcgctgtcttgttaagatataccaaacattgccacatccagattacctgagtatttgccaatgcttaatgttcttgggcgagcctgaaactgtggcaaacatattggacaagctgctttctggaagcaaggtatgggtctctttactcttttaaatggcattacttaaatgtcagtttaacttactaaagattatatgttaatatccaggatgatgctctccttgcgtaccaaattgcctttgatctcgttgaaaatgaaaatcaagctttccttttgaatgtgaggaatcgtctggcttcacaaactcctgagtctaaccctgatagtggatcggctttaccggatgatcaagctgctaatgcgggtacgggcagcacagaaccagctggggatgttcagatgagagatgacacagctacaccaaatggtagttctcacacagtagatccaaatgaggtagcacgtgctgataggcttgcgaaaataaaaggaatactgtcaggggagacatctatccagttgacactgcaatttttgtatagccacaataggtgagctgactattacttgctaactgagcgtactatttacttcctccgtttcacaatgtaagtcattctagcatttcccacattcatattgatggtaatgaatctagatagatatatatgtctagattcattaacatcaatatgaatatgggaaatgctagaattacttacattgtgaaacggagggagtacttgctaaccgttgataaccagtcttgcaaatttccatgcctggtgctgatttgatgcaacttgtttgtctcaacaggtcggatcttttaattttgaaaacaataaagcaggctgtggaaatgaggaacagtgtttgccacagtgcaacaatatgtaccaatgcaatcatgcatgctggaacaactgtagacaccttcctaagagagaatctggtacatttagtttctatttgttgtcttactgttatgcaacattttggcctttgtcctgttcttgtctcatgttggttcttgcaggagtggttaagcagggcaaccaattgggctaaattcagcgcaaccgctggactaggtgtcattcacagaggccatcttcaacaagggcgagctttgatggccccctacctacctcaaagtggtgccgttggtggtggtagtccatactcagaaggaggtgccctatatgccctgggtttgattcatgctaaccatggtgaagggatcaaacaattccttcgtgaaagccttcgcaataccagtgctgaggtgtccttttattcctttcctgtctttttaatctcatgtcattcatgtcatgcatattttgcttacttctaagcaaattatataggtgatccagcacggagcctgtttgggccttgggcttgcagctttgggaacagcagatgaggagatatatgaggacataaaaaatgttctttacacggacagtgctgtggctggtgaagcagctggtattggaatgggcttgcttatggttgggacagccagtgagaaggccagtgagatgcttgcttatgctcatgatacacagcatgaaaagattattaggtcagtgttgtttgattactgtcagggtaatttcttatattgtgttatgctcttgttctgacatctctctctttccaggggtttgtcacttggcattgcgttgacagtttatggcagggaagaggaagctgacaccctgattgaacaaatgacaagggatcaagatcccatattacgttacggtggcatgtatgcattggctctagcctacaggggaactgcaaataacaaagccatacaccagctgctgcattttgctgtatcagacgtcagtgacgatgttcggaggactgcagttatggctcttggatttgttctatacaatgaacctgagcaggtatgtgcactatcaaatggtgtactttttatgtcttcatttaatttgatgattcgccttcattaaatttgatttgtgctgtgaacatgctttaacgtattatgtgtttgatcaagcagcatctcttcataatatttccagctaattgttagaataaacaaacactgatagctttgatccacaactcacttcttttttgtgattatgcagactcctagaattgtgtccctgctctctgaatcatacaacccacatgtccgttatggtgctgctttagctgttgggatatcatgcgcgggaagtggattaagtgatgcaatttccttgttggagcctctcacatcagatgttgttgactttgttcgccagggagctctcattgctatggcgatggtcatgattcagactaatgaatcctttgattctcgtgttggaacattcaggcgtcaattggaaaagatcattcttgacaaacatgaggacaccatgagcaaaatgggtgccatactggcttctggtattctagatgctggtggcaggaatgtcacaatcaaacttctctcaaggaacaagcacgacaagcttactgctgtggttggccttgctgttttcagtcagttctggtactggtatcctctcctgtattttattagcttggccttctcgccaacagccttcattggactcaactccgatcttaaagtaccgaagtttgagttcttgtcacatgctaaaccatccctctttgagtatcccaaaccgacaacgcaacagactacgacttcagctgtcaaactgccgacagccattttgtcaacatacgccaaggcgaaatctagggcaaagaaggatgcagaaagcaaagctaaccaggagaaagcaaccgaagatgcttctggctctagttcaagcaaggccaccaaaactcaggagaaggatgccgatgcaatgcaggtaatgatagctataattcaaaatttctaatgattgggtttagtataactctttggttttaatcttttacctattgtgtttgaatccaagataacaaactttgcagaaagcagcagcttctactctgctgctcgctttctggttgtggggatttgttgatccagtgtcaactcttctgctgttcagcacataaccaacttcatttgttcccaggttgataacgcggcggagaagaaggctcctgaacccgaaccaaccttccagatcctcacaaacccagcacgcgtcatccctacccaagagaagttcatcaagtttatcgagggcagccgatatgtcccggtgaaacctgctccatctggattcatcctcctccaggacatgcagccaaccgaggcggaggtactcgcactcaccgatgccccctcaactgtggctgcgaccactggtagcgccgctgctgccacaggccaacaggcctcatctgccatggctgtcgacgacgagccgcagccaccacaacctttcgagtacacctcgtgatggtagaaatgtaggaggcttgtaatagagatctggactcgcaaatcctttctttcctactgtatacgttgcttattcttttttgagtatgtaatgcgcggaaatttgttgctggaaaaaaaataactgatgaatcgtccgtagagaactttgatggagattatacgatgggtcttttgagttggggtatcgactggcagcgcaagccgcaacctgcatcgcgtcctgtgatgctttgaacttgcaatgcttgtattccatcgttttccaacgataaggtatcagaacttgaaatgcttgtattgcattattctccaacgctaaggtgtcatgcttgtattgcattgttctccaacgctaaggtgtcattaagatttgagcacgtctttgctttgttgcaatcttcggttgcgatctgcttaccatttgttgcaaaacacaccctttcgccttccttcctcctttcaccattggttgcttgcaaagccagcgaggaaggcgccatagctagcgaacaccgagctgccgcgtcagaaggttcagagaagatgagcgtgctttcttattcatcgtatattcgtattcttgttttggggaagattaatgttcaggtagaaacatttagctctgcggtttctctgttacaggagttttgtggttagaaaacgaaatcagtgagcattagcttctaagcaatgcaacagtgttgccttccatccctattcttgttcagtgattactccggggatgttggggtaacattttaaaactgttattgccagttacccctgggtcccccaaaaaaaaactagatttatgggtggtctagattcattgtactaagaggatagtttgagtttttttaaggacggagggagtaattactaaagcagaagatttgccggaacaaacagtatcgtaagaactaatattggtggccatgaatcaaaatatagccaactgaaaaaccataccacgagacgcaagcaaattagcgcacagaactctcccaactggtttacatcgtcaaagcagacaagctggtaacatcatgcagccatgttgataatcaagaccgagcaacattctcaacctcgtcagctttgaagttcggtttggacctctgaccgtgcaaattcagtgaagcacgaagaaatcaagacttaaatacgcccataatccccaggatgagaaactactacagtgggcaagttatcaaaaccgctattggatacacatgctggtggtcattgcaagtagcgttacatgatttccttcacgctgatacgcgcttcgagtgttaacaggcttgttcatgatgccgtccccttgcagagtaacacctgaagttgcactctgcacacacacccacagtagacagtggactggtagcgatttgattcaaaagggcgataacaagctcgagaaatcagaatctgtgaggacttgtaatacacagttgttctgaaagacctgccaaaagaaaaaaaaacttgtcagtgttgagaattgtagctacaatccgccacaatggtatgaacaagacatcacctattgctcctggttcttgagttcatgctcaatgagcctcagctttacattgttctcctcattaaggagagagagcttctcaagcgaagattttagtaacgacagtctgggagtccgaaacatggcttcttccgacctttggtgtctgccatgttgacattcctgtaccagccgcactgccaatggccgggtgagcaaatcgtttcatcctcgcactcagagcagtgattgaagagcacaacgcatccagctccacatctgcaaacctatctgcaaaaaagaaaaggcggatccaaataatgttagcaaatgaaactgtttcgaagagtttaaagatcacctttctcaactacagacctagctgtgctttgaactcctgctctgcttgtgacaatggtttcttgtttgccgcaggaagtatcttgaagccctcgatgcgtttttctaacaaatcgtataccttaaaggcccgatttatccggttgtttatatcttggtctttggcttctatggatagaagtgattgcttcactgcttgcaagcgtttctgcttgtcctcaatttctgtcttcaggtaatccccatgttccttgagctcaatgaaaacctaagaatcattaaaataatatcttgatcattatgtttgcctatactcccatttattctcatctgattagtgatggtacatttatagctaataggtttggggatttgggcatctgcaggtcctattaattctagttgccgctaaccattcaccaacaatgacaaatgacatgttctgaggtctggaaatatgtgaatatgataagagttatatgcaaagtatcatggtgacagtttcttaccttatgcccatactccacgtagtactcatggaaaactttaatatagtgatgaagagtggattttccttcaatagagtcaggggtcaatgacctcaagcttgatgaagatggaactatgggtggatctggacctgcgatgagctctttactgatcattccagttgtaaaagattccacgtccttaatgctcttgctgtctatgtcaagctgaagaggcgttggttccttccaacccttcatctccaccacaaagcactcacctgggcatgtaatgctgactaactgcacatggccatatgcatctgctatggtaacaaaaccagaaaggaagggagaatttgcctcattgtttcctgtagtgaggataggatgcacagagggtggagtggatgccatttcagggtatgaaaatggcaggaagtgcagtgtgaccatgtcaagtcccccaccatgggcacaataaaatctctctggaacaaggggatctagaaacaatgataaagagctatcattggaagtttttgctagtgctaaatctacaattgcgagtcttagcaaaggaggagaatgccccatccagacagcatcagtattactcttcacatttgatcccgtactggacgggcgatacgatcgcatggcccaagaatcttctgaattagagtcacatatcatagcaacactctttatctgcccatgtgaatcaacattaaggcgggtaggaattcctatgctccactgtggttgaatttcatcagcaagagcatcaatctggagttgcccactaccccaggcagttacaagaatggaatctttgccaacagaactatacacaaaacccacagctttgccttcacaagagttgctcttgctttcaggttcattgttttcttcgcaaactctacaaagaggtccctgcatggagtatcaatcaaatcatatttactaatgacaaaaatgtagaagatagttacatgtacattgacaataggtagctatagtttggattatcagatgtcatatcaagaatgattgtccagttctacaaaaattaccaagtaagctagtctagtattttgataatttctctttcacaaagtacaaactacatcaatacattacaacaatacaaaaaaaatggtaataaaaaaatatcttaagtaccagatttgcggttgtttattaattcaagaaattccatattcagtaccagaaactaatttacagaattttgtagacctagagtaataaagtcaaatagcctcccctaatgttttccggtcaaaaaaatcatacatgattttgtaagacagaagttttagttagtgctgtctcttgttttcctttctttctgtcatagccattgcgaactggcccagaaaaacatgggaactatctggacaacttaatccatggtttaggtcatgaccaaaactgagtacaatagtaattatggccattcttgagccaatgaagcgcaaatcttgtgcacaccagggttcacatttccattttcaaggtgaaaaccactttcggtttaccaaaaactaagcaaaaacgggtaaaatctgacaaatttggtcaactccgtatgaaaaccatctaaaaacactcaattttcacaaaccaatccccaacagtttcacgaaaaccgagcggcttttgcggttttcgatcagaaaggtgaaccctggggcgcactaccaattccaaactgtggcagcaaatcgtactagcacaaaagttttcatgcagacatgtgaatgcggtacatgtctgcggtagacaccgccgctacatgcaagttgtggaaatgtctggtcgcaaaccaatcagctcctaactcctacaaaacaataaatctcatatactaaaaaacaatggattgattatgaccagctgcatgagcaccaaattcacatttctctggtcattgcattagcatagtccactagcttttggttcgaacaatatttcaccaagtcaaatagaagcagacctgtaaagttagagaatcatctaatgatgcgtatggatgagctctagacatcaatgcactattatcagctggctgacgtgacaagtcaggaaacgttgcttccaaccaagcaattgccaaacgtgagttggtgacaacattttggtttgaggatttcaatccaaatgaattaacatcttcatatatttcttgaatatgcttcttattgtaatcgctgcatcacagggaaaaaaaataaagtcaaaaccaatatgcagataaagaaagggcaccatatgatcatatcattaaggtcgcatttcataaatacaagactacaaagtgaaagtgtgaaactgcagggaccataatttatttcccataaacaaaattagtacagtattttttttgttttaacaaattaggaccatcatgctgtcaaattgttgtaagccttcttcccaatagagagaaaagaggggtgggggagggcagaaataaatgcaatacttaccttccaaatggaacaatggggcagagcacaaaaattgaaccatcgctgaataagatgaaaacctgtaaaaggacaggcttacatgtgaaattaagcacataaatgagccattaaacatacgaagtatgccgaaactactaaaaatattacatatgtcgaaacaaccaattgaaaaggtgacatgaaagaaagtgatgcataaagtatcaaaagtattccagtaactctttcatgaatagtggggacaaacattattagatgttccagaaaaaaagggtttgggcgtagaaaccatgcaatcagctgccaagttcatttatgtagtaatatgacttgtgacaccctaaatcttgctacagatgtaaataaagaaactgcaaggttaatcccatgtgtgaagcaaacaagtactccctccgtcccaaaaaaaggcaacctaggtggggagcgatccccacctaggttggttttttgtaggacggagggagtagattctataaggctaattcgggtaggactctaatatcctattttgtggtttaatattaactatgctatgatattgcttgctaaattacaaaacaatcccatcggatgaaaaatcattctggttttgttttcagctaataaagacactgtagatcatttactatatttttttccagatgacttctacaatatttaggggatcaatattcaagaaacataccgaaaatctatcccacagatgatcactcccatatgagaatgccactggacaaattgatgaagcattctggcatttgccaggtagaattggttgcaaatagaactcctgctctggttgctctaaatcaaatgacagatcaaataacctgcagaaataataacaaaacttctataaaagggtcatgcaataattatttttaaaagcaagtgttgtcttcaattaatttaagtgtggatgtaaaagacgtatttccattccaatcaaatccaataaatagcaaggaagcatagataaagtggaattcctccatctagcatcgatactcatttatcaaacctgaaaacagcatctgatgtcaagactccaaaatgactactgctaaaagggtgccacgatgtttgcagtactttgatgccatcattgttgctaggtaagatctgagaagcaactggcacagtcctgttgtaaggtccatatgtacaagtcaatacaatgaaagaaagaagatatgagtaatgatattaaaaaaaggaagagaaataatgattcaggtcataaatctaaagagcaaggtgaaataaaattttggagttgcgttcttcaataccctgatgataagagtactcagagaaacctactcttagtgttcacggctatgaatatgctgcatgtatatatgcaacaacctattgcagcttaaataattgcaagatggtcgggaaaaataccagtacaatactaataacataagataaagctatagtggacttatgtacctgcatatgaccttatcaccatcttcagaaaccctctcatgcacatacagaatacttatgttatgtgatccagcaagtagtagcgatgaaccgtcggtattaagtgataaatgagtgaccttgtaaccaagatcagtctccggcatcaacatctggacagcataggcaacatcagctactaattactacctccagtatcaaaaatagcatgacacgatatgtttatttcctgcaacacattttaaactacaaaccccctaggcgacactaagaattccattttttgcactcactagcacaacatttgttagtgaattgcaagttgacctaattcacaaacgtgaaaactcaaacaaatgcctccagttcagtgtctagaaaggaattgcatcacttttacaagtgagaactgacacaaccacaagaggaaacgacctcacctcggaaggcacggcggcttccacggcgacatcatccccgtccttccccgcctccgcatcgcgaacccgcacgcatatccggtgtacgcctcgcgccgaagggtcccacacgtacagccgcgacgccgacgcatcccacgcggcgccgccaccgccgccgccgaggccctccccgccgtccccgcgggagaatgcggggtgagaggggagcgccacccactgagccgcggcgtaggccctcctcggcgacggccgcaccttgggcctcgacgaggtggaggcggaggcggaggcggaggcggaggaggacggggtgagcgcgagggacggggaaggcgagtggcggcggcgggagcgcggggtgcccagggcagcgggggagtggcggaggggaggcggggatgagggcggcgaggacggcggcggcggcgcggtgatgcgggtcatcgccgccgacgaggtcgagtgcttgccgccggagaaagagaaatgcggggtttggggtttgggatggcaggtcaggcctacttgtccatgggccttagaaacaaataagtgggcttttgggcttttgaagggaagtgaaccggtccagcccgtaatggcatgacatgtgggacctacctgtcgggctgttccactacctccgtccaaaaatattatattttgagatgcttctaaaaatacattttttgaaacatactacagcgcatacgctcacaacttacgcacactcacccctatgaatacacgtacacatatctttcccctacgggcactttcaaaagatgagaaaattgcttatagacattagtatattaccataaaaattatatacgcgtatgtaaagcttttattagtattttagtaacatcaggtatttgttgctacttcctccgtttcacaatgtaag

SEQ ID NO: 43046 - DNA, 12376 bp, Oryza sativa
cttacattgtgaaacggaggaagtaatatttttttactgtgttttaagggtatattgataagcgcatgtaatattgtgtgtgtttgtgcatattaggtgttagaaattaaatgtttgagatgagcgtagctcaacagattagatttcttatgatttagttgattagattttttatggtggaactaacccattcgagtccaagtaagatttgatacgggtactcgcatttattttttttcagtggtaagcaacgtagtgacttatttgttaatctcaagatttgctagcccagttttttaaatgtgctcataaggatgaggtttacatgtgtgtttttatagggtgagagggtgcgtacgttatgaatctcaacattttcattgtttttctcaaaaggaaaacataactggtgagacatatcaacagggagcaattaaaacacccactcatcggggatttagatcctctaatgtaacttttctctgacgtgatggttaacatatgaggccgagaatgatagggcctactgtacacgttagttacggtaatactaacgttagatatatctgcttcctccactggcacgatgaataccaggaaacccggagttatacattaatgggttgcagtcatggccttgcctgtcggctgtcgtctccaatctccatgcatgtcgacggacggaccggccgtgcatgacgcatcgacgacaccgcctgccgatctgcctgcagcctgctcgatccatccatcgatgatccaacagcatcacgtccccaccacaaggcaggcactgccgcaattgcatccctgcaacacatgcatgcatcggatcacttgccgtggattcatatcgcagccgtgacggcgtacggtgccgttgccgtcgtctcgtacaactgtcaagccctttttctaacggcttattagaaaatagaaataaatttatagataaaacttttatatatgtgttcttggtgacttaaaagtcaatgctgaaaaagaagttacgttgaaaatatctcaaaatcaatattaaaattaagtttgaaaatttaaaatttagctttttctttgattgattaggccatccgatgaaagcctcagtgagcttgcatagctgcagctgcaagctgatctctccttcatatcgatccacactgcgtcttcgtcgtcatctctatgatcaccatgaggggagctagctgatcgatcagttaatgcaaccctgttgtatatttgctcatgctggtgctagctgtagtagctagctagattaatttgccctttgatattagcttcatgcctgattaatttttccccctttcccttataacctcctatgattgtgtcagttggtcgcagttgtaaaagttttttcttctgttaaattgttaatatatacgagcatgtaaggttttcgcgcgttggagaaaaaaaaaatactatgctgcccattctgacgaactgtttctctgcctgcttatttctggacacgagcatcagctacgggccagccagacaagacagcaaaacgtgaagatcctaaaaaccttgatgcatatatagatctctgtcatacggatgattggacagtatggccactatgtctgcatccatacatgagtgtgctatgatcatgatcatgatcagtatacgtaatattcagtatagcttggatcggagtattaagcaattcatcaaacctcagaattctaatgacagcaggagtgatctgtgatcttaatccatatatatctcctcctctgcatgcagccatcgtatcaacagcgctgacgcgtcattatctaattgcatgtgctacctgttcatcagcatttgacaggagcggttagctagctgggcatccttacgacagcaagatcgcacaaaatgtggccaacgatctggtcggatgaatggtatcagcacatttagtttttctttaagactctatcagcacatttggtttatgtttgcacttcttttcgaccatgaaaaagcattttgtcatagagctaatcttgcagagcatatatatagtactgacgaaagatatcgactattgtatatgtcgttataattagtacctctgccattttcagaaatggagcagctatctaacgtttgccaggcataatctgaaaccttgatatcttctcacatgactgttagtttgctgctataattaagccctaattggtcctacacacacatgaaacatcagctaatgcatgaatatcagattaagtgtcatgtgcccctgtatctttcttctgtaaaaccatgtgtgtatatctccctgaatttctcttcagaatgcagaaactgaggcacaaacacatccgacacaattagaaagaaaacatgagcaaaaaaattcctcgtatctcatcacatgcagctgaataacgaccattagttgcataaggttctcatgtttctgtgttattggcagttgcaaacacccccacatgtacaaggtttcctgtaaccgtggtatccatgcttagatcagaacaaacaatgctgagtggccttaaaatcaaggtgccttctcacatggcgctgtgcatggcaagagcattttggttcatgcttccatgttcatgaaacatgaaaacatgtccaacatattgcttcaggcttattaattactgttatctaaccacaggaggactgagcatggtcagttactttgcaccactgttcaagttcagaagagttgatctttctaatactacaagactttgtgcaaggagttaaggagagatgattgcattgtctttcttccaaaaaaaaaaaggtgtgatgatcgcattgccctgtaacttgatcccaaaagcttttcctgcttcaaagaaaaatcattatctaaagaaaaaggcagctcaaagaaaactgctggaacatgcatgcataaaggtcttctcttcttaattatgtcttagactttatgttctactagtaattatacagttctcgatcctgacttcaggacatcaggtcaaacactgatactatgtgagtttagttgctagaatccagaaaaaaaatgacgcatgagagcctttaacactgttgcttaagccatttgatgataagatcaactggaagattgaatttcactacagggtgcatacttccagagcaaaaacaccattgtacaccgcctgatctggatataaatttgaacataaattctttttttttctgccaaattatattaagatagtgagaagtgtttgaagattaaaaaagtgcgtttgtcgtgttacaacttataaagctacaatccggaaaactcaattcatccatttttttacatgttacttaaaaagtcatcaaaaattttaaaaaatttagtaggatagatcaatatataatatgtcacttcataaacatgcaaattcaactacaatccatcttaactaggtgatgatttgaacataaattcgttgtggcttctatcgttaggtgatgatttgaacataaattcgttgtggcttctatcgttatggagctcaattccggtaagaaagtaaagctgtccaaaaaaaaaatcaagctcgatttgagtttagctaaagacccaaagcctaagccaaagcttacgagttttaccggggcgagctcgaggtcctaccaaatcttactgtgtatagcttttattatttattcatcttgttaacttgataagctaatagataaatatatattagcacctatctacacaataaattagcatgtattggcatcatatatttatcttagtcatttttctactttttattagtgtgattacatggaaaatacttatacttataaagaggttgtcattaaaatattcgttgtactacttatatggacgagcttgcttaaaaagctcaaaggtgaaataggcttagctcaagcttgagtctaggcagagagctgacagccctataagaaaaggagagcttctgaccttctgtaattctatgaagtatggaccatttgtacgccaaagccaacttgccgtgaaatctcccattcttcttgtgcatgcgcactcccattcttctcatccaatttataatgctgtagcaagaaatctgtctgcctgtgcatataagataagataatttcaatgacaacaaagcagtcttcttctgtcacaagtcattttttcctttgttagcaactaccagtagttcgtgatgcaatgtgctgcctgataaatgcactgcaatgatctacgtacccaatgcaattatgcattgaaatgcagtcgttgggacaaaggccctgctcaaggagctggagatttagagaagcataccaagagagagtatatatatatataaggtttctcatcttatagctgctactagttcattattattttttgattatgtagctattgattgtcagaatttgagtaaaaatttgaactattattcaggaagaaactatagtcgctagaaacttctcaaagaggaactgggtatagagtattagctagcatctgaaggtacgctacgtctgtccttgcaaggtacttgggcaatggttggctggcaactccatcaatggccataaaactattgggctagccaacctacggggatgctccattacttggttgacacttcgcaacgtgcagagcacatgctactcggccgttcgctcacctttcacatggatcatggacggatggatggatggatggatggctcttggtggctcttgcaggctgcagatcgagaggctcctcatagggatcggcaagaaccctgaaaaacaagctcagatgttcagtggttgacgctgagttcgcattccaatgctcattattggacctaaagctctttatactccatccgttccctaattttgtaggattcaaattttgtacgcaatataggcctggtttagttctaaattttttcttcaaacttctaacttttccatcacatcaaaactttcctacacacacaaactttcaacttttctgtcacatcgttccaattttgaaatgaactaaacatagccataagcatttctaggacaccgatttcaaagcacgagaatccaaccattttcagccaatcggatgcttaggaggggaattcaaacaattcaaaattcaaaatttgaattttaatcaatgaggtaactcaaaggaaatattttccattattcctcatctttattaaacaacctataaatgcttatatttaggaacggaggagtacaaccctctccgaaactggacgtggaacgtggtgatgtgctgagtgagtggtcaggggtttttgttctgcctgtcacaatcttgatcttgactagcacaagccatgcattgcatcaagaagcaatgcataggatcgagaccagcgtgtacacgagctgaggtcatgttcttgacaaagcagcttgaattgttcatcacattgtcactttggtaatcgtggtggacttcaggggatcagcatctaagtttaaaatgcctcattgggttgaacaatcttgtgttcctagtcagagtttcaacctatgcttggtattcattggagtgcgaggcaacatttgatcgagatatgctagtaaattgctggattagagaaaaggtcagagaaagatgaagatataaggtcggtgagtgatcagatcgatgcatccattgcatctgcttttcttggagtaatatgggcatcacttggcatcttttaaagaggtctctccccacatttcttggaccaaaccaagttgggcaagagcaacaaaggaacaaagccaaaactgatgccaatttggaatcagttggttgctcctttctgttcataaaagcgactcaagtttttcctttttgttccttgcagaaagaaaaagttttgctttttgttcagtctcccaagaaaggaagaaggcgatcagacaatgagacaaatcagacatcagagaacagatcatctctcatagctgcattacgtaatggataaataggatcacatgagtattcctactagataaaaactgtcactaatgcatgctcacattgtctaatgaaaaccacaacataaaagaggaatccagagggcatcagaacctgaagtctgaagatattgcgcggccaaccttttccttcagaaggaaaatccttaaaattcagagtggagtgcaggacaatggctatgagtcagagtcagaatctgggagcagctgaaatctcatgcaatttgtggtatggagttcatcgagtacactcacaaggccacaagcacagtgctatagcctgaaggtactacagtagcctacaattgtttgctgattgtatgtttctttgcacttaggtgttgaacagtgcttggcaaaacaaaggtactactctgatatttttttcagaaactgatacaatgaaatttcagcgtttgaacaaactataacaaatgatccaaaagtaagcattgattccattagacagtacagcctctctccaaaaataaaaggatggtacagagacgtgcacgagcactatatagtcaagattgacataaacaatggcggtgagatgtactacggtactaccactatcactatagaggaacaatcacagcaaaagcactgaaaggcagaggtagaaattcttactgatggggcattctccatttgaacagatcaaaaaatcaccggcagaggtagaaattctctctggcacttcaacaaatcaaaacgaagatactccatttccatatcaaccataaatattttccattaatttcatccatgagggctgcattacccaattcagatcatcagctcaactcaacaaaataagaaaaaaaatattacgcagtaattctaagcttaggggggagatactatcaaatcatccctcaccatccacaacacttaaaaacacaaatcgataagaaaagaaaagaaaaagaaaaaaaatccatttcttttggatggatgaacaacagccatgctaaaaaccagcagctactacgttcctcttcatctgcacaatgggttgttgggggcgccgagggcgacctcgtcggcggcgtactcgtagctgcagtagcagaaggcggcggcgttgtccttcttgttcttctcgacggccttgaggatggcctcgaaggcgggcacctcgcaggggatgcggagcacgccctcctgctggaacccgaactcctcctccgcctcccggagcagcgccgcgaacgcccggtgcttcaggtagtccgtcgggatcacgaaccgctgcgccgtcggccccacgcacaccgccaggtgccccctcggcggcggcgtcccccccggcgacgcgccgccgtccgtgaacgacagcgtcctcttcaggaacttcttcgccttgctctcgccgccgccgccattgccggcggtggcggccgcgtctttcggcgcgacggagagcttgcgccacttcttgagcatctgctgaagccgcacgatctcggtgatcttgttcgacttcttgccgccgccgccgccgggatgcagatgctgctgctcctccatttctgcggtttcttggtcgctaacttttttggggaaatttttcgtgttttttttcttctctctttggcgttttgggcttcgtttgttgcgtttgtgcagtgatgaagctttggaggcgttcatggaggggtaatttatagggagggagcttgtgtggggcccaccttacaatagtctaattaattatttttctatgtgttttttcccttcttctgatctaggagtaactaatggtgttaactgaataattaattgattagaggtttctgcaggtaggtcagtaaagaaaaggggttgccagttcggggaatctgaatagatttctgattgctaatgccatcttggggaaaatgctggccagagtctggcttaatgcagatcttcagagcaatagccctgcaaattcatttttcttttatatataatcatagggctacagttatgtttattagagctgtatgactaattaatttggaatatatgagatgattgaacaagttaagtggcaaaaaaaacaatatgtttattagagcactatgactaattaattttgcaaatatgagatgattgaacaagctagtggcagaaaacaaatatctttgctaattgagacggtcaacattcggctttaaatggttaagcagtgaaccttttttctttatcttcatcagcttaagtagaccatgatttttaggagttatggaaagtagatagtgttacgtgattcagtcaatgaggcgattctgttcgccttttctgtttcggataactgaaaaagtctgttaagcatgggttggagattttcagatcctaagaaattggatctaaaacatatactgccttcacctgaaaatattcagtcaaacaaatctgttaaactccattgccaatcattattgcttcaaatcaatggctagttggcatttgacaattttctctgcttctgaaacagatctacagcagttcacattttcagatcctttgcagttttggacggccaggaatccagcatgtcaatggctgatggagcagaggataggtttcacatcagaacatggctgttgagccttctaacatgtgatcacgcacttaacaataatgctgtaccggctaatgcattataaactactccattttctgcatcagttcagctctgcttaaccagctagcctgtgtgattgctgctctaatcatttttcttctggcggttggcaatggcaggagcagcagcagcattgacttgattagtttttggcagggttctttcagatttggggatctacggcatcgtcctttccatctcaccgatcggtgataccgttcgtcttgtcgcctaattaacacatggattttcattcaacgtggtggttaaagagaggcgaaacgtatggtattcttcatggcaaagaggttcagagcattgtctcttctgaattatggtaggttgcaaatgtgatataggttttttttttgtggttcatgagctgattatttggttggtaagattacttgcgatcacgacaaagaaccaaaccggtagcaaatacttcttttttctgaaagatcaaaccggtagcaaatcatttgctcagtagcggcagattctctgaacttctttgttccctttttttcccattgaaattttggtctttctcttgttctgttgctcatcactaattaaagctatccttgacttgatatgcttcttctaattaaggtgactcgaggtgaaattaaaagcatatgttgtccttaaacaacagctaattaagtgattaacacgatgcacacttggttgatgacaagtggctgtttctgttagtctaattaagcttctcaggcatgtcatggactgaagcttttcgagtgtgttttttcacctgtataatactcgcaatttgccctggtatacacgtgacatacttgaaagctccagtataatcggcactaattaatgagagcatctcctgtcacttaaaccacaattaacaaacacgatgagtactgttcgacaagtacaagttgttgtaccttcatcatgaacataaactagacagtaagaaaaccataaaatctgcaatgccatctagcatctcttttggtttctagaggttgcaggttgtaacatgacacttgtggcacatactagtccactaggtagaaagaatctacgattaagattagcatggatgtattaaagaaaaacattgttcttgctagcaagctctacttggatcagaatgaacatgactaaatcacaggttatactctggggagtttctcacaaaccgtacaacttgcaggctttgtcatgtgaaaatcctcttgcattatggttttagtacagtgtcatgcgagtcatgccactgattatttaatttatttcattcacatctccgagcaaaacaataattagctgaactaaaacatgtcaccaaatttcacaaggaacattctggactatgactctaacttgatcttaaattttgagatcgagtacagcagtaaaccattgtcacattgtggaatgcaaaatgtgtttgtgatatccaacttcagctctgaccaagtggccgcccagttagtacaagtctgtcaagattttccaagtaattttcagtcaactccattgtacaagaaacacacacaagcagttcatagagaacacaagctgaattctttttaagatatttcaccggttgattgtcgcgaattatttattctgtgcctctaaaaataaattttctaaaaaaacttactgcattgcatagattccttgttctgagctatcaaactatttaatttgttatatttataatcatgttgataatatactataataatctagttaatctgcttcaacccgctagaaaaccatcagctagtatatccggtctctgccgctcacaggatcaaatgccaaaactgccaacggtcaagtcctttatatcttaagttaatctcctcgcgtgtactgtcagtaaccgtcctataacattaattaacactcctaattacggtttaaaaaaacacacctaaactgtacggttacctctgcagccctggccagaagaacagtgaaactgaagactgaagagattcgcggccggccggtcaaaagactgaccaaaccaaaccggcaatggccggtggatgcagaggaacagcgctagtagtatcgggaactgcgactctgccgatgcagcaagctattgacggttaaattagttagggaatgcttgcacagtcaaaccctacaagagataggcagatgaagttgatagctagccaccttgcaatgctttgttccatagtttcaggaaaagaaatataatttctgataatgaatttggacaagcttgaaagtttgaacgggtcgttttatcctttgtcaaatgactcaactgtcgtggctagattggacacttgtttcttccgtggttactgttttttgaaacggattttcttgtttgaagagagtttttgaaggaaaatgtctgaagagaatgtgcctgtaattgttcagaacttcagataagaagtgtcagtctccagaagaagctgatgtaagaacttgtactagtactaatcgactggttggatgctagtggaaaaatcgctaggctaaaaccaagagtaattttcagatcacatctcctgtccactggacctgaactgcgtgtgaaaccaaaccacacccaagagcgatcggcagtcatacttattacagacagaatcacagaaatgaggagctgtgcactgtgctcgtgtcaaaaataccacattttatacaggagttcatgaaatctgcaagaggtgatccactgtgaagagacaaaaagtgaaattcgatcgtttgatgcagtgcaagggctgccgctttggtgaaccattgcatgcgctttaggggggcagcacaatatcgaaatgccgctgagctttttctgcaagtccaacaaagtagagtactacggtgtactactactcctccacttgtctattgcatttgcaggtttttgcagcacgcttcataggcattcgcgtctgcttgcgagagtgcagagacacagtgtggtcactctcagagcatattataatcttatgtagaggagagaggtagaacaaagtcaaaggggttggctctcatgcaagagctagtttaacataatctccaagacaaatgcattaaatgtataagtgagaaatagagagaggaaaaaaaaattgtagctaaccttacagctaatctatctattatataattaaaggaatagaaaaaggagccttcacgttcgctttcatggcttagaaattctcacattaatcagagaaaaagaaaaaacagagtccatatagaaatacaatttagaaatagctaaaatctggaattaaaaattaaaaaataaggaatattagaagaggagactagagtccatatagaaatacactttagaaatagttgaaattcggaattaaaaaataaggaatattataagaagagtatagagtccatatagaaatacaattaggaaataatagaaattcggaactaaaaataaggaatattagaagtagagtatagagtccatatagaaatacaattaggaaataatagaaattttgaattaaaaataaggaatattagaagtagagtatagagtccatatagaaatataattaagaaaaaaaatagaaatttcggaattaaaaaataagaaatattagaagtagagtatagagtccttataggaatttaaaactaactaaaattcagaaaaaaaaggagcctccacgttcgctctcatgacctagaaattctcacattaatcagagaaaaagaaaa

SEQ ID NO: 43047 - DNA, 3988 bp, Oryza sativa
atattttaataatataatgagaaaaatatgtgctattatatgagagaaaatataatgatgctagccgcgcaatctgcgcgggccaccatgctagtttattatatatgttagctttaagatgagctaatagtaagaaatgatctatactattatccttgctctcatcactgaagtcaaaagctacatgcacgcactgatctgcgagcaatgtccaggaatcatgccactgatccatcgggttaatcgtacttaagtcttatctaaaattccaggtcgtactgtactactactactactttgctgttctgtggacagtaatacctggagcagtcagcagatcaccatgggaaaaaaaacagttcatccaactaatttaaccaattggcaagttgggagacttgataatcataaatttatcttgaaaaagaaatgatgttttctagcttagatcagcagcctaagctgatgtagtagaaggctgcggcgtgttcttaccggcgagcacagcctcgccgttgaaatcaacggccgggcaattctcaggtagagccacaccgatctattatactccttccgtcccaaaaaaatcaacctgaacgaaaatatgatctctttacaatgaatctacacagaagtcacatgttagttttttttttacgaaggaagtaagtttttaattgtcacgcaaggttagttccacctcgcgcgaccgcaagcgagtcgtcccgtgagccgccgtcgccatcgtcctggtaagtcgtcggcgacggcaagtctctgccgctgatggtgcttgtcgcgcagtgcgacgcgacacgaagttagcatcagctgcagcgaaattgagaaacgggaacatgttttacataaccaaaccgatcagttcaacccatattgcgttatgggctggtccaagtgaagctcgtagtgatttcctttttttgggccaagaactcgacggctcgacaaatggatagttgggcccatctggtgaacgggctggtgctagagtactagtggaaatcttttttcgaaacttgtgagctaagaatcaaattcgtgtagtaaaggtctaacctcacaattgtccatggcagcataatgcataaccttacaagttattatccatagcacatcagttacattacatacagattttaggcctgttcactttgatgcaaaaaaaaaccttactaaattttagcaattgctaaaattttggcaacttgctaaaattttgataggattttttatatagttaccaaaatttgctagcaaaataaatgtagccacttttttttttgacaactttaccaaaatttagtaaggttgaaaatggcaccaaagtaaacaggccctttaaaccatatgttttaaggagtttaacgagatgaatcttatttctaactcgtgatgttaataggttgaaccaagctagctcgttaacttaacgactcttacgagttggctcgttagctatcgcgaccctggcagataacaacgccagcctggctggtcgtctacttgacgagtgatgatgagttgatggctgatgagggtaccacactaccacagtccaaatcagggccgtggaatgcactctccattttggccgctctagccagaagaaaatcggaaatcggccgggacagacaaactccatcaccaagtgccgctcgtggcggccgtgggttccgcacttccgctgcatgcctgtatgtcacgggtagcatgattcggctcacatcttctgtcattatgatattatcattatagctactgacacgtaaaacaatagaatattgagatccgcatatcagtgactataacgataataatattatggtaaatagtcatcaacctagctagtgtgtctctgtagcatttgaaacataattcatcacattattaatacaaatcatctacttagttatatataaaagtaattattttgaaaaaaaaataaaagttaacttaatagcttaaattaagcttagcttaatcgtctaaacaatggcaaacaatgtcacagagggaagctctctgataccgtatttctataaatacggagattctgcagtaacaatgtaatgagtaagttgaaaaaaagaacatgacacaaaacatggctaattagtatcctttcgttctagaatacaataactgatgaatatagataaatgcatatttaaattcgtaaataaaagcaagtaaaatagcaggttgtaattaagctaatgtcacgcccagaaattcacgaaccagaatttctaagctgaatgtgtattaaacccctgtccagaaccagccagggtacacaaacgacaattgttgacatacagatccacgtcttacaaaaatataaaagattacaaagcagcggaaaagataaaagcgagctaaaccgggaagcttgacttgagcagcggggcgactccattccacaggcaatccttgacggcagcgacggaaccaacctctctgagacggctccaactgagaagaacttcaactctgttgtgggggaaaagagagcaagactgagtactacccactgtactcagcaagtcataccggaagaggaggtatgatgcaggatataaccaaaggaggctacgaggttcatttgcataaagcaggcatttaaaaccagtagttgaaaacagtaaaaacagttgtagtaattaagtaatattaaccagtcactgtccaacgctacatcacgttgtaacaggcccaaccaaccacctgaactacaccagctcattaagctaaactagggggtgagactaatcacggtgaatctggtcgaccgcccataaccgcgggcacggctattcgaatagttttactctgatcagaggtgtacaactgtacccacaagacacagccccacgacacgttcccgtgcgccgacatgctaccacgacataccggaaagaggccgtgacaggacccttcgcataaccccctctaaccgatcgcaccacaccttagggttcgcccccgcccccagcaggcaacgggcagcccccctttcgtgccgcagtgaattcggaagccgatcaaccggacaccccggccgacccaactctatcacgcccaccctcgcctgggtacgtcggctagagaaaagctacactacaagtccagccgttgcccacgctggcttgtggtaagtacgataaattcttccagggtttcccgtgaaccggtccttaatcgccatgggcacaactagcaaaccatgcacccacagcccaccgtgcagtgtattttaataagccaacaccattacggtgccactaatccaaagctattgccaataatcaaagtctatgctttaatgagattccctttttgtgtactagtagaactaagcatggctaagcatttcctaaaccaacatctaatcattttgatacccaagttatcaatggcataaggtaaacaatgtatggctgagtaataggacccatcccacatgacattgtaaaagagtgcaacatttgatagaaatgcagggtgtttgtaaattgggtacaatatgatcaaatgtaaagcatgacttaccttgctctcgcactgatgagaccacaacaacttcttcgagaaaccgcggatcgacgaaacgaccgaaatctacgcgacaaacaaagcacacaagcaaagcaggctataagactactgaaacaggaaacaaaaccatttttaatggattctatgcatttttatgaatttaatgagacttgaatggacttaatcggagctcggatgaattagatataatttttagaagattatctgtgtttattactataacaaaaagtccttaaataatttatcgcgcaataaatcccagggctggcgtcatctaaggggggggcggctgcgccgacaggtgggccccgcttgtcagcggctcaagagagagagggggcgccggcacgtgggccccactggctgtggcacaatgcgggagggggtg

SEQ ID NO: 43048 - DNA, 5745 bp, Oryza sativa
acgagagagaggggaaaagggaggagaggggatcctcaccggcgagcacggcggccggcgcgaaggatgaaggcggcggcgatgacccaacgagcggaggggcagacgggcggcgattgcacctacggaggaaaatggagaggaattaggggttgggaggaagcccacggcagctagcgtggccggccggagatgggaagggcggcgaaattcaccggcgcacggagagagaggcgttccggcggcaggattggatggggatgcggcggccgaggtagctttggcggcggagaagctaacggcggcggcggattggctcggcggcggcgctagaggagatcggcgcgggcgcggtagaaggcatgcgagaacgcggcaaaaaagggaaaagggagagtgggacgcggggaagctttataggggctcgggaggggcggtcacggccgggaagccccccgatttggccggcgacgtgggggagggagagagagagagagaaagaaagagagagagagagagacggattcaaaaccgaatcccgccctctcgggccgcgcacgcggggcgggaaggcgtggggaagggagcggcgacgtgggcacggtgacgtggggcgagtggacgaggtggggcgccggcggtgcgggcggttggagctccggctccaacggtcggaggtaggagacgaccgacaggtgggccccacctgtcggcgcccgaaggagagagggagggagggaggactttggggaggggaggagaagcgggccggcgcgggaaggaatgggccgacggcccaagaaaaggaaaaaggaggaaaaagaaaagagaaaagggaaaaaggattttcccagggggatttaatattgcttgtgctcaattttaattggttaaaattatttccaaggctctgaaaattccactaaaaatcctgttagcatattttgacatgtagaacccaagaaaaattccacatgtccgctccgattattatttgcatttattaattaaggattcaactctaggttaattcaacaatttctttaggcgatttatttaacaaattttaaagctaaaaaggggaacttcagggcgtgacagctaaccacaagcacatgtcactattacaaaacatcaaatagatgccaacactatagatgtcggaagtgataaaactggcacctgtagtgtctttctcacccactcacccttgagcctgccaaaatgctatagtttttaatatattgcatgtgtagagagaagaaaaacatgctacagtttttaatatattgcatgtgtatgatagataggtcaagtattaatggtataatacatatctatacgaaactatgtacatataggctattaaattagctgtagatttttttagagctagtggttgactactcctattcatcccaaaatataaaggatttttattggattttacacattctaacttcttcagactcgtggaatagaatgttatcatattcacttaaaatactttatattttgagacataaaatatagttttaaaacttactctgagttgctgctatctatgtcctaaaatcattgtaattctaagttatttagtataactaaggtttgaggagaaaaactacgatgcacctcgttatgttgtatactcgttccgtcccaaaaaaaagacaaccttgtaatatgatgggatatatctatccagattcgttgtactaagatgtattacatcctaatacgatgttggctttttttttacggaggaaataggtaagagtaggagggtggttaagagtaaaatgtgaaaaaaaattgaatgagaagtgattgatagaacaattagtaatatatggtaacaattattttttagataatttttttggagaaaaggcgcaaagcgcccaactttttactagaaatcatatgagttcatacaacaataaacaaaataaacgcgaaaaggctggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcgagaggagcaatggtggcgcccggcggcggaggaggaggggcggcgtcgtggccgtcggagggggaggtaaggtgccccgccccagtggcattggtcgctctcgtagagcggtgcgggtgttccgatcccgcgcggccccgtagatttttcgcgtttctgcttcagtgctttgtttgatttggggggcgaatgcttgcggggctggggatcgcgacttctccggcgaaatattgctgcgccggcggcagcaccggcggggcggtgaccccccgtggccatcgatcgatggcggcgtcacagtgtagtagaattacctgctttcccactgcttggttggtggtcaatctacatctaattaccatgtttgcaaaaacattcaaatatgcacctcttttattattattgttgttgttgttgttgttgttgttatttggaaaggaatcgattttagtttttcagtttggtagagtggtggtgcataataaaagagaggaaagtatggattggcagtacacgtgagatggtaatgttagctcgaattgatgtggcaaccatggtccatggatgctagcacttattgagaattgatgtgaattttgggataagataatgtggtacctttgcttgtgctttctgatgatgtgtcgaagagggaaggggtggatgtgcactatgcttttggactatgtagtgatgtggatggcttcaggatacgatacaatgtgctgtagttttcaaacagctgtatttttttttgacaagtcatctgctcccaactaaatctgaatcttttctggtgttccagcagcatgagaccatgtttagcccaatgagtcttgaagatagttctagccaaggagcaatgagtttttctcctatcagctcgagttttgatataaccaatctgacatgcggaatttaaattgctctagtgaaagttgcatggccttgaatatccttttattttcttttaactacattgttgaacttacacgttactatacatctatgataggagtagcttagagtactcaactaggttcatcctgttatgtatggtcatcttatccttctcaattgtttctgatgatgcagcttgatgttgttcgagcaaaggtagtggagattagtggaaggggtgcaggagaggtcagggtggttgcttgcccctacaggatttgccctctgggggctcacatcgatcatcaggtaactttgtagatattatgtccttgatgttttcatttttcagaagagtgacccactgttaagactgttgtataaactgtatgtttgcaaattattttaatgtgttcttatattaaatttgtatatgtgtatagtcaggcagcaatgtaccataaatggcatgtgctttaatgtcatatcgtcgccgcataaatgtgacataattggactgttctatacatgtgtggaatgagttgatgagaccttgatgattttcagggggagtgttaagtacttgacaataaacctagctataagaattttcctctgcaaatgttggaaatatattagcactagcatagtggtggtgatttttcctacaaatagaataaagctcccacttgggtttgtatttggagagtctttggattaagtctgtaaacctgagtttatttgagttacaaagcagatccatcaatattggtggaattcaatttctctttatttctgagcagcacacgtagtaattctttaaaagggtggaagttgcataaactgctaatttacttagtttcgtgggaataaattttcaggtcataacatattaaatcagtcagcagtaagagaaaagttctgtatattggatcatcaccatctctaactgactagaatcaacacaaacatccttgcagtaactattttttttaccagttcttaacctgttgttggcggtatctaccttaggttatactctacctaaggtaatgaattagttttatcatttcaaaaattgctggataccctctaatgttaaataattcacttcaaggagagctatattagttgggtatttatggaaatgtgttcccatgaacaccttattgttacaaatatcatgggttgacttcaattcaaaagaacctctgcaagggatatggtggttggctaacttctattctgttctgcattacggcagggtggaactgtcacagctatgaccattaattatggtgtacttctcggttttgtggcctctgatgatgccgaggtgagttattgtgcttaaacacttttatctgtatgctcccctgaaattccaagttaagttctttgtgccaaaataacataccat

SEQ ID NO: 43049 - DNA, 6349 bp, Oryza sativa
ctaccttttctgaatatacatcaatcagaacatattgtctccattcaaatgataatttctacacgctgactcactcacattatccatcctgtcataaaaaaatatgcttatatataacactggtaatcctctggtttgttttacagatttcactccaatctggtcaattcgaaggtgtgatacgattcaggtatgtttgcggttgcaccatgttttggtgttcttggttaacatcaaatagcatagccagctgattcatccatgcgcaactttgacaaaatgcactttttttttcaaatctctgttagccttttttttttttccaatagacgtgctgcctcacctatttctcattgttctgttcaccctttttgttatagctgtgtttccatcactaaatcctcgctttgttaaattagacgacactcgtttacgtgtttcaccacttcaacagagttgatgacttgcaaaagcccattgaaaacccagaaaacataaactgggagagctatgcaagaggtgctgtttatgccctgcaaaattttggatatgatctcaagaaggtgacttttacatttaataattcaaagtccagaatatcttatgctttaaataatattgacagatgacttcttgtagggtattataggatatatttctggtgtgaaaggacttgacagttcagggctcagttcatctgcagcagtaagctaactgatatgtcatgtatatttgagttaaaattgctggcacaatcatctgtaatatgtagaaaactggaaatatgagtttagtgccaacctagttgtgaatcgaatatgcagtatttcataatcatgacatatacttggctcacatttgacttggagttcaaagcaaatttgtgaagctactaactttgtactagtatcttctaaaccttcagctcaccataacaaggacagaaacttccagttcttactctaggttctcaaaagaattattaatataattgatactttggttagttatgtgatcatcaaatgcctatttctgtatgctcctcatcaggtcgggattgcctatttgatggctttagaaaatgtgaatgatctggttgtatcaccagtggacaacattcagttggacaagtgagtttgtttccttttagtaagcattccatgtggactaacattatgaattcatacatgggatccagaacagttctaatttcaagtatctatgttgaagtccccacaactatctactattgccatgttctaaagcaacaatcaaatattgctacataagatttattagctcattgagtcatggtcactagcagagttcttaatttcatatccctatttgtcaggtccatcgaaaataaatatttgggtcttgaaaatggtattctggatccatcagctattttgctctcacggtatggctatctcaccttcatggactgcaaggtagtactttcccttgtattttctgaaagtctactattttagtaatatattcagtatgacttctgttttttcaaagttttgagactggtatatcattttttctgtaaaaaaggcttttttttattcacacaagttcattttttatgatattgcattgggtccatataattatttcaatccttctcgacaattctttctttgttttgtggtttcattgcgcatagttttagaaaatgtgcacttcaatgctctctgttagcatttatagtgactgagactctctttgcttgagtagaccgccacacattcctacgtctacttctcagtgttgagtaaaagtcagcaatgtcaaggagaactaccattcaagattttgttagccttttcagggctgcaacataacctaccgaagaagagtggatataatacgcgagtttttgagtgcaaagaggctgcccgtgctcttttatggtgagctttgtttgagtataacaaattctgtcaggcaaatatgcatcttgttcagtttgcagattcgtctatgatggatgttggcagattttttgttcagaacatacccaatttcaattatcattttgttgtttgaattcccagtgcttcaggctgtgaagatgcatcaagtattcttcgtaatggtaaactatttatatgtactttttgttatgaccaactctaaaatttaaggttgataccattttgttttcttctaacacagttaacccagccatatacgaggctcagaaggttgtcatttgaattctctctcttaaaatattttcttacttgtaccatattttgaatctgaatacattccatcacactcttttcttgcagtgtatattagaagaaaatctcgctaggagagctgagcactacttctctgagatgaagcgagttgtcaagggtgagcacaaccaaatatttttccgtgcgctcttttagtatttggtccactcatttaaatttctactcgatgcatatgtactttcatgaacacaaatagcaaattacgtaataattagcgattgtactacttgctgtagaccttacatcatgaagaactatatttgcacacttctgctacctctattgtctccatagatgaactgcctttactactaaaatttggcattcgttgtgacttaacttaaagccatatatgcaaaagaaagaggcaagattatgatattctttcttgtgttccaatacgcacgaggaatcaacatattgagttgtcatcttaggaatcaaaatgcttagtagagtacatatattcttcgaacctgcatctttaccaaatttgaactgaaagtgcaatgacatattatagtataacaatatccggatactctgtgttcaggaagagatgcgtgggctcgtggagatcttcgtgagtttggccagctgatctctgcatctggtcgcagctccatactgaactatgaatgcggtatgtcgatcgcacgttagacatctgagataataaccatcactaaaaactcaatggctgcttgctctcacaaattggcagggagcaaggagatgatccagctgtacgagatcctcctcaaggcacccggcgtcctcggcgcgcggttcagcggcgccggcttcagaggctgctgcctcgccgtcgtggagagcggccacgcggaggcggcggcggcgttcgtccgggccgagtacgagaaggcgcagccggagctggtgagcaagatcccgccgggccgccgcgtgctggtctgcgagcccggtgacggcgcccgcgtcatatagctcaccgcccaccgccgttctgccggtctcgccggagcagcctcgcattgccgtgcccggcgcgccgcgaaggcggtggcgtcgtggcgacgccggcgtgcaaggatggacggtggtcgcttgggcctcggcgcggcgagctcccccggtttacgcgtacggagcttggctagttccagttgagacttgagagtgggtgtaatggtaatggtataggtacgaactgtccgtgtgtatacgggtacagactacagagtgccagcttttgtccgtgtatgtgtagaaccaattgatgatcaatttttgataaatatctcagcaataagcagcgacgtagatatgtactattacatgatgactacgattgcattgcaccgatgatgaaaaggcgttatcgttcttgccactaatttgatggtgcacttgttatttttcagtccatatttctttcgcgaggattttttttcagttggtattcccaaacatgttccatggtcagaacgtaataagcagagaaaaaattgatagcgcataagcccaacgtgagatgatagcgcataagcttagcccaccaatgttacaagcaaagggttagaaatctggaatagaggggctgagacatggtagtttggaaacataggaaaagtccaacttatgtttcttaactactccctccgttccccgttacagaatataaagatttttaaggttgaacacatgtattaataaaatagatagaattaaatagaagaatgttgtgattggttgaaaagtggaggtaggtgagaaaattaaatgatggaggattgtgatttattaagaagagaacgttgatgaacaagttgttatattttaggataaaccttgagggctaaaagttgtgaaggagcatgaaactaaggtataacacggaataaaatttgaaaatatctatttttttataaaaaaattacgtttacatacgctagagtgaagaatttgtgaaaatatccctaatccgcgggtcggttccgcgggagcgcaactaaagcacgaggtggcggcgccgagcagacggccgaggcgctcgcgcggaacgaggctgcgggaccagagccgggaacgcggaaccggctcacttccgcagcgctggcgtgcggaaccgtggcaccagcatatttttactacgtgacactgtacccgacactgtttcggtactgttttacacaattccagtctccgttccgcacaatggagacgcggcaccagcgcatgaacagttccaaacagcccttgaacagtatcaaaacggtgtacaaacagtactacgcagtgccgaaatggctggccaccgcggttctgcgttttggcgccacgggaccgtcgcggttccacgttttggagctgcgggaacttgatggtctcgcggtcgtcccacgggatcgtcgctcccgtgttttgaatctgcggaaccgccgtggtcccgcatttttatttcgcgggacgggtatatttttgcacaatcttttcattcatgtatataaatataaattattgaaaaaaataagtatatttgcaaatttttttcgtataacacattccttatattttaaaatcagtacaaatgtagtactaacgaggtaatgatatgactggtagagatttgaccaaccacgtgtactcctaactcctagttggcactaaaaaaagagagaaatgaaaaaaaaaatgagtagagggatggagagctcaccgttgggagcgccggcctgcaatagtgtatttgatgtatcgcaatctatgtactatgtgttaattttatcataaaaccacgctaatgatctaaactcgaaagtcatcgttttgcgatatcttgccttaaatattttgtttcatgataaatttggttataaatttatagttccatgatacactttctcaagttttttttcacaacggttttgtataagttttttgggaatatggaaggaccgcatcttcgtattaagggggaaaaaaactttatttacatctaaaattcaataagtgaagaagacgggatacagaaatacagagatcacttaaaatctattctccggtccattgttgcgacctttcctctgtggattgtaacacaaactctggaacagccgatctggctaaccgctagagctctgccttagcggccattgcccttaccacctccacctaggttttctgctgctgattgaagactctattgtttctctccttccaacgtccatgtgactagaggtttaatataagtatttgtagttttgtaaaatttatttaaaattttacgtctaagttctgctaatttgtgctaaccaaccaatcagcactgctaatcaaatgcagcattattctagagcaatgattgcattaacgaagggagtctaagcaaggcaggttatcagagctgatcgatcggttggttagcacatgttggtgtaaatatgtattgtaccaaggacctatctgtaaagtgttatgctaatagaatagatgaggaaggggtgagctgagtaggctaaccctagaaaaattccccaaattgaataatatggtatcagagcgggtcgccggcgactggggaggttgaaccctagctggcgaggtcgcagcggcgcggcgcagcggcgcgggcgaggagaggttggcgcggcgcgacgacgcacgcgcgaggccagcgtggccgcacgcggcggagacggttggtggccgcggcaggaagcggcgctgtgccggcgcaggacgacagcgctgctaaggcgggacgtggagtgaggaagcgacggtgtcgacggcagggagcaccaacggcgacgacgcgtgcagagggctagctggtgacggcgtgtggcagaggagcaggttgttgctgctgctggtgaggtgttggtgctgctgctacttgagaaggtgaagtgggcgcttggcttgctgttgctgctgtatttgctgctgctgtgctgatttggggaagaaactgagtacttgctgctgtgctgaaaactgagaagtagtgctattgctgctgttctgttttggtgagaaactgaggagtagtgttgttgctcctattagttgatttggct

SEQ ID NO: 43050 - DNA, 2684 bp, Oryza sativa
cagaagaacaagaccaatgagagctctaacaccaccactcactttggtaacttcgccaactacgcccaagtgggcgaaggtactcaggcacaggcacttgcatctacatatagacatcctatagattggatcatagactcaggagcatcaaagcatgtcacaggattgcataatactttcacatcatacaccccttatatccactctaaaactatccaaatcgctgatggtacatccaagcctattcatggtatagggtcggtagagtgcacatcatcaatgaacttgtcttctgttctgcatgttccttcctttccagttaaccttctctcagttagctcggctattgatcaactcaagtgcattgttgtatttgatgagaagtcttgtctgttccaggagaaggggactaggaggaggattgggactggagtcaggcgtgatgggttgtggtacatcaatcatgaggaactgggactagctgcggtggttggagatgttgagaaggagatcagtttgcttcactgtcagttaggacatccatcttttgagattttgagtaagttgtatccagacctctttagtagagtggataagcatagattggtgtgtgatgcttgtgagcttggcaaacatactcgctctacatatgttggaattggtcttcgtaactgtgagcccttcatattaatacattctgatgtttggggaccatgcccagttacttctgtgagtggtttcaagtggtttgtcacctttattgattgtcacactcgtatgacttggatttatatgcttaaacacaaaagtgaggtccttcgttgcttccaagactttcataaattagtgacaactcagtttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagtatctatggagtgaggctgtgatgacagcagcatatcttatcaatcgcatgccttccagaatacttggtatgaagtctcctgccgaactgttattgggtaagcgagagttcaaggttcctccaaaggtgtttggctgtgtttgttttgtgcgagatcaccgaccttctgttggcaagttagatcctcatgcagtaaagtgtgtgtttgttggctatgcttcgagtcagaaggggtataaatgttgggatcccattgagagaagactgtttgtgagtatggatgtgacatttcgtgagtttgagccctattataaaagtaaaggagatcttgaccaatttcttgaggaattctcgactgtcatggaggttgatagtcgagagggggagagagagagagaggtgacatacatgaaaaaaatgttggtgacaagaatggagaggcaatagtgattggatcaataccatgttctattgatgatgcgagtaaagaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctagtttaccaaaggaggcggtttgatagtcagggggagaaaagaaaagggttagtgcaaagtcaaattgaagagttaccacacccaaaatgtccagtccctgaatcctcccagagtctctctcctccagcctccttggcttctcttgagacaattggtaatacttctccaactcttgaacatgtagaattacctcttgcacaacgtagagagactagatccaatgctggtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgcaatgaaagaagagttgaatgaccttgtgaagaataagacttgggaacttgtaaaacttccaccagaaaaaagggcagtgggatgtaagtgggtctttacagtgaagcaaacccctgaagggaaggtggataggtataaagcaaggttagttgcaaaaggctacagtcaaacatatggaattgactatgatgagacatttgcaccggtggcaaaaatgggtacagtgagagctttggtatcttgtgcggtgaactttgggtggccccttcatcagcttgatgtgaaaaatgcatttctccatggtgatttacatgaggaggtctacatggagatccctccaggatttgggaatagctagacagttggaaaagtatgtaaactcaagaaatccttgtatgggttgacactacaccggactaggtcatctctgacgggcccaaaccctcacctttgacgggtttggtcttggtcagtgattagtggtcactgatgacaaaatcacctgtgacggatgaaacacccgtcacagataacccatctctgaccggtgtataagtcatctctgacgggttaaaacttgtcaccc

SEQ ID NO: 43051 - DNA, 16528 bp, Oryza sativa
catcactacctacaaattcacaatttttcacgcaatataacttgtatgctacaagtgagattcgaactcaagacctcaacctccatatagagctcccttaccaactcacctacttaacacatattgactactaacccaatgttattattttgtctatgcttgtctgaatcatttaacatatatttaacaccctaaataacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatctgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgacttatctttgacgagttgcgttggcccgtcacagatgacccgtcactgaagcccggatttgtagtagtgtgaagcagtctccacgtgtatggtttgataggttcaggcatgcagtgtgtgatatggggtattctcagtgtaatggagatcacactgtcttttacaaacatagggggacacacatcaccatcttggctgtgtatgttgatgatatagtgatcactggtgatgatgtagaagaaatcaggtgtctaaaggaaaggctgggaaaggcatttgaggtgaaggatcttggtcctcttcgctacttccttggaattgaaattgctcgttcatcaaaggggattgttctctctcagaggaagtatgttttggatctgttgacagatacaggaatgcttgggtgtcgtgcaagtactacgcctattgataggaatcaccaattgtgtgctcaatcaggtgatcccgttgataaggaagcataccaaagactggtgggacgcttgatctatctttgccatacaagacctgatatttcctatgcggttagtgttgtgagtaggtatatgcatgatcctcgaactggtcacttggatgttgttcataagattctcagatatctaaaagggactcctggaaagggattgtggtttatgaagaatgggcatctaaatgtggaaggatattgtgatgctgattgggcgagtagtatggatgatagaagatctacatcaggttattatgtgtttgttggtggtaatcttgtttcttggcgaagcaagaagcaggcagtggtggctcggtctaccgcagaagcagaatacagagctatggctttgagcttgagtgagatgttgtggatgaggagcttgttcactgaattacgagtgctaagaagtgacactgtgatgcttcattgtgacaatagatcagccatcagcattgcaaacaaccctgttcagcatgatcgcactaaacatgtggagattgataggttcttcattaaggagaagattaatagcggggtgcttaggttggagtatattaagtcatgtgaacagctagctgattatctaacaaaggggttaggtcctagtgagattcaatcaatatgtaacaagatgggtatgattgatatctttttcccatcttgagggagagtgttggtgtaaatatgtattgtaccaaggacctatctgtaaagtgttatgctaatagaatagatgaggaaggggtgagctgagtaggctaaccctaaaaaaattccccaaattgaacaatagcaaaaatcagccgtacaacctgaccatgtgagtggttccttggatcggtataatcctctgcctgacaggcgacatttggatcagtcaacaaagtgcatcattgcactgggaaaacgctgcattattggacgcaactagtggagaggaaccaatcagctgctcgaattctcgtcctataattcatttttaagataatggattaagaaactcggcctctacattcatgagagaatgcacacagccaatctcgtgatctcatcctataatttggctgcgtcattgaaagaatcatatgaaaacgtcgattttgtacgtaggatgctaccaacaggggattgcacgaagaattaaagttagcaagatgttcgtatttagtccctactatatttatgtggtttgcttttcgtctctattatcactatttatcagacagaactcaccccttaatctatcaaaaccatctgaataatggtttttactacttaccagaataatccaaaactctaccttgcaacgttagtagaagaagcagtaaagacaagtacactagcttatacatggccggtttggaataaactgctctctcttttactgatcgacagatcgagtattcagttacaccattcgatccaataattcagggaaaaactggaaataagtaggagacagttgcagcagtttaatcagctcgagacggcatgcatctgcatataccatccaagctaatactagtagaaagtacgtacaacggacttacggacacgtactgtgtactaccatacgcgtcctttcaagttcagaaaggacactgaatttctgatcaacggtccatgcatgatgcatccccgattacaatttacaaatatgcaacacattccatgcaatccagtcattataatgttcgataatcaaaacaatcattttcgcctatttttcctggaaaaacttctattaaaagttgaggtcagagcatcagcaacttgtcgattgcaagtgcccggccaagaagggtagaataatcgtcagaatcttcagttagctgatcctgatcataattcataccgtattcataatagaataagtaccttgaagaaacagcgatcgagcattcgagccggtccaggtgaagctaggctaatcatgtgagtattgcataagcagattggaagagaagcagcagcagcagtggcgacatttgtcaggttcgttatggttgggtagccacgcgaagttgtgtactttgtgtacggactctacactaggcaatcattagtggtccaggtcagaaaactgaaaaaattaatatggtcatcggtggcgtacttagctcattaactatgatataatgttcatcattggtagtaatctaaatcactggagaaatcagctgagaaaatccgtaataaatttgctattcgtatgattttagtaagagcaagtttaaatagtatagtcaattgttagatccaaatcagtttaatatccaattcatacaataattacctataaacatatacaacactattaatgtctggtcccacttgtcatatatacattgcgtcttagagtctgtactgcagctgactacaaatctgtagtccgctactcatctcttccctcttttatctcgatatgtgttcatagctgacttataatctgttgttgtagctgctccaaccgacttgtgctttggaacggaggaagggggtgtttagatccactggcaaatcttttttccctgtcatatcgaacgttgaacacatgtacggagtattaaatattgaaaaaaaaactaattacacaatttgcgtgtaaaatgcgagacgcatcttttaagcttaattgtgtcatgatcagacaatgtggtgctacagtaaacatttgctaatgacggattaattaggcttaacaaattcgtctcgcagtttacatgcggattatataatttgttttgttattagtctacgtttaatacttcaaatgtatgtccgtatatttgatgtgacctgacaattttttttgccagtgaaactaaacacaaccgaactgtctctgatacctacagcttccgggcgcagtaaaagccctcctccgcacgccggcggcggctgcatcgatctcctccacttgagacttgagagcagtggcggatccaccatggggtctatggggtctcgagctcccactacctgtgttgtaatcatgggagtccccataaagaccccactaaaattttctgccatacattcattagaagagggggctataaatttatatagtttgtttaaactctcctattaatcctcctagatccgccccttcttgagagagatggcaacgacttcaatttggaggtgccagcaccacaggcccacagcttagttggttttgctggccactcgcctccccattagatttcaacctaataatacaagaaaacgatgtcctcactaaagactaaactctagctactgtcatagtacatacgtaccgatcaacacctctgttatatattcatcgtatactttatacaattattggagctattagcacactatcagtcgccgtctcaagtctcaacagaccaaattatcaaagcgtcgacgctgaattctttgtggtaataattgctggtggtatcgcatccgtattggtgggacaatatctagtgttagtctaagcacaattagcagtatagtatatgaatgtgtaatgtggatagctagacagatggaaaacaaaccgtcctttgatgtatactctagatcactaatcccagacgtaaagaagaacggcaagcttatgaaaacacgcagaattccagaaaagtttttcttttgtgtgcaatggctacttggctagtggcgcgcatattgattgatcgtattgtagctagatcccattatatggtcctacttgtactatgtccagtagttacccagtcgataccaacgggacccgcgatgtcgtatctcgtatgtgttccaactggcatgacatgattattggaagcgacttctgctatgttggtcaccacttcaccagatactcctcccgtctcgaaaagaaacaacgattgacttgattcgtaccgcgaatttaaaccttgttctttttttagacggagtaagtaggcaattccgcaattaaattagctgagcagtgcactgcgtgcatacacttatgtcttccgcatgcgaaaacaaaaatcacaaaaataatataaaattccccaaaatcaaaacctgaaaccatacccccccccctcctgctccatcgccggcggtggccgatcccatgcccaccagccgtcggaggccgagcctgtcgccggacccactgcagctgctcctgccgtcatgctagatcaccccgctgcctccggatccacgtgcgcactcgctgggatgggggaagggggtggagtggcggcccaatctgcgtgggagggagaggggatgccggatctcaccgttgccacgcctcccgcctcctgcctcccgcccgcccaccgccctgcactgatggagaaaccctttgtagtcccggttcgtaacccccctttagtcccggtttccaaaccgagactaccaatccgggactaaagatcgctatctttagtcccgggtgaaataaccggaactaaagatcaatctttagtcccggttggtaaccccaactgggactaaagatggctcagccgtcccggttggtgttaccaaccgggactaaagatcgagctgacctttttttttcatggccctgttgctgcatggtttatatatatataaaccatgcatatatatgtttcagtacatatatgcatatataatatatgcatatatatattatattatatttatatatgtttcaatacatatgtacatgcataatatatatgtatttatacatatatatgttatgcaaatgcatctgtgtgtgtatgaccaaaatatatttacattatagaaaatgtgtacacatgcatatagaaacatatgtagtcatgtattaattacaatccattatatgtcctagctagctacgatttcgatgtagtagtcgctagctcacaagctaaggacctatgaattgtgtttccgtcgtagtagaattcacccttgggatcaaagatttgttcgttgatgaatccaaatgacggaaccgataccaagccctacatggagtttaaagctatgattcgtagtagcaattaacataacaagattttcttaattaacagaggaacttatgacggtacctatctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtagggcaacagtatgaacatcttgtaatgctgcaccttcaggagatggacgagattgtcctctgtggcttgcggatattggtcgagcattgcgacgtttactttccgagggtcgatgaatccagtatcgaaaactccccgccgtcgggccttttgaatctccattctacaacgataaaagggagtatattattttctatagtctacttatatacaaggacctaattaattaaaggagacgtattaagaaatctaactgaacgatatacttacaaaatccagcaactcataatagagacgtcgagggcatccagttggtatagttcgtagattcccttgaaattgatccagagaatgtcatctccttgcaagaagtccatgtccctgatcctcgctccgatcatctctctaccagtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcactaacggctcaatctcctggtttggttgctctccaagctgagggactggtttggactttccagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctgatgccatgtaagcgtcaagctcctcttgcgtgcaatcgtaccccgggtccttgttcttggcggcgtcagctttcgccttcttcgttgcccttgtgtgggcaggcggtggagcttggggggcccttgactttgaaggtgccggaagaggagcttgcggaggagtcggtgtaggagctcgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagcttgaggtccacgtacgttccttcgaccaactcaacttcgaccttggagtatcctgctggaatcggcctgcagtggtaagtacctgaagggtccgttgggatggctatgcccgacgccaccttcatgtggtgagaggttatttattagtaatcaacatatataagcaacaactagcggaatgggcaaatctaaaatatataaactacgagcttacctttattgataagttcttgaaaggaatatgcagctcacatggtgtccgttgagtgatgtcatcaacggggcaggtggattcgtcctgggtttgcatggcgtccatgctctgtgatcctacctgccccgttgaggcgcagctgctacggtttcctgacgggctcaccattgcaggaggaatggtcggctagggatcattggaccgatgtgcggccatgcgttcatcaaccttccttgccacctcctcttgcatgctgagctcgtagctcgataccctgaactcaagatctgcaatcttcgcctcggtatctctcttgctcctcatccgactcttgtacgtgtggatgtcctccttgaacctaatcttccaaggaatcacccctttccctcgtgttcatcctggatgctctggagtctgcagggcgagtgacagctcgtccctctctctatctggtcggaacgtgccctgagaagaggcttccactgcgtctgttagtcgacgcgcagcctctcgtatctgatcgccgaagaccagtgagccatcagctgggttgagcgttccaccgtaagcatagtactagaacttcgatcgttccggccaattagcggtggccggttcgatacccctctcaagcaagctagcctccatctcctcccacttcggcatcacgacgctatagcggcctgaccccaagtggtgatggtacttcttcttggctgcattttctttgtttctttccatcatcgcctgcccttgttcactgtcttatatgcaacgaactcgtcccagtgatcccttagctttgggaatgtgtcgaagttcggtgtctgccccttcaggatatatttcttgtacagctctcccttgaaactctgaaactgttctgtcattttcttcagagtccactttttcactttgtcctctgtacccgcgggaagggtgaatgtctcgagcattgtggtccacagcatctctttctccgaatctaggacaaagctctcatgatctccgcgtgcccttgttcttcgccagtacaccgtactgacaggcacgttatcccgcacaacccaaccgctgtgacgtacatagttcttggcggcttctgccggggcactaggtcgtccatcttcttccacttccattacgatgtgccgaccctcaagcttcttcgcggcacctcattgcccacgtgccctcctctgtccaacggagggttgacttccactagcctcctcctcctggttcccctccacatccctttccacgtgctcctcctggttcccctccgcatctctctccacgttcccttcctcgttcaaatactggtttggatcctcgtttccctcttcttcgttccagtactggcttcttccctccgcgattgaatcgtacaatatctgttcatcattgcgatcagccatctgttcatacaggaaacatctgctaagtcatgagacatttatgttttaacaatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatgctaaatctaggtgacgtatattataggaccctagctagtcaataattatatactaagtctaattacaaatataataatcttatattaaaactcaaataatcttatatgctaagacaaaaatagccatgtatgctaagtgtaactgtcgtatattagaaccctacacaatcttacatgctaagtctaattacaaatctaataatcatatactaaaactcaaatagtgatatatatgctaagtctaggtgacgtatattataggaccctagctagtcaataattatatactaagtctaattacaaatataataatcttatattaaaactccaataatcttatactaaaactcaattagtcatgtattctaagtgtaactgtcgtatattagaacactacacaatcttatatgttaattaagtctaattataaatctaataatcttaattgcattacaaatataacaatcatatatatataattacgtcacttgcctgggcgaattccttcgagggctagctctaccactccggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattaacctgcctataattgcatttcacgttcacgttcgttggctcgttcacgttcgtccgacaacgttcttgttcacgttcattcaccttgttcttgttcacgttcattcaccttgttcttgttcacgttcgttctctcgttctcattcacgttcgttggctcgttcacgttcgttcgctcgttctcgttcacgttcattcaccttgttctcattcacgttcgttcgctcgttctcattcatgttcgttggctcgttcacgttcgttcgctcgttctcgttcacgttcattcaccttgttctcgttcatgttcgttcgctcattcgctcgttcacgttctcggtgtggcggcagcgggacggcggtgtggtggcagcggagcggcggcggcgtggcgccgcgcgcggcatcggcgtggcgcggcggcggcgtgcggcgtcgcggtgtctcgtggcgcggcgtcgtgtcgtgacgaggtcggcgtcggcgtctgaaactcggcggccggcggcaaccgagagggagagatagagatcgagatcggagagagagatcgagagggaggcggcgcgcggtggctctcaccccagagatgcggcggcggagaaggaggcagaggcggcggcgacgacgacgagcgcgagacgacggcgagatacggcggcggtgtcggcgcggggatgccctaggcagtggcggcgaaggagaagccgagagagatcgatcgggtaaaaacttctaagtgttggtggagaagacgagggcgcgcatcgggaatatatatagccctagatctttagtcccggttgttctcatcaaccgggactaaagatcttttcccgctatttccaaattctttttaaacccggttagggttaagaaccaggactactgataagcgcattgaatattattttccattacatatgtgtttctaaaatagaagataatgcattacaattatttaaagtacaaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacggcatgatttaaaattaataaaaattgtaatcatcatatatacttagcataggaattatattaaattaaattgttaaaaactctaattaacatatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcagttataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggttaatcgtcaccgtgaaagggggttgcccatccaactgatcgtaatcctcgtcagtcttgtcctcaactccgatgatttttcttttgcctgggagaaccacgtgacgcttaggctcgtcaggccctctacccttctttcctttgctagacatgtccttcatgaaaaagacttgtgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccagttgttccatcgtgtcccatggcatcgacacgaacagcgctgttttggttcgtgctcatcatgtcttgggctctcgtgtagaatgtgtacccattgatctcatatccctggaatgtcgcaatcaacccagacggtccccttgctaggaaggcaagttgttggttgatcgaatcgttacccatgagatgttgtcgtatccacgcggggaaagtatcaatgtgatgccgtgtaatccatgcatcggacttaccgatgttcctggcgtgaactagagccaagtgctcctcgatgtaaggagctaccaatgaagattgttgcagaaccgtgaaatgggctttacagaataaattgttgtctaccgtcattattgctttccttccgagagttccctttccccgtagtctcccttcatggcgtgattcaggtaccccgattgggcgaagatcttcgataaattctacgcaaaattcgatgacctcctctgttccataacccttggcgatgcttgcctctggacgagcacggttgcgaacatacttcttcagaacgcccatgtacctctcaaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggctaatctatccggatcgatgaccttctgcaaaattgcgttcatgaatgcacatagctttgttattgttgcccggacattgtctggaaggatagcccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgtcgcgttgttccatatgctttagatcattacgtgcttccagtgtatctttcgactttccgtatacacctagaagccaagaaggtttacgcaaaggttcttagtgaggtgcatcatgtcgattgcgtggcgtacgtccaagaattcccaatagggtaactcccaaaatatagagttctttttccacatcgccgcgtgaccattttcgctctctataggctggcttccaggcccctttccgaacactactttaagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgtttaagatacgtactttctgtttcatccatacagtgagtgcaagccttgtacccctttttggactgtccggataggttgctaagtgcaggccaatcgttgatggttacgaacagcagcgctcgtatgttaaactcctcctgtttatcctcgtcccacacggggacaccttccttcttccacaacagcctaagatcttcgaccagtggtcttaggtacacatcgatgttgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtctatgtttcgccactgcgaaccatcggcggggtgtctcagcatcccgtcctgttgacgctcttcagcgtgccatcgcatcattctagcattccccttgttcctgaacaaacgccttatccatggtattatagggaaataccacatcaccttagcagaaattctcttctttgttagctgcccgtcaacttctcctggatcgtctcgtctaatcttgtatcgtagtgctttgcaaacaaggcatgcttctaggttctcttactcctcaccgcgatataggatacaatcattcggacatgcatgaatcttctgaacttccagtcctagcaggcagactatcttcttagcctcgtacgttgtctcgggcaatttgtttccctccggaagaatgttcttgacgagttcaataaattgccaaatgccttgtcactaaccccattttttgccttccattgcaagaactccagagtggtatccaactttttgtgcccctgctcgcaacctgggtacaacgaagttctgtggtcctctaacatcttgtccaatttatgggcttccttttcactttcgcagtcctccttggcgtcctacaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagctttggccactctcaaaaaatagtgcacgccgtcaataaactctttggaccgccggtcagcgtacatccattgccgatccatctacatgagtcgaaaaaaaatcgtacaaaaataattattcttacaataatgacagtcatacaataattataagataattataaactgtttcaacagtcatacaataatgacatatctttattcatacaaaaatcataaaatattacaccaaataattcttatttactatttctaaagttttaaactaattttaatgtgttttacttcttttaattttaattttagtttgttttctagtattcaagattaactttcactatagttttccttctcaactattttataaaaccttctttagcaaatcaactaaatttctatatattctttcttccccacacaaattttctccctcatcaacttacaactaaattttggagacaaaaaagtgtgcaaaacatagctgcaaatgtaatatgacaaaaaaacattgaaggatgaagttgcaaaccttttaggcacctccgatttgtatgtaattaccaaaataaatttactagaaattttggcatgacctcccctcttttttgaagaaattttgaagcttgctcgggcagctggaggaggaagaagacatatatatatataggggtgggactttagcccggtgggctaaagatccccgagatcccaaccgggactaaagttacgatctttataccaaccgggactaaagttacgatctttagtctaaccgggactaaagatcccggagggcctgacaggccctgacagcatttgaaccgggactaaagatgatctttaccaaccgggactaaagatcaaatatgcccgttaccttttttaaccgggactaaagatcatctttagccccggtttttattgcatccgggactgttgtggaattcggccgatcgacgaaagatggcttctccaccaatgctcccgcccgccgcgttcttgccaggcggtggaggaggaggagctaatgagcctcccgcccgctgctgccgcacctcctacccaccgccggcacaccacccgcccgccagtggaggatgaagtgggagaggagagaaaaatgagtggggagagagataatgtgagagggtatgaaaaaatgaaaggtgac

SEQ ID NO: 43052 - DNA, 12004 bp, Oryza sativa
acgtcgattttaatagttacagtctgcatgtaatctatagacatcctcgtacgtaaaaaatcgtgttttctgcagcagtggtacgtactatgaaccgatcgaaaccaccgccatgtacgtacagcacgcgcgcgccacatgcatgcatgcccgccccggtcgccgtcgcccgtcgctgccggcgaaagaaagaaaccgtccgtgacaaacccaacccacgaggcggctaattctaccgatcgatcgaggggacgaccgaccaggcgaccagcagctagcagcagaggaaaacgatgcgagacgaccgtgcgaggctagctagctactagctccaacgaaagcggggtctctctagctgcgttcgcgcgcggtggccgcgccaccgctttcacgtacgtacgctccaccggtcgacggccagtcgcgtcgtgcacacgcgcgcgcgtgcgcgctttcatacgccatatatggatggaattttcggtggttggccggagcgtatgcacgtaccggcaatccacgcgtacgagcaacagaaagagagataaaatgtccagccgtcggagtcgaccccgactgatgctagcggtactcgtttttcgcgcgcgcgtgtgtggttgttgttggatttacggaaacagattctctacagtaaatataaaaggggaactatgtgaattgtgttttgtgtcttgtgcgctactgtgaaatgcaaaaaatcactatacaatacagtagatatactataccagggtccactataaattaatgtccacagctgatcggatggttgagattctcgacttaataccctatagccctctctgcactagatagtgtctacgtacgggttctctaatctctatcctgactagctataccgttggttggttatccctttcccgtactttgtgatcttctcatcattagacccatttgaatcgtgggaaaaaaacagaacagaaaaaaaatacagaattttgatgggaatacaagtgtaaaacagaaaaaaaaacacaataatagccgtttgattggaccatacgaaaaacacaggaattgggaaagatagactcaaagaaaattttaagaggttgaaactcttactaagttttttaaaaaatctatatgtaatgagccatttcataggaatttcatataatttgaaaagtctcaatcctttgaaaatcatttgattcaaagggactctaaatcctattgttactttgagaacttgaacaaagcaaaacactatttatgttttttaatatatgatgcggttaaattttatatacacatttaaccatttgtaatataaaaaataattatcatttattttattgtgagttgtcttatcactaagtttttaaaagtataatttatatcttttacatatttctatataatatttttaaataagtcgaatggtcaaatgtgtataaaaaaatcaataggaacatctattaaaaagcatagggagtaattagtttaagtaaaagcctaaggcaagaatgaataggatccaatcatacagaccaagtcgatctgttaactctcggccgtaggtcttaaaattttttaaaaagataaaatcctcaaaaacataggaaatttgtaggctaggttaaccacaaagctctgagtaccaagtatacatttttttttcaagacaatgttcagtgttctttgtctcgctttctaaggactaagaatattatggataatctttttggcggactggcatagagaattaggaatatttgagcacatattttccaatagcacaagtctttggaatatatgagcaaatatcatttatattctatttctttctgaaatgaattcttagggtttccacaatttccatgttttggatgtgcttttgtagctcttcaggaaaagaaatgcacatcattaaagatgatgagaggtctaaattaaaagatatctaacagactgatcgaatatcatcaaagaggaaatttctatataggaagaacatttttcaaaaagaaaatcttaatctttaggagttttaaaaatatgcatgccataatctagtagttagtagctaaaaaactgggccttagtttctatccatatattttaggttcaatcattagtacacaaattttaaatattgactttgcagaaaataaaaatgtcttatagctcagaacggagagagtaacgaaatactttatcattttttcttatttactctcttcgttctatattaattattatataaactttttagtcaagatcatgaaaaccttaacttccctatatttcacttaatatgactatgtgatggaaaaaatagaaacaagcatacttcaactttctcgcatgcataagaaacgagcatttgtaactgcatgcatgcatgtagactaaatttacatgcctagatacaataatgccacacttaaatgaaaggatgattatatatgataatcagtttagaaattctggttttgattatataataatcaatgtagaattgagggagtattactctattcgaaattggatgcgatcaaatggttagtggtacgtaggacgcgtggcctattttgttgctcagccatagctcccagcctcccacgtccgcacgactatatatagcgcggcagcacgatcgatcgccggagctcatccacaagctcgccgagccagccgttgcaccggccgcgccggagcgagcacacggcggccgcgtgcgtgctccaatatgcccacgtcgcggcgcgcgctcgccggcggcgctttgtccatgcacgtcgcctacttcctcgccatctcctgcctcggctacggcctcctcggggtgctcaaggtgcgggagcccggcgccgcgccgcgccgcatcgaccgcttcttcaccgccgtgtcggccgccacggtgtcgagcatgtccaccgtcgagatggaggtgttctccaacggccagctcgtggtgctcaccgtcctgatgctcctcggcggcgaggtgttcgtctcgctcgtggggctcgcgtccaagtggtccaagctgcggagcgacgccatggacagatcccggcgcgtcgagagccacggcgacgtcgcgctcgccgacatcgacggcggcgacgtcgagaacccgacgtcgtcgggagaggaggcggcgagccgacgccgcccgatggacgcggacacgctgcggcacaatgcggtgcgcgcgctgttctacatcgtgctcgccatcttcgcggtggtgcacgtcgtcggcgccgtggccgtcgcggcgtacgtgctcgcgtcgccgggcgcgaggcggacgctgggggacaagtcgctgaacacgtggacgttcgcggtgttcacgacggtgtcgacgttctccaactgcgggttcatgccgacgaacgagaacatggtggtgttcaagcgggacgcgccgctgcagctgctgctggtgccgcaggtgctggcggggaacacgctgttcgcgccgctgctggcggcgtgcgtgtgggcggcggcggcggcgacgcggcgggaggagctcgtggagatggcgagggaggggggcagggcggcggcggccgggtacgcgcacctgatgccggcgcggcggtgctggatgctggcggcgacggtggcggcgttcgtcgccgtgctgatggcgctggtgtgcggcatggagtggggcggggcgctgcaggggatgagcccgtgggagaaggtggtgaacgcgctgttcctcgccgtgaacgcccggcacaccggcgagtccaccgtcgacctctccatcctcgcgccggccatcctcgtgctcttcgtcctcatgatgtgagtgctctctgtttctctctctgacctaagctctctcagggtctcagctcttcaacctagctagtactccatctgtctcataagttttcgcttttactatttgaccacttgtcttattcaaaaaattttgtaattatttttttttgacttactttattatctaaagtattttaagcataacttttcgttttttatatttgcacaaatttttttgaataaaacgagtggtcaaacagtgcaagcaaaaactcaaaatcccttatattataggacggaggaagtacttgtttccaagcttcctgcattgtacactataatattctagaaccatagtcttttattactactatcctagcccaaaaatataataacatagaattagactaaatacattttaatactacgaatctggataaagtagtatagatttgtactacttaaatatgtcctgtcctttctatgctgttatattgtggacaaagggagtagctagtaggtacgcaaaccatttacatcatcacattaaaatgggaactagttttaccatgcatgttaactttactctccggacctctagaacatatgttttccttttcattagttctcctaccaattttgacattgttagtagcatgttttgcgattaaatcacaaactataaatacatagaaatgtttcgttgcaacatgcatatatgtggaggtgagccatgcatgcgacccataacaatgacacaatgccaatacctttgtcccaaagtgtattaggttgtgttcgttaccggtggttgaaagcaaatttctcatacatgaaaaatggaacggtctaatagcacttggttaattcggtattagctttaaaaacttaaaaattagattaattaatatgctcttttaaagtatttttttataaaaaccatactatttaacaatttaagaaacgtgcgtgcgaaaaacgtaagagtgttgcaaagaacgcaaccttattgcattgccgagtgtagtggcacttggcatcgatgtccttgagtgtaaaatgtcaggatctctcaggtggaaactgcaaaaccacttgaattattgagtaaaatatcggatggtcatatcataatgacaaattaaattacaagtactaatagtgaacgagtgatgataggagatgtaacggccggtggcaagtgggttctcttctgcaatggaatcttcttcggttcttcccttctccgtacgtaatagtcacggacaaaagcacatcaaaacactataaactcgtcaataattcttcgtatcctaattaatttgctcatcggccacagcaagaggacacatgtttcttttctgtggtaggacagtcccaacccataacactagacatggtttccataaactctacatcatcaagaagtactagacactactcttccaatgcaaacaccactatttcatacttcaatttaatgctacttatctcacatgatgtcttggatgttgtgtagaaaccatgtctctctttcctcatttattcacttgcatattattttttgtcctaagtagcaacttatttaatgctatggacatcatcctaattattgggttgagaatggccttaggtaggtagatgcatgtgatggagagtagtttcaaacgtcaaaacactgtcccatttcccagttcgtgaccataggtaggagttgaccgtgcgttgaccctttctcctagatttttgacagatttttttttatttttgccaaagaagaaaaggatagctctcctcctagcttcacagaaaccacaacgcagcacaccacttcaacttgcaagaacaccacaatcaatttgctgaaaggtaggagtattaatattccaagtctccattcaaaagcctgcatgcatcacatgccacaccttctgtcaacctgagaatatgctctccgcgttctcagcaaatctggtcacctgggaggttgatgactattacttctaattttgttcatgtcaaaatgggaggcgcatagttgctagaatttgttccaatctttggttcttccagatgattatggctcaattttcacatgcaattccataaaattcgccatctttccccagttgatgcatggagtacaaaatagtggagcacagtagtcgtcattcgtcaacttttgcagcctggtttaggaactgggatgtgtgcctctgaaaatgacctgcatggctaaagcagggtgatatctcctgccgattgtcgtagcgcgtgcaaaggaatttcttcaccggccagcagttgttcccatattgttctctcaaggccatatgcttgtgaatccaagcttccagtcagttgagccattgttttcatcttattgtcgcatcatttacagagaatataaccaagcaccagaatgttcttgcacgtcacctgaaagatcaaaccttagacaagcagagctgcaactccttccctgaattatttctcaataatgatctgcttttgaacatccgaagatgataatccacccaagggtgactttctgatcgcatttcgttaagcagctgcatcgacatgcatgcattttcaatgcccaaaataagcaactaatcactgaaactttaattggaaagattgctgcaaattaactgatgtctgtttaaactcgtaccgtttgttgtctcatattctgcttcatcttgcctccaggtatctacctccgtacacgacgtggttcccatttgaagagaattccactactaaggatagtaatgcagagaaccagggaatcagactgctcgagagtacacttttgtcacaactctcctacctgaccatctttgtcattgccatctgcatcaccgagagaagaaagctcaaagaagaccccctcaacttcagtgtgctaagcattgttgtcgaagttgtcaggcaagtcagactaaatggtttcttacctgagaaaaaaaatgcagaccaagtaaattaacaatttatctgatgaaaacagcaaaacacaaagtaacacttgtcaggtatttctgaatcttaataatacacaatgaaaatagtaatgttttctttcgtggaatctgacggatctgcccacatttgcagtgcatatggaaatgtggggttctcaatgggctacagttgcagtagacagatcaatccagaccatctctgcacagataaatggactggtttcgtagggagatggagcgactctggcaaactgatactcatttttgtgatgttctttgggaggctcaagaagttcagcatgaaaggaggcaaagcctggaaacttagttagatcttagatgcagtaccagctgaacattgcaggtccctgagggtaggaaaaaagtataaagatgtactctttctcttccgtttgtttgtatattcattttcacatagacaggaaccttccactgtcatccttgcacaaagctcaccctccactccaagtgttggcagtttcagatcaggtgaatgaaagttcatcacaagaaatcaacataggctaattaacctgattcacttcacatagagatgcttctgtcactggctccctgcaatgaccatttattgcatccatgtaatgctagtaaaaggccggatgtcattgtgatggctgcaatacttaaatacccacatgttaaaagatatgtagatgtctatcaagtggtgatcagttcatacagtacgtccagaagtactttcttctgaagcaagggcatctagaagaacctgagagctgagatcacaaagattgaaaaaacactagattgcttatcctagtcactacacttttctgatagaaattaaaaaggacacacgtgcaaccaagggtgcatcagtgaaaaaaagagagaataaaagggaaaagggaaagaaaatctccactacacattgtgcattctggtacacttgttcccactacagaagatgttgattatatagcaataaagcaaacaatctagtatttgtggaatctgaaagataaacctcagctacatacaaaaataaaacgaggtaacaaattgtaatctgttataataaatatataaatgttcaattaagtgaatgcaaaggaaaaccaaaattagccataactttgataccagaatcttcaacaatggactgaacagcaatatgcagtagtaaattcaaaataatggttactataactaaatttcagtatcatgatacacaggtgaattctattaggaaaacagggacaaatttgtagtccaaaactagttgcacatgcaacattactgatttcagctaaagaagaacacaactaattttttacaataccgtatgataataatagattaaaaaagagtgaattattgaggcagagcaggtttacgtgtgaagacaaacagctaatctaaattgaggatattcttatgactcaaaaaatgtgaatgaaggattctaattgctgacaatcatttcactcaagaacatatagtagttaggcattataatattctaagcacatgcttgtgcatacaccaatcatgcctgggttggggccctgtacacaccatcagcatcatgattctgcaaaatgggcacatctgtcttacaccatcctacatattaagatccagaacttggttgcagtgagcaatggtggcaaagacagaatcattgaaacctaagaaacaccttccagtagccaactccagcatactgaacactatgcccacaaacctccaatgatgcatccattcagttcaatcctagttacatcacagcatctgccattagccatgaaaatcccacagcccaagttccaagtggttagggacattacagagaaagttaagcacctccatgtgtttatctccatgaggcttcgttccctctccaaatgtgcagtgtgtttcttcagacgctgtttctggtttttcatgttccaaagcaatccattaatagttcaacttgtgtacttcatctcaatatcctttgttggtttccttgctctgaagatcctcaagccacgacacaagccaactccaagggacctggatttgatgttcacttctgtgtccacagcagcagtctcaagcatggcaacagtagagatggaagacttttctaaccagcaactctgggtgttaatacttctgatgatattgggaggagaagtatccatttcaatgctggcgctgcacttcaacaatgctgagaccaacacaaacgaagtcctcccaaaaagatcaccttcgacgagaaggaatattgaatcctttgatgctgtaaatgatagcaatcaaaatagttcacaaggcttccaatcagaagcaaccatatcacttaactgggtacagggaagcagaaccatgaaacagaagtgccgcaatatgttggctcatatagtgacaggctacttcatagcagctgttgtttgcagctccttagtcattattatttttgctcagattgactcagatacaagacaactcctgaagagtaaagatatcaaaatatggacgttttccatcttcacagcagtatcctcatttgcaaactgcggcttcaccccggtaaatgataacatggcaatattcagaaagaaatccagtctataacttctggttaccccacaggttctagcaggcaacactatattatcgccactattgaggttaagcatatggatcttgaggaaggttagcagaagagaagaatatgcctacatccttcagcatccagaggatactggctacaggtatttgcaattgcagaagaattcagtcaacatggttctcactgttggggggctagttctgctgcaagtgatgtttctttcctattttgagtggaactcaagtgccttaaatggaatgaactgatttgaaaagttggtttgctcattgttccagagtgtgaaactgtgaatacaaggcatgctggtgaagctgtcattgagtccaatactagttctatttgcacttgtcatgtaagtattccctataaacatttcataatatttattattttgaagcatttatcaggactttcagaattttatcataaatatggcacaatcaccatcagtaactgcaaaggataaattaagcacataatttcagaacgaaacaacataaacaattatgagcttaaaatcttcagatattttttggttgaaattgcttagttatcttaataaaggaacacaaaactagttcacttgttgaaggccagccttatgttctcgcaagagtttcagtttaaatgaagttctagataataacatggaagtatgaacactgtctcggtgagaaacatacttgtttactacagctaagtcagcaatttgtgtactcgaaaaagaaaaaaaagcagataaatgcatagaacaaaatcaaaacaaccataaaatcctgcactatgacagaggtcacaacatggcggagaagaacagattccacaatccagatagtcaattcatcaaaaaaatagaaaagcatgctagtacccacgtaaacttcaatgacaacatgccattaacttatttgcaggtactatccttctgataattcagctctccctatcaatgctgataacaagcctttgacagaacgaggaagaaattcaaatgatcaggccatatggaagaattttatcatttcaaagtctgcttgcttagcaatattcacaattatagcatgcataacagaaaggaagtcaatatctactgatccactaaatttcaacattttcagcatagcattcaaaattatcaggtaagttcacatccttatttctaggaaaaccctcaactatggcctaggaaataggaatgatttccatcccccaactttgaaaccattactaccctcaacaatggccttccaaattaactatgtgcatggaaaagaaatatgaagaaggtcagcataaaagaaaattatgtttgcaccttccaagcaatgatgcaaaattttctttcacagtgcatacgccaatgtgggatactcactaggctatagctgcgagaggttgctgaaacctgatgctacctgcaaagctacttcatatggttcgtcggcaagtggaccgacgaaggtaagctgatgataattttagtgatgttcctggggaggtttaaaaagttcaccctcacaggaggaaaatcttgaacgtccatgtaattaaacatcactacatcagtagggagtaaactgtacgatcacgagcattataagcaaaaaagtttgaaggtgtaaactgtaaatcaatcagttgatatcatcatatcaccctaagcatggggaaacgaaattcgtctcgatatccaattcctcggtaggaattcaatcgatattacatgaatgcgatgcgagagcctcgaatgggctaagcgagaatccattccgtgatcagttcaccgaggggaaaagtacgaggaacgcgtatcgtatcgcattacgcattgggatttgatttcgctagccattagcacgagagcaaaaacacgggcacccagatcagggaaatgcagagcatggaaagaggggaactaccaggagaagcgaggttgcagaggtggccggcggcgaggccgccacggcagggcattgattgggcttgtccccgtcctcggatgcgcggcgaggcgcggcgcggcgaggcgggcagagggagacatcgtcggcggcgggaaaccgagctcccacgcgccgcgacaggatcgcgtccagggcgacgggcaccgcgcgcgccggcggcgggaagaacgccggcgcctcccgccgccgtcgtcggctgttgcggcggactgctcgccatcgtcgggcttccccaacgactgggcctaaaaaatgggcctaaagagctaatgtttggtcctcaagtgggcccaataaactgtgggctatatatcagcccaacacatttagggccctcattttttttcgccgataaatgctaacgatatgttgactgaaaatctacctccaaatcttgcagattttggtccaccggatgaactttgcgatttgtgcttcaggccttctcctccaactccggcgactttcttctccggcgccagcgataccctagactctggcaaaggaccctacgggttaggatcccgggttggggtgggggttggagggggaggggcaagaggggggagctcgccggctttagagggatggctgtggga

SEQ ID NO: 43053 - DNA, 3041 bp, Oryza sativa
ttccccctccccctcccacccccatcccaacctagtaccctaacccgtagggtcctctgccggagtctagggtgtcgccggcgccggagaagaagaggaggtcgccggagttggaggataaggcctggagcacgaatcgcaaagttcatccagtgattcaaaatctgcaagatttagagatagattttctgtcaatatatcgttagcctttccgtaaagaaaatcaatccgggcaatttatgagcagctaacttagcttacttattaaaacaacgaattcgagaggatcggagtcatcagcttcgaacttttttgttcactgctagttgtgcgtccatatatcgtgggggcggcatccacatacgcaaagattattgatcagcagaaggaaacaaagatcatgtttcttccacatcatgttacctatcatcgatcaaatagccgtgtccacatctgtcatacatgctggccggtactccatgttagccaaatccattctctctaccaacctcagatccttgagagggtgtcaaatatcctggcaaaatgctggttgaacagtttaaaaccgctgtggaaaaaacaggttaaagttgaactatagtgcatgaataattaatggtctcttcggattatagccaaaataaaccttaccaaattttggtattgccaaatttttggcaatttgacaatattgccaaagttttagtaggatttcttacttatttatcagagtttagtaagaaactaaatagatgcacatattttcacaattttaccaaaaattggtatggtttgaaatgatatctatctgaacaggtcctaagttttaattattttaaagagataatagctactttagtccctaaagtttctctgtaggatcagtttagtccctaaccttttaaatggtctaaataaatccttaacctttgtcataaaacctagaatagtctttgggtccaccaaaaccatcatatggatatgccatgtcatcattcatgcaaaatctataataaattgtccaatttacccttacgtatatcatagaaaaataaatataagggtgaattagacataaccataggaaaaaatacttccttttttcaccattttgaggtatatttttgctcttgcatataccatatattttttttaactttttccttttgttttttattttcctatgcgtaagggtaaattggacaaatcatatagattttgcataggaaggtgacatggcatgtccatgtggcgattttggtgggaccaaggactatattagcccacatgacaaatttaaaggacttgtttggacaatataaaatattaagaactaaaatgacccaggagcgaaactttagtgaccatattagctattctccctattttaaacatgaaaaatagatttatttgatattttaaagcaaagacaattttcaacgaaacataccatttgataggtaagtttaataatttggaaaaacgtgctaacaagtcgagataaaatctttctgactttctcttactcctcttcagccatacgctcaagctttaactgaagtccatagaaagcaagcggcagcgtgcaatgcgtgtccagtgcagcggcgcatgcgcgtgagcgcgtcaatgtcgttaagaaacagttacatgtacctgtcagtggcacaattgggagctcaatagcagctgagattttcagcgaggcaaaagacatacagaagtagaagagatggtgagccaatcaaagcacaaaccaacgcgtagtagctgacggatttgaattgtccgcacatgagctctcccagccactaaatcggggagcccaaaggaaaaaaattctctcaattattgctgcgtgatccactgcattattgtccgatcactcaaacagtggtccatcgaagctttcggctgctcgatcgatcagttgccattgccgtttgccaatctcacctgcatgctgtatccattccgactgaactggggtctgaactgaactgttcagatcagagagaagaatataaaaaaacattcagtgacactagtgttaatgcttgtacattttaccagtgcggatgaggtcccgaattgtcgataggttacagctgctgcacacagatgcatggaccaacttcactggcaagtgtagcgacttccttgactgctcaggaagaagggaatcacatagaccaatctgtaacaaaaaaaaaatgaaatattttaatcaagagaatagtgttgttgtaggaaaaattgccacgagtccttttcggagtaccaaaaatccctggattggcttgttccacagccacaaaatatgctaactaaggtaccatcagcatcattgttgtgcgaactgaacgtactcctcttgctacaaatatagaccaaacacttgggactctaaaaagtacacaccaccaatgttgattgtttcatcctacatattaagctcagagcatcctcacattgggcagcgttacacaagtaccaacaatattagaaacctaccaaatatgccattgaaacacactatgggttgccaactccaataccaccttctataagcccaaaaaatttgttgaagaatgcatccaccaagtttagtgctagataccttgaagcgtatcaaactatacatagccatgaagctcctgttaccgaattcggaggtgcctcggatctattgggagaaagctcagcatctctgtgggttcctgtccatgaagctcatttccagagccagatgtgtggcaagttctgtcaaacaatcttatagttttctggtttgcaaaagtaaccctttggtagttcagctcgtttactttgtgataatctcatttgctggtttccttgctctgaagaatctcaagccccagggtaagccaggtccaaaggatttggacctattgttcacctctgtgtctacacttactgtctcgagcatggcaacagtagagatggaagacttatctgacaggcaactctgggttctgatccttctgatgctaatgggaggagaggtgttcacatca

SEQ ID NO: 43054 - DNA, 2678 bp, Oryza sativa
  unsure (1)..(2678): unsure at all n locations
gacaggttatttcgtagctactgtcatttccagttctgtcatcattattatttacttttggattgattcagatgcaagaaatgtactgaaaagtaaggagatcaatatgtataccttttgcatcttcacagcagtgtcctcgttcgcaaactgtggcttcacgccactaaatagtaacatgcaacccttcagaaagaactgggtccttttgctcctagtgatcccgcagattctagcaggcaacaccttgttttcaccactcttgcggctatgcgtatgggttttggggaaggtcagtggaaaagcagagtatgcttacatccttcagcatcctggggagactggctacaaacatttgcatgtgaggagaaattctgtttacattgttctgagtgttactggactgattctactgcaagtaatgtttatttgctcgtttgagtggaactcagagagcttagagggaatgaattggttacagaaattggtaggattattattccagagtgttaatacaagacaagccggtgaatctatccttgatatatcaacactttctccatcaactctgttgctatttgcagtcgtcatgttagtatctcctccaaaccctgtcttctaatgaatttaactaaatcagtagaacacttagattagttattacaggaacataacaaattatcaggagaaactgttggaaaatttgatagcttcatcatttataactttgaagattactaaacacatgcattcatgaccactgcagcttgctaggttttatcgattttatacgtcaccgaaatagtagttatgaacttcaaatctgcatctaaataactactgttgaatagagaaagtgagactactttgaacaaataggacagaacttctgacaagggtttaaatgaaaagtaggcagcatacaacatgttttatgtggaacagcatgtttcctactccttgttaacagataatcaacttgcttgcaggtaccttccttccgatgcttcatttctcactgccaatgctgataaccagcccttgacagataaaaagacaaactcgattagcagagcactgtggaggaattttaccgttaacaagctttcttgtttagcaatgttcacattcctggcatgcataacagaaaggaagtcaatttcttctgatccactaaatttcaacatcttcagcatagtttttgagataatcaggcaagttcacatccttttttttttgtctgcccataacagaaactatggctacatcaaaattacatcactgaaaatccgaattgcctagtatgatcactaagaaccactgaaccagcataattaaatttgcaagaacatatcaaatctacgacctgtcatttttttttcttttttggttgcttacaagcaaacagaaataacgccattttatttccacagcgctttcggcaatgtaggctactcactaggatacagttgccagaagttgttgaagcctgatgccacttgcaaagatgcttcctacgggttcgtcggcaggtggaccgaggagggtaagctgatagttatcctggtgatgttcctggggaggctcaaggagttcatcctgaaatgaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctacgagagcgaccaatgccactggggcggggcaccttacctccccctccgacggcaaagacgccgcccctcctcctccgccgccgggcgccaccattgctccgccgtcggcgatccacccgcgccgcgccgccgctgcacgtgcggcccgcgaatgagtgtgccttttgcctgccttctgccccagcgtgccgcttgcacctcctgtatttattcctccgcgccgcacgatatgacgtggcacgtttgtttacaggctttgtacgtgtcagggtaacaagtactctgttttttttcgcgggcacccagcaaacgcatatgcggatattgcgcaccactacaccactgcacacgtaacaccgaacttatattcgtggatattaaaaatttgtatcctgttgaatagggtcatgcatccatgactccggtactacactaagttgtaatctttatattttgatttgaggcatattgtatatggtgaacgtagttttttctcatgtctcttactagtgtattaactactttatattacatatgggtaccgagctcgaattcgccctat

SEQ ID NO: 43055 - DNA, 17345 bp, Oryza sativa
tgataagggctctcttgagtttatgaatgagcaaaaccgtggtccacgggccaccaaacccaagaaagaagtgaataactcctcaactgaggacaaaaataggaaaagtgcattaataaatgattctaacttgtacaaccaacatgattttgttattgagtatgaggatgccaaattttttgtaataaaatcctataccgaagatcatgtacacaagagcataaagtatggtgtctgggccagcactgctagtggtaacagaaagttggatgctgcttatcgtgaagcaaaagagaaagaagccacttgtcctattttcttgtttttctcggtatgatcatttctgtcattgcttgttcttctcttttctattttcatggcaggaaaaaagataaacaataggaaatgaaaatttgtcctttgacttaccatttgattttgattttgaggcagtttttcatgcatgaaatgaatttgaaatttgactttccctataggttaatggcagcggccagttctgtggtgtggctgagatgattggacctgtggacttcgacaagagtgttgattactggcagcaagacaagtggagcggccagtttcctgtcaaatggcacattatcaaggatgtcccgaacagccttcttcggcacatcattctcgagaacaatgaaaacaagcctgtgaccaacagcagggacacacaggaggtaaaaagaccaatacccatgctggcctttttgtagttaaaactaacttcagaatgcaaatttaagctttgctctgtcttggtggttgtctattgactggtcttatctctagcaccaagtaactaaactaacattgtcaactcacaggtgagactggaccacgggctccagatgctaacaatcttcaagaaccatgaggtcgagacaactatcctcgaggatttcgacttctacgagcagcgggagaaagccatgctggatatcagacagcgacagaagcagcagcatactgattccgaggtccagaagccgatggtggaggccaaggaaccagtggatcttatgaaccaaatctcagccacctttgcccgggccgtgcagcttggagaaaccaagggcagcagggaggacaaaccaaaggttgaagatgcttctgctgctgctgttgctgttcctgagaacgagcctgttgctcttgctgagactgaaggattgttagcagattcagagccaagccctttgaaggaaagtggttgatcttacccctttcatgtctgattgcgagaagcagctgggccttgtgatgttcacatggaagcaagaagatcaaaggaggttgatatgtgaaaaaaaaaatgctgcttcttttgtacttcaccataggctgcattataggctggaggagaaggatttggttcacctccagttaggttatgatgttagtcttatgtttccttcccaatttcttctttctgttctgtcatctgttccacaagcgccaccaagaatggtgctcagtggtttagccataaggaaagctgcatatataggccagagctctgtacagtttgcagttaaattatgttgttctcaatcttttcctgtgatatcatacaattctgtagcaaagttctcctgttgagatgacagttttacactcttggtaatttcagctccatcagtatcaatcaacagagacaaggataatatggaaatgagctaatctcacagaacattttacacttgtgtattcatcaatggcaggcactacaaactcagccagtaactaggagctgaatctaggaaacgggtaaggaagattaaccgaaagcttggcattagcagaactctgccacgggaacatttcaaattgtacatactatatactctgaacgcagcaaagtttgtgcatgttccagcagggggattatataacacaggcataaagcagcaggaacatgcgtcagttacaacaaaaggaaatctgcatgatgtttcgacaaaaggatagagcctaacacaccaaagcagtctgaaaacaccactctaagagagaaatattttgaatatagaactgccttacacctgagtatataactcagtcgtacactcaagttggatttctacttcagcggcgcagagtctaacatgtgataaatacactcgattatgcttccttccatcaaggtcttcgcaactctctgttgtctcattcaatcagttgtcatcggttgggagatgcagcaccgaaatcgggccttgcggactgtgctcaggatcaccacctcagcatgctccagcatcctaactacttcggtgaatggagggcgaacatcagggtttggatcccagcaccttgtcatgatctcactgagaacaggcaagcagtcctgtggtatggctggacggacacccttgttcaccacagcaaatgcagcttgtactgctgtcatgttagcgaaagggagcatgccagtaatgagctcccatagaacaatgccaaagctatagacatctactttctggtcatatggcctgtgctgaatcatttctctgcaggatcaaaataggcgagtcagacatcaggaaccaagttaataagatgaatgtattgaacgaattacaatttgaaacagtaaatagaaaacaactcattgctcagtatcctattgaaaaatattacgatgtactaccatgaagtaaaacacaacaaggtcagtattggcaagttttagctttcatgctgttttcttcttttccagactgctaggaaacacagtgttagcaatattaaggcatgaggaataatgactaaactgactggatttcttatagagataaccatccacttgctttataaaccatcaatgtacatgcatgtgccactagacttgagaaagaatctagttagtactcactgatggaaactcaaaagtgtggccaaggatttagagttcaggacaactaacaggagattattcaaacaaattgtgaccttgtatgataaaccaatcaaaccatgtacccaacctcagatttaacttaagtactactacagtctactagcatcccgagatggtagccatgatgatcacattgaacattaaatattcttgactccagaaagaatctgattgacatttcacctacaaagttacacaaacctaaatgagtaacaactggtgacaggattagattctaatgacccaataacaggtaataagtattttaagggctgaaatgaagccttctagtgatgcagaagaaaaggaacgaggcaaagacatatgcacacatttgttatagtttgtaacagagattctgttaaggtaattcagatctatcagcaatcatatggtaaacagattgcgctggtaaggactaaggaatgcactgaagacaagcaattgatgtgcactaccctaccatattgcaagacctatatctgatttatggtaagtacctgcatatatgatatttcaacctggaatccttaatgctcaaggcccaacgtggttttaagcaaggcctaacaagaacttgctacatgaccaaacagaaccttaaggagggtcccacatggtaaaaaaaaatcccaactagactccccatccacctctcccttatattgagagtcagtcatcgggcaggcagcgaaggcctgctaaagtggtgcaatctgaagtcaggcatgtagatccaggaggcagtaaccaccaggcaacagggacagcatccccaagaggaaaagaccaagggagggcagcaagaacctgggaagttactcgagcgctagcatccaatggacccaggaccaaggggcactgtccccatcgagcagatttagtgttggcaaccatcggacggcggacgcgcggagctgtggatatagggtggtcatcagatgagcatgatcagtccaaaagctccattgctgcccgccgtcagtgcaacggctccagagctctgaactttgtcacaatttacaaagccaggttctaaatgcttatgaaacactcttattgtccacaatgtgggtgccctagctggaatatatcctctagttttccatttatgcatacggtaagctgtcatctcttcttaatcaaagcttcccttaactgtccgaacaacaaagcattaatttcattccatctatggctatgcagtctaaagatcctcaattaatagaacaaggaaaaattgttatagtacgcctttaactaacatactatatcctacttggtaaatagcattaatgtagttgttttattcagtaaccaaacaaaattctcttaactaaaataaagtgttgcacgcggctagaactaacagataatatggtaaatagtattaatgtagttgttttattcaacttacggggccatccaacgataggttcctgtttcaggtgtcatcccctcggttttgacttcaatcctggcaactccaaagtctgctatcttaatcgatttatcgccagaaatcaagagattatctgacttgaggtccctatgaatgaacccaagagcatggacgtaggccatgccccttgcaacatccaaggcttgcttcacagcaagctttaatggaactgacctgttctgcctcttcatcagaaactgcctaactgagccaccctttgcatactctgtcacaatgcaccaaaccatcggcttcctgcatgccccaataaatttaactatgttgggatgcctcaaagttgcaagcatcataacttcttgcacaaactgttgttccattagcccggctctctccggatccgcctctggcctctccaaaagcttgatggcaacatcctccccattgtaggtgcccttgtatagcttcccaaatgcaccctgtgcaaagggcatccccatgtggagcttacccaaatcgatcgtccactcctcgtaatccttgagcgtctcagtcgggtacctcgggtccatcagtgcccgtgcaagcgcatcctcactcaacgcatgcgacacccgcccggggcggaaaatgctgtgcccaaccgagtaattggctgcgacatgccccctgaggcccgggtggttgagcatcctggtgtgggaatcactagacccgacgctgctgttatccaccgacattgccacggagccaccgccatgcgtgctggtctgcaggctattgaggctatcgatcgacatgttggagctctccccgagcttccggtagtacgccatgtcgcagaaattcccaccaatgtcgtcatggccgccggcgccgccgacgacgccgcccatcatgccggcgaacttggggccttccaccatcctcctcctcctcctcctcccaacaatcagcgccttctcaactcctcctatctcctcacctcacctcacctcccttccctactccccaagggcggatctatcgtcgcgcatagagggttcagctgaacccccaaatttctctgcaaacaaaccgccattagtaccaagcttaaggccgaaacaaaagcttccacatctacaagagaagctaaggtcaagtgcaaagagaaatggcgcgggtggagagaaatgaggaagaggacgtgagctcaccggcgggatgcagcaggacgccggccgccgctactgctcgccggggtggagatcggcggtgctcggcgcaggcggcgggcgggcgagctcgcgaggaggagacggggagacgaggcgaaggggagatcgactagggtagggaggagcaacgaggagacgagtcagaggcagctgccggtattggctttttctatagccaggtgactgagcttagcagtggtggttaaggaagctaatcaactttcctactaatgaaaatggtattaattaagctaatctaatcacttgctgatggagttatgcaaatgtgtgtttgccctatctgcagtcgaggatacatgatcatacggcctgtttagatagtttaaaattatgataagcagctgattggtagcgaaatactgtgttttccaccttttttttctatataattttttagattctaccattacattttatcagaatatagacaaaaactaaatcatttagagagtttttaattttaggagaagctgcagcagttaatttttttttcaaaccgcacctatccatctcggtctttcactatcccatctttctctctcttattttattttattttttttttggctcttgtgaatttgtctatgacctgaccgtatcacaaagcaaaaggcccatgtgacacaatggggagagtcggtgattactagcggaggggaaaccggtagtaacgcgcacatacaccgcgacacagactgcacaggcccgtgatgatgatttggtaggtgatcacctcgaaatgattggggatttttttttctttgcgaggacgacgacgactccccggcccgttgatgcgtgccaaccccgcggcagctgtgcgcccgcgcaccggtgcaccagggcgtgcgtgcgccccgttctttgcgcgttacgacgttgcgctcccgcatcccgctccacgcggatgcacgtacacgggacacggctcgtggttgtggacggggcgcgatcagagtgcgattcagcggaagcgtgtgatggagggaggcatcagcatcaggcatgggacgatgggagatcacatcgaccgcgttcgtggtgctttacactacacgtgcgtgcttggtttagcattgagctaagggccggtttagatcctctaaaatgattaaaattttaccgttttagaacattttttagcaaaataaatgtaaaaagtaggcaagttggcatttgtcatttgatagtaatctgaagaaaaaaaaatcaggccccgtgcataagagaggcggcagcaattaatggcaaaactttaccatgcatctaaatactaacttataaaattgcaatgctaaatctttttccatcaaaacttataccaaaaaatttaccgcagcaagttgatctaagcagacaataagccagtttttctgtgtatgatgtgtctggtaggaggtggcacaagcgcacaacacaaacgggcaaagggtgaaagggtttcacctacaaaatgcttttgattgcttcgttttttttcactgtttatcagcgtacagtaacaacaaaggttgaactgtatatttccagtttttttaaagaaaaaacctgtatatttccctttccttattctatgggccgacaaatccctcatatacggcccatcactataagcccagatttatgctacaaggcccatagcgtcacctcgccacgaaacggaataagatcactttgacttcctcaactgaccaccgaatctaaatcgtatccctcaactgcaataccaaaaatcttgacccccccccgaacttgcaaaaccggtgcaatttgactctcttagtggttttggatggcggtttcactgacgtggcgcacacgtggcagtgttgacctgttctttgttccacgtagcattgacgtggcgcttatgtggcattaaaataaaaaaaatatatgcggggcccatttatcattcacacaaaaaaaattgtgggacccactgacatgtgggtcccacatgtcatcttctctctcactacccttcttcctcctctctcccttatttctctctctctccccttgacatgagccggcggcaggcgggggctcggtggtggcatcggcgagcgggtgccggagtggtggctgcggtgggcggtggacctcgagcgacaagcccgggagcagctcctccttgaaatgggggtggacctcgggcgacgtgcgacggaatgcgtcgggggagatgggagcacgctcccaaccgccgctcctcgtccccactctgtgttgtgggtagtgaggagggcggcggccgcggcgtcgacaacgaggtgggtggtggccgcggtggaaagggagcaatagctcgcgcgccccaacgcacggcggcggactggccttgagcgctccagtgtcgacctggccatgatgcggagcggcgattggagctcctcctcctcctccaacacgggcccccttgtcacaccctgaaaattcaaaatatttaaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgtgcgcgcgttcggacgctgacaggtgggtcccacctgtcggacccatcgtctaccttcggccgccgccgcccgaaaccctagcgcgccgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcacgccgccgttcgccggcgagcgtgcgccgttcgagccgtctcctccgccgagccgccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgcccgtgcgcccggtccaccaaaccctagcccgctgacgcaataaaccctcttttccttttcaaaaataattcattattgcgtcataattcaattttaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctactgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcagttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcagtggattgtgttatgcgaggggtattgtcacaactcctttccgagatactgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaatgatgcttaaattggtaataatttgattagctcctggtttggaatggaatattcctggtgtggagatagaactgtgcagccggggtggttgttcagaatggttgggcctatacaacagggtatgttgtatagcgttggattaatattgtttaattacttaactgttttatcgaattctcaaatgtttgctaaatgctgcttttgcaaatgcaaccctactatgccatcctttgttatcctgtgcacttgcatatttgctacgtggctcgctgagtatgtcatatactcaccttgcaatcattcatcagaggaagagttctacaatgaggctgatggagtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttagatgccgcgttacaagcctgagtacctgtttggtgttgagggttttgtccaggagttgcgttcgatgtcctttgtcattggatttgggactgcccctttttatgcccagattcctcatgatcgtcatgaagagaagtgccgagtcaaagtcaccttgaacagtaatagtgaagatatccccttagtgatgtttgaagctggaggaagaaactacatccatgcatgtcaggaggtggcaaggatcgccataggagagctccgtgatcgctacagtgatcaattggccgacactgagtatcgctaccatcctcgtcaaccccagggaagtgaccgtggcagctatcttgagactgaaggaattgagaatgatgctaccacgaagcatttggttgagatgttgtgggctatggatgaaagtcgtgcggagactgtgttagccgctcaagatcgtgaagaccggaatcgtggtaagatttgtaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgcagcaacgggaatggtcccaacaaccccaataacaacaatggagagaatcccattctggcccaagttcttgctcaacagacacagcttatgaacatgatgatgcagcaatttcagaatcaggaaaaccaaggaaataaccatgcacctccccagaacaagttagcagaatttcttcgtgtgaggccacctgttttctctagtaccactaatcctgttgaagctagtgattggctgcatgccatagagaagaagttggatttacttcagtgcactgatcaggagaaggtctcatttgcatcacatcagttgcatggccctgcctctgaatggtgggatcacttccgccttaacaggactactgctgaacctatcatttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcatcttactttaggaccccagcccatgccacagggaggttcttcgtctgttgttcgtccgcagcgtcagttcttcaacaacaatgctggcaacaacatccgtaatcaaggtccacgtcctgttgcagctccagcacagcaacaacctgtcaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgtgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagatttctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccagttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggatttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtctgaagtgaaattccttggtcacgtcatctcagccggaggagttaccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaatgtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcatgatcatccgggaaaggctaatgttgtagcagacgctcttagcagaaaaggctattgcaatgctacagaaggacgacagttgccattggaattatgcaaggaatttgaaagattaaattggggaattgtcggtagaggtttcattgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttttgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccacagacagacggacaaaccgaaagggtgaatcagattttggaagacatgttgagagcttgtgctttagatttcggtggaagttgggataagaatctaccttatgcagaattttcatacaacaacagttatcaagctagtctacagatggcttcttacgaagcactgtatggtcggaagtgtcgcactccgcttttgtgggatcaaacgggagaacgtcaggttttcgggactgatattctaagagaagcagaagaaaaggtaaaaattattcaagaaagattgcgagtggctcaatctcgtcataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtccataatgtgttccatgtgtcacaattgaaaaaaatgtttaagtgtacctaccgaagaagctaatattgagcagatagaagtccaagaggatttgacttatgttgagaaaccaatccgtatcctggaaacaaatgagagaagaaccaggaatcgagttatccgtttctgcaaagttcaatggagtaatcactcggaagaagaatcaacttgggaacgagaagatgaattgaagtcagctcatccgcatctgttcgccagttcttccgaatctcgaggacgagattctgtttaagggggggtaggtttgtcacaccctgaaaattcaaaatatttaaattgttgtttaattggaatttttagaaataattttaaaagtcttgaaaagaaaatctaattttaattaataaattccaatataaaatggggccagataaaatttcattaaatactttgcttaattctataattcctagatttttgtgggatttatttgagctaaggaagtatttttaataaatggaattgcatttaaggaataatttaaattgaaaaagtttttaaaaagtctcttttggctttgggccgaaagtcggcccaaaaccgttttttttctcctcggcccag

SEQ ID NO: 43056 - DNA, 11393 bp, Oryza sativa
gctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgcagaccgcccccttcttcctcttggatttgccaccggccgcgcccgcagcggcctcgtggaggcttgggaagttggcggcaggagcagggggctcggtggccgccggggcggcagcgttttcgcgctcctccacctcctcctcggtgcgctcggtgtcccccgctgcgcacattccttcgtgccaccgcgcccgacttgctccctccccgccgtggccgccccgcgccatcatcgtcggaatcatcctgctcgtcgctgttgtgctctcaccgccatgccctcgctgagcgggcgctcaaggtgccctcgccgccatgccctcgccccgccaccatccccgaatccctactgctgctgcaacggcggcgatagaggaggcgcgaagactgtcggctgccgctccgtccattgcctgccgtcgccgtcgccgccgccgccgctccccacgcacgaagagaaagagggagagatagagaagggaggagggggaggaggaagaagggataggagagggtgacatgtgggacacacatgtcagtgggtcccacaattctttttttgtgtgaatgataaatgggtcccgcatatattttttttattttaatgccacatatgcgccacgtcaatgccacgtggaacaaagaccaagtcaacactgccacgtgtgcgctacgtcagcgaaacaaccatccaaaaccaccaaggaagtcaaattacaccggttttgtaagttcggagggtcaagatttctggtattgtggttgagggatacgatttagattcggtggtcagttgagggagtcgaagtgatcttattccccacgaaaccgactcaaattattctccagcccacgaagcagccgccgaataagatcacgctcgcctcctcctcctcctcccctctcatcccgtctccctcccgaattggggatctcgcgagtcgcgacgaaccaaaccgatcgaaaccctagctagggtttcgccgcaccaccaccaccacctccccggccgctccccaccgccgccgccgccatgtacaacggcatcggtctccagaccgcgcgggggtcgggcacgaatgggtacgtgcagaccaacaagttcttcatcaagccgcggtcgtcgtcggcgggcgggcccccgagggcggcgccggccccggggttcgacgacgccggcgggggcctcggcgggatgcggaagccgaacaaggagatcctggagcacgaccggaagcggcaggtggagctgcggctgctcctgctgagggacgcgctcgaggagcaggggtacacggagggggagatcgaggagcgcgtcgaggaggcgcgcaaggaggccgagatcgaggccgcggcggccgcggccgccgaggaggaaggacgcggcgcggggcggcagccactcccgggcaaagggtatgtgtagagatcgaagtgttcgtcttatttccgtttactgtgctggctatagtgtttgtcatgtgtactaggagaggaaggctggtgactcatgcttaaaagttaataattttcgatacagtgtttggttgtgtgttattcctgaaacaaattgttactcgtagttcatcatgctagcttgttcttgttactgtgctggctatactgtttgtcatgtgtaggagagcagggctggtgactcatggtttaaaagtttatatttgttcgatacagcgttaagattgtttcatttctataactgaactgttacttgtgtttcatcacgctagtttcatttctataactgaactgttattgtttcatttctactatactagtatttttttttactatagttccaagtttccaactagcatacgtgatacgactgcatatgcatgggtttctttatttttgctgttatatgttcatttgtttgttctgtttctgtacggttatttaatttctcacaggaaggttatggtcattcaatttcttacaagaagtgaattctctcagtttttcagacacacaaagccaccacgttgctgcaaggaaggagaagcagcttgagacgctgagggctgctcttggtttggatgttgatgataaagcgaagaagaacgctgatgtagaaagtgatgtggaatctggggagcttgttcctgggaaggagtatgaaggtttggaaatagatgggccagaagatggcaagactttaaaggatgacagaaggcatgcaaagaagggtaagaaggataaagggagtgatgcaaagagtcatggcaaaagttctaggaagattaaacttggtcatgattcagattcagatcatgatgataacaagaagaagaagaagaattctcgctatggttcagaagatgattctgaggctaaatatgatgaaaagaagcacagtaaacacttgaagaattctcgccatgatacagatgatgattctgagagtgaccataagaatgcaaagtgtaaaaagagttctcgccatgattcagagtctgattctgagagtgatcataagaatgcaaggcgtggaaagagctctcgccatgattcagagtctgattcagatggtgattatggcaagaagacaacaaaacatggcaagaacgatcgtgatgagagaaagaaaaggcctgccacgatctctcgccgacatgactcagaagatgaaaagcctagaaagggtaagcgcatggatgattcagatactgactcggagggtgatggttcgttcagtgagtcggacagcgactatgatcggaagaagaagaaatctacaaatagttctcgcaatgaatctaaagatgataagccccgaagaaaggctcctaaggacaagtattctgatggcccagaaagtggctcagacagtgatcatggtggaaaatcaaagtattcaaagatttctcgccgtgattctgaacttcagtcccgaaaggatgctgataaacaggaccagtaccgtgataaattgaagagtgagtttgctagcgatggctatggagagaagaaatctgttaagatcccatacaatgacttgaaagatgacaagccaagcagcaaggttgttcggaaggaccggtacagtgatgaatcagagactgattcagaaacttatgttaagaaaaagaagaatcttccgaagtcctatcaccatagtgataaaccagcacaaagaggtaaagaaaaggaagagaactctggaaagaatgttgataagcgcaagaggcatgatactgattctgattcagatagccatgctcgtgaaaggaaaagacaccttgatgcacgggcgagtttggctgcccaaaagaaaagaagtgtgactagctcaagtgagagttcagagagttcagattacagcagtagcagtgatagtgaatcagatgtgagttctgacagccgcgaggataggaaatcagcaagacagttgaagcatgatgagttagagagaaagaaaaggagtcaagacgagaagagaaaggagctagagaagcaaaagcaggaggaagagagaaaagagctggacaggcagaagcagagggaggaagagagaaaggctaaagagcttgagaagcagaagcagagggaggaagagagaaaggcattggagaagcagaagcagggggagagggacggagatagatatgagcgtgaccatgaggggaggaaaggcgaaaatgatgttgaaagagactacaaaagaaaagttggagaagataggtatgatccaagcaggaggcaggatgaggataggtatgatccaaacaggagacatgatgaagatatgtatgatccaaataggaggcatgaagaacatggtcgacgaagaaatagagattttgatagccgtgatccgaaaaggtctagacatgatgattcttatcatcattctcgaagggactatgaacagcgttattctagagatgaatatagagacaggaggcatcgttgaatgcaagtcatgtgtaagtctgattttgtcctctgttttgtttgtgtatatttggattgttttaaacaaacacattttgttcattccaaagtctgttgtttagtaatattagaagttatgttttttcggatatggagttaactttgtgcattgtcaatggtctatcacagattttagtgttcaaatacattggatgaatttcatcttccttcgcaactaatgtataatctcaccatgctttagtattttcctttgcagccatctctggtttcttcaagcagaagagggatgcatctttacatgaaccgagcagatgatcgatgtcctgctccctcaagtttttcagagtcctaccagaagaagacttgatgcagcagtaaatctctcctagcagtagagaaccttttgcctcaggaatgtacgtttgcttatgtttgtatgaactttcatacttgttgttttgttgtgtgaatgatcaatatgtattctggtggatataattaccttgtgtctgcaagaaatatatgatttaacactgtgcccatgtggtttagtggcttagtgctgaacagcatcacaagcatttttgttggcaaaattttgccgttgatttctgcatatgctggagtgaatatattacttttgatgataataacagttgaaaaattatgcgctacgcctacgctacgttcgtacctctgatcgaatttgaccgggaaacctatttgcactaatggtcggttcggagttcggacatcttccccaagcaggccagccgagccagccgaggtctaaagagagaggcaaggcaacccggtaggtttccagattgtgcagcgtcttgggatttgggaatcttggtgatcatcggacatgtcgaagcgaccgctgtcttcggtgctgctgctcctgtcgcgcggcgcagcgacgtctgcatctcattttgtcctagggcacccgcaatgattatctagcttagagcaggtacaatggcggactattagctagctataaacatattttaatgagataaaagatgagatagaagagcagcagccagctgtagcacggactccaagatgcagtgagtgtatgacagtgggactatatagtaactaactattgtatgaattgactattagattggctacaaatgaattagagctagtagtggtgatgtgaccatcaagtatatgcatacaaccaagtatgagaaatataaaacattgacaaagaatacattggatgaatggaggatctacaagatattaaagtccaatgagttttggaatccaatttggcctccggagacagcactgactacaaacagacctagcgccttcatgccaactccgatttgggtgatcttggacttcgtggaaagcttatctcgctacctttcaaacgcatccggtttcatgtccaaattcatctcgagtcaacgggaatcgccaaaacaagacagtgctgttgctgaaaccgaacttgggccttgcgccttgtaatagactaggcccatctcggaagtgtctccctccacctccacgaattagcacttaaccctagctttgttttcctctataaatagctttgtacatcctcaaaaacaattgggttttgtttagttgaattttgccaagtgccattcaccttgtctctagtcctcgctcgattagtcggtgactattgattcagagcccccaatagttggtgtgttgatttgctgggtcgattagatctaccacttcaatcgcaactattcctttgtgcttaattacctattcgcaatatttagattgcatcttatcttgttcttgcagtgttctctcgtttgcattgcagggatcatcaaccgcgcgtcacggttggtacgacatcgtttgtggtgtagcgattgtatggcgttctggacttgttctggttggtagccacgtcgtaaacgtcgcactcgatcaaagtgagagttatcccctcactagaagatcgggccacgagagagagcgtcatcaagtgggctacactattaaacttgcttttaggagccttttgcatgtagttgtattgttattatcgaaaatttttagatacacggtactctattttttttatagcaacttttagccatacatctaagcaattgcttgtctcatagacgtatataaaaactattatattttagggatgcagtgccaatttagagctacaagatactactcttcttcaagttctcttctcaatgtcccttctaaaaaaagttctcttctcaataaaaagaagtgcactaaatcaagagtacttaataagtatagtaagaaccactgtgcactaaatcaagagtactccttaatactccatccgtcccataatataaggaattttaaaaggatgtgacatgttctagtactgtctagattcatagtactagaatatgtcacatccattcaaaatctcttatattacgggacggagagagtaactaataagaaccaccgtatagcaagagcagcaacatttgttcgttcaataacataacaaaggtacaaatatcaatatgtaatgtaaatttcttgggagacggagcatgcataaacaatataccatgtacttacctgttatgatagaaaaaaaatgctactcatcatactccttccgtccaaaaaaaaattagcctagtattaaaatgtgacatatcctagtacggcgaatctggacatactttatatccagatttgtgatactagaatgtgtcatatcttagtactagattggcttttttttagacagagagagtatgcaagtttcaaagctagcaccaatcaaaactagcaggagtagtcaagtgtagacgagataacagggaccaattaggaatgatatacaacactgaccatcatcatgacgtggtttgcaagaatatttagcctaaaaagctcactgaaaaagaaccagtaaaacaacgttattttccttccaaaattaaaagggtcatatttgccatctaataattacatttacttatcaaaactaaagcacgatccaacctacaaattatgataacaagaaacctaaaaaaattacaggaaatcttctcttataatctcatctactcgttcatatgacacagaacgcaaagatattacatgttcagctcatttgctcattcaaactaggatgttctagctcaccaattaagcgtatccggaatctgagtcaagctctcatttaccccctcaaacttcgatattccagctctccaattacatgatatcctcttaaaaattggataatgcccctggaaacatctcttcttaaatgatgtaatatattttaaaattctggaatagtacttctctggtttattcgttgaccgactaatgtattatcatatgatttgcacaatgccgaagtattgaagtcaagcctctctcttatttatcttttatgtcatctattgatatttgtatatctccagaatagattggttgtgttcagcagttggcaaccaatttttctcatcaaatctcatatagcttactacttacctactttactttacttgtccagagctcattgttgttagtttgttcactagcatcctttggtgttacttgtggttcatcgtccattttatttcttctttggttgtactggcatttctttcataatctctgctctattttttttctcactactgcttcaatatatttaaatcgcttctgatgtgtgatagttggatcaatagctttatggatcattccttatatgagacaaccaatcctctaatagctcatttttatgggatcattccttatatgagacaaccaatcctccacgttctttgcatttagatttaggtatatttgtcttaagggtttggatgaggctacaaagttttagtgcatattacattggatgtttgcacactaattagaagtattaaacatagactaatgacaaaacccattccataaccctggactaactaattcgcgagacgaatctactgagcataactaatccatgattatccctaactaatccatataattagaagtattaaacgtagactaatgacaaaacccattccataaccttggactaattcgcgagacgaatctattgagcctaactaatccatgattatcctatgtgatgctacagtaaacatgtgctaattatggattaattaggcttaaaaatttgtctcgcagattagctcttatttatccaattagttttgtaagtattctatatttaatactccaaattagtgtcccaacatcgaatgtgacagggactaagtttagttcctaattgttacatttcagatactatttttaaccctagcactaacctggataataccaggaagagggtagagaaaccgaaaatgacccatttattcattacaatcaggctgtccatatttaacaagaggaattgaacaacaaagtcgattaagaaaatgttcaatatcattttttaaatgatcttaaattagataaacccacccacttttttttcttatttaaaatgatagtcttaaattaaaattagagaaaacatattttcatatctttctttcaacagtggctcaactttattcatgattctccatacataattccatacaaaaattcgatacaaaaaaatctttattaaataaattatttttggtggtataacttaaaatcaaaaaacctattatcaaatgaattattttttttagaaataatttaaaattcaataagaatattatcaaataaattatctttttagtaataactttagatctaacaagcttattattaagtttttcagaaagaacaatatataacttttttttctctaccttctaaaaattatgttattttttatttatgcttctcatgtttatctctctttctttccttacttatgctcatatctcttttattggtgaaaataggtaccgcgctatgaggagatgaatatagctttattcaaatttatccataaaatacactttcaaaacattttctcaaatccacgttagataaggctattttagaacctagctttataatataaacttgatggaaacaccatcgtccctatatacttcaatcacacaaaacacaatactaagcttacctctcttttcattgcaaggaatcaaaaaacaaaagaggtttgaatagaaaaacaattttagatataaatgcaacacattccataaaatttacaaggatgggagacaatacccgtacataatttaattgtaagaattgaacattcacgaatcgagcaatgaaaatttaaactctctaaaaaaagccctagagactcatacaaggagcaccatatactttaggtttgatcctctatttataagctaagttcgatagaaacccaataaaaaacctaaaataatagcaggctataagttagctataagcatatgtggaggtgagaagggaagagaagagtgaagaaaatcgggctacatatttgtagccagttgcagcataaactctaacacgttgtgttatatgagaggtgggaccatatattaatggtttacagattataataactattatataaatgagctattagattagccatagataatttgaaactagtagttggctatactattaatcttactcttagctcaaccgagggaatactacagatggctgccacgtcgcctggcagtaaagccactccaaggcttcggtcccgtgcggcccaaccggatagagacgcacgtcccagatccgtcccacgcgccctccgcagggcccacgatccgtgtcgatgcatgctatccgcgcccatcaccacgtgtctcagccgatcgatgccgctgtgctgccgagtgccgaaccggacaccgcatgccacgtcgtcgtacggttcccgcccgctcctcccgcgcatggcaagaacggacagctggagatcgcaggccgcatggctcgatcgtccaagccatacaaggttgccaacaaaggtttggctgatctgtcaattgaacccgtcgcgttttggttgtagcatagtatgtatattcagggcaacccgtggcacgatacaaacatggcaacgaacaagcaagtacacctcgttagcaaaatgttggtcgaccgtccacaaacaaacattcatgactaatcgaagtcacagactcacagttgtatttgacacttacatatggatcgacctgaacctataaaatatagtggtaaagattaacaaaatgtggcgtgacactggaccttgcagtcacactaggaccattggatgtaaatcaaacgggcagataatcaaagatactattcaaacaaaagaaatactgcatatttactgtagctcctgtgttgtagcttcaaaccctccataagaaaaatagatgaccaagatcacatgcagttcttgtcttgcagtccctagtataactgcacgtgatctcaaattcgcagtagtgaattaaacaccccttaacttcaaacttgtgcgtgcacatttttgggggcatgaacctagaaaaaggctttattatgtaacaacaattgatttcgaagactgaacaatatcacccttagcacattgctggaaatgttcaattaacaggggaacttcgtactcagcacagaaaaaatggtatgacaatacaatcacctcatcaattcataacgacttcggtgtcgttaagtctacagccttttgtctcaaaagggaaaaatgagacagccaacccggagaggaagattacaagctcaaagagaaggatcgctgtcgtctgctggcagctgtgtactagagcaacagcgacgagaggacagaggatgcctccaatcctacctacagagctcgccacgccaattccggttgttctgacagaggttgggtaaatctgaaaattgaagcaaggagaagaaaacagttagcattaacatctgatcttccattttgttgtcacgatgatgaaatgaaaacaaattatgtgctatctagtgacactgaactactgaaccatgtgaggcagcagaactgaaccaacctctggagcatatatgtatacaattgtaaagctagcagatatgcaaagccgggctccaaatagggagactcttgttagtatatccgttcgggagaaaattagtgggaataagaaaacacagcgctgtgaagagcattgatgccattgacagctttctaccaatcctatccacaatcatggctgacaaaaatgatcatggaatctctgtttcgagaaagcagagcagcatttcgttgtaaaatgggaatcatatgc

SEQ ID NO: 43057 - DNA, 736 bp, Oryza sativa
ctatagggcgaattcgagctctgtaccccgaacaaggagatcctggagcacgaccggaagcggcaggtggagctgcggctgctcctgctgagggacgcgctcgaggagcaggggtacacggagggggagatcgaggagcgcgtcgaggaggcgcgcaaggaggccgagatcgaggccgcggcggccgcggccgccgaggaggaaggacgcggcgcggggcggcagccactcccgggcaaaggattggtttgtgaaaattgagtgtttttagatggttttcatacggagttgaccaaatttgtcagattttacccgtttttgcttagtttttggtaaaccgaaagtggttttcaccttgaaaatggaaatgtgaaccctggtgtgcacaagatttgcgcttcattggctcaagaatggccataattactattgtactcagttttggtcatgacctaaaccatggattaagttgtccagatagttcccatgtttttctgggccagttcgcaatggctatgacagaaagaaaggaaaacaagagacagcactaactaaaacttctgtcttacaaaatcatgtatgatttttttgaccggaaaacattaggggaggctatttgactttattactctaggtctacaaaattctgtaaattagtttctggtactgaatatggaaattctttgaataataaacaaccgcaaatctggtacttaaagatattttttattaccat

SEQ ID NO: 43058 - DNA, 14328 bp, Oryza sativa
  unsure (1)..(14328): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaaggctaataatacagccgacttgttggttataaggttctttgcaattttttcttagcctacaaatataatagttaactatttataattaatatagtgcccatttgtctctctcacagaattttttggttcttgcgtccaagccggctgtaaatttacagcccgcttctcctctctctcctctcttctctccatcacctcagcatttagccgacttacagcctcctattatacttgctcttaaggttagccatagccatatattctcttgtgagtttacttcccaatacataaagttatactacaaatattattttagtgcttaaggttaactttacatgcacattggagatgcccttatgcctttaatttttaaggtcacggtaaattttttgcagaaaaggagagcgcctggccggccaccagctcactgttgcaaatagtagaaactcaacaattttatgaaaaactatactagaaacttgataactgcaccacacctgcacttctcatcttttgcaaattaaataaattatcaccttcagcagttcagttagttttagtactatagcacattgctaagctggatcttaatcaatcagtgtataatcatccatcatcagagataatacctgccaaaggcaaacaccacaatgatacaatctacaaagccccaaactgaacagattacgcaaagatatctctcccatgataatatgatattatgcacagatccatcaaaaccacagtgtcatcacactatctcaatatatcaacaatcattgcctgctttaacactgaccaagattaggttatctttacgcaaagagctttgttttttcatagctagattagtgcagggattaaacgacacctcagcttcagtagcagctggggcaatgcatttgtctgggaaaggagtcgatctcatcgattgttcagatcatcttttaaataaatacatgtgtgtcacgaagctgggcttggctggctgcaggcagcagttcgaaatgcgcatcgagctggtgagcaaatgatctttgccactgtgacgacgacgacgctgctttacataaaggcaggacaaataatctggtaagaatttggggcctctctctgctgcttgccctgaagatagcaactggttgtcgtgttgccataggcaaaatttaagtagcacagtggtttaggtctaactaacacacgcatgcaactataaatatgtaatatgaagtgtcctgaatcttttcaagttcataggatggatggtctcctgaaaaaagaaaattcagagtcctatagttattttgtttacttaaaatgtactctgaataatgaaatgatcgacttacctttatggtgatctcaaacgagtacccctatctactactatttagtattatcatcgatataagtgatcttaaccgttaatttatcttgttagtacttcctccgtgtcaaaatgtaagtactttttaggttggtacgagtattaagaaagtaggtggaaatgattagagaaagtgtgtgattggttgagaagagaaaaagagatgaaacagaatgtttgtgattgaccccctatcgccgctccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcgcccatcagatgcggcggcatcgagttgaatgaggttcttgagggcatccctgtggtgagggcaagtttccccatcaagtacttgggcctccccctagctctgggaagactgtggaaggtggacttgcaacctatctttgacaaaatttccggaagggtagcaagctggagaggaaaaaatatggcagcggctggaagaactacgctcgtcaaatatgtgctaacggcgcaaccaatctaccttctgaccgctctgaaaatcacaaaggaatccctcaagcagctagacaagcagcggcgccgcttcctctgggcaggcacaggtgttattaccggagggaaatgcaaggtcaattggacaaagacgtgcatgccgaccagccaaggaggattgggggtcctaaatctggacaaattcacgagggccttgaggttgagatggttgtggcatgaatggaaggaccagaccaaaccttgggtggggctggagacgccatgtgatgaaatagataggaacctcttcgccgcctcaacaaacataacaataggggacggaaacacggtgcgattttgggagtccacgtggattggtgggcgaagacccaaagacctcatgccgcttgtctatgcgatctcaaaaaacagaggaaaaccccttcggcaaggaaaggaggaggacacctgggtgcaagatttgaagcttgattcacaatcatctatcacaatcgaccttgtcgaacagctagccgcactgtgggaagtggtccgaaatgtgcacttagacgttagagaaccagatcagattacttggaagttcacaaacaacgggcactacacggcctcctcggcttaccatgcacagtgctgcggggcgccgagcacaaaattcaattccttgatttggaaagcctgggcgtcggggaaatgcaaatttcatgcttggctcatcattcagaacagagtctggacttcagaccggcttgcgaccaggggatggcagaacaatggttgttgccctctttgccgccgcgagattgagacggcattgcaccttgttgccacttgtagatacaccaagaggatttggcacctcgtctctgcatgggtgggctatcagcagatggacccaacggaatgggaggaagcccagtcagtcaaacagtggtgggagaacattgcaaacacgcctagtgtcccgagaaaaggacttcgatcgctcattctgttagtcgtctgggaaatttggaaagagaggaatcggcggatttttgatcacaaataggtggcaacgaacttcctactaatgaaaatcaaagaggaggcgagcctttggggctttagcaggagctaagtggttgcgtgagttaatctcgcacactatacagctatagtggttctatagtggttctctgttttccttttacccctaggggtttgtattttctcctgctctattcaatgaaaaggcactctagtgctgtttttccgttcaaaaaaaaaaagaatgtttgtgattggatgagaggaagaggtatgtggagaaataactttattttgggacaagatattatgctagaaatagctatattttaaaacagaagtagtataagcatgtcactgaaaatggaggtcctactgtcctaggagtagtcctcctgagcagtgaaaaaaaaagtactactaaataatactaatcaggtttaactagctaaacaaacacaaatctttgacagggctaaacaaggggaggaagcttttgctaatctagtggtagctaacttgatcagccctgcaaagtgcagtgtgcccaatagtccaaagtgtcgtatcgaatgcatcctttgcttcactttcgcatcactttgcagaaagaaatacacacaggttgctgccctattggtccccatcgatttcatcatacaggtgctcctcttttaattttactctttttttttctttgagaaatctttaatcctagtctcgatccccacatttatgttcaaatatgtcatctttctgaattaagctacaaaattatcaaagcttcaacaaccacaaggatgcaaaaataaacaaataaatagctcatccaggaacagaaatcgccgaggaatgtaatataattcagactcaaataaaagaaaagaaaagaaaagaaaagaaagattcaatcttctccaaaatggccatcaagtttgcgccttttgctccgggaagatgaacttgttactgatgaacaagctgcaagtatcatcggatgtcgcttcctcttcctcgcagtagcattcagagctcgctgcagcagctgatagcaactgctgatcctctcctgtaataacaaatataaaaacattttttttaaaaaaaggatcatttcaaagttactgacgaactgacaaagttttgcaaactacaagatctttcaattgatcatgtcgtgggttgggttggtcaggacgtcagagatcaggttacttacctcagtcaggccaatgcaccacgaggcagctgattcagagctgacgctgctcctgtgcgacatggctgcaggcgactcatttactgcgaatagcaccgccgctgccgccattgatgaggcgcagtggttcaggaactcgagctctgttccacggatggcaacaagaagattcttggatcaattagcgagcattggatgcagcgagattcaaggacaagtttagcattagttgggatgtttaaggataattactagcacttaatttcaatatgtaattaatgatgatgagactcatgtagtttttcacagaaaatggtgcaagtactattattttagcagggttaagaaagcatctgatctcttgtcacattgaactgtcaccaggaatccaggatgttacaaatgtgtttggattggcccaggtagtggatgatcatttagccagctaactggttgattgaaatggaaatccaataatctccttcctatgtactacaacagattttggtaaagttgtggtaaagtgtggtcaccatccaaacaccctcttaatcctgacgcaaatagtgctacctagcaaggttcagaataccggtttggcaggaacaggcctggtgaaatttaaatgctaattttgaattcaaatctaaatttagaattttacatgttcccgaacagaatagttctatattcaagttttacaatatgttattttatttatattcgcatccttccgaccggtaactacccggggaactggttgccatccggttattgaccggtaaaaccaacagttttcgggaccatgacattgagtactcactactcacaccataactccagtgattcatcttttcatcaaagagaggggaacaaaaaagtacttcaatagagagtcaaagatgcaatgataatattattcaggcaatgaaaacaacaaattatatttcattgtactattttgcacctcttgacattggcatttagtttacttatgttatgccaccttttactactagtgatagtatggtaataaaattaaaatataatcaacattttgcttattttagatattttaactagactctaacgaaaacaattttgattattcatctagtatattatatggcatgcgaataaatgatcaacctatatgcatcctagagtaaaattttgttttctgttccctcaaaaagaaaacgttagcattaccatgaattgcactgagaattatttggcaagcacgcaatgccaagatccttgagcttcttccagaggagccaaccttacaagcgaagaaatcaacaaaggcgaaaggcgtcactgaccggagcctccaatccaactccacgaggacgatgagctccatcctctggatcgtccgaggttcaaaaatgaatcttgttccttcaatctgtttgcatttgctgaaattcatattcataacaaaagcaaataaagacattgagtactcactattcacatcaagttagttacctgaaggtcaaggaggggtggggcagaggactcctccatcttggcagccagagacaagcaagccacacatagcaattgggatgcccaaccatgatcctgggtgaaagaaatcaaattgcaataataagctagaatcagatgagtagagttcttaagataactggaaattcagctgtctatctctgcattaacaaagaatgcaccgcattctctgagcattgaggaacaagaggagatcgattaaaagaaatcttgttcgaagagaaaaatctgaagtataacatcaaatcacaaaccatgcaactgatcacaatgagaattgatgatggaatagtacaaccaacgacaactctatgtagcaattgcaagtgtggtgtacagagtcattttcagattgatattaactgttatgaacttacgactgacttggattctctaggaatttgcaaataataatgaattcattagtgtaggcggttttcttaagtaatcgatggtgacatattttcacaggcagcctatgaccttacaacggccccaaccttttctatagacgattataaattggagccgtttaagaaaaggaatggctgtggctttctgtagcagagggatcatgataatcatatgcaaaaatatgtagaacgtcgatccatgaaaaagtgccttgtcctacctcttaatcagggtagtgaccatgtagatcggggattgagaccaaatccaaatcaaaatagtgcccctgccaatcataattctcaatcttggtgtggtggcacacctgggcagaaaatggcatcaccggtcacatgcatgttttttgtctactaatgggaaagttaaaattccctgttgaatagacacatcctctgacagagaataatgccctactagccacctaacatagattcagaattccatccctaatgacctcaattaatttgctgctactagttgcatctgccaaaaacattcgttagccttgtgtgctagctagctaggtacttattccctacaatccacaataaaattattattctctcgtcctaaacaatcacaatcatcctttatatatttaattcatacacatgcttcctcagctcattaaactaatcacaattattttccaatttaattttatatatctccttagttactttgaaaaactcaaaaaagtatatatattttgggacggacacacaagttacttagaaattcagtaccattctaacccacatatcatcggcacataactatagtgcaagtgtgctttttttttactgcaaattctgccaactctgtactaagtatgtatgctacagcagcatagtctgatcaattgattcgtaatctgcagctaattctttttttaaggcctaatctctggctctctgcagtgcactgcgcttaatccagtaactagacacagctagagacaaaagtgtgggcggccattgatttaccggcaagctgcgagacgacatgaacctatccatgtagctcacggcgaggtacgccgtcgccggctggaagccgtggactgaccggacctggagaagaaaggcgagtgaaattaagatgtgcaagttaattagattgccatggatcgagctagctagattgcggcggtgctagctatagcttcaccttgaggatccaggagacggactccgaccagccgggccggtggacggctgtcctcggcggcgagcaagcaggcatgacgagctcggcaccgacgggcacgtcgacgtcgtagtcgtagtcgtagcagtgctcctccccgcctggagtcacctgcaccacctcgccatggacgccgtgttcgtcttcgtcttcgtcgtcgtcgtcagcggctgcggcggccgcggcggcgcacgacaatgacgacgacggcgacgacccctgcgccggctcgccctcgcgctccagctcgccggcgtcctcgccgcacagcagcgcgtcgacgtcgtcgtcgacgacatccacgcagcacactacgcccgcggaggacccgcgtgcgtcgtctccgacatgcttgtacatcatcgcgccgacgaacttagctagctagctagcaagaagacatgattgcgtcgtgcgccgccatttcaccggccgcgagagcgagagcgagagcgagctacggccgccacaaggtgcaggctgcgatgcgacggcgcgcgcgcgcgtgtgatggcgtgcgtcgtagcggtggagcagcggatcactgtgggcgatagcaaagctgagaattcgctggatatgagaactggaaatgaaacctgcaggatgcttggttttatttgtctgtcccggcagaacggcactgtacgttggctgagtgctgcctcttgcctcaatcctccttaaaaaggacaataaactcaaggctaaacacaagttatcaaagcctataaaaggagccttcacattcgagggtttaaagattatcctaaatttaatttaaggagtaaagattatacaaggagtcttcacattctagagctttctaaacagaatttcactctttttttggttggacttcagctctaagaaatggagctagagctgaagctgaagcagaaaataaagtggatcgtggagtagtaatagattttagataatggtcctactactccacatagctttttttgggagtagtagtaaaatctaaaccacttttttttctagagctgaagcaggaaatggtcctactactccacatatataactactagatttagactttgtaagttaaaataaagtggtttaaaattttatatatatttcatataaaatatatagaaaagtgtttatccaaatgttattaataacaaatttagatccatatatttctgaagtgtattggctctaaaaaattctgatctaaagttgtgccaaacaaaacttaattcatggagaaaaaaaattcacgctgaccattgatcaatcattgtggtaccaaattataatggcatagattgctcggattaatagatgtagccatgtaggtacaattgtttttatgaaaatagaagctaagatttatatcactgcaatgcagggcccataataaacaaattaatcaaaacaataaatccgaacgtacaacttacaaaactttctgttaaagagcatgcacctacatgtacataaacatgaacatcagggttatccctagcaggtaaagttgtacactcgcacttaaggccatttcagcctttcacaacagtacaatcatttcggtaaacaccaggtttgggcaattggccagacgtacaagcatgtaattaccggctagtcagtacgtactgcccaatgacattagtgtgacggccgtatcaaacatccaaaatccaaattccatcaacttctgcgtacgagatgcaaagtttattggttaattcaagggtgtagctatatttatggcgccatattttttataaaaaaatagtcggcatgtatttacattgtaaatccctaaattacatatgtaattttagtgtatttataatgtaagtcttaaaattacatatgtaagtactaaaattacatactaattacatatgtaagtgactgaaaaaaaatcgattgtagcatatggcgccatatttctagcaactccataattcaatgagcagactgtacataggtgcatgtaaaaggctgcatccgtccatacgcatacaaaagaatgtgctccctccgtttcataatattctataatttagagtagcagtgcatgctttaatttgatcactgatatcttctacttactccgtttcaaaatataggtatttttagagcaggtacaatagcaggctataaaccagctgtaaacatattttaagaagataaatgaggagagagaagagcagcgggctacagatttgtagccagctgtagcacggactccaagacgcagtgtatgtgtgacaggtgggaccatatattaatagtgtagtatgtaactattgtatgaatgagctattagattggctatagatgaattcgagctagtagttagctgtactattaaacttgcttttaaggttggcacgagtattaaaaaagtaggtgggaatgattggaggaggtgtgtgattggttgaaaagaggagataggtgaagaagaatggttgtgattggttgagaggaggaggtagttagagaaatagcttcattctgggacaagatattgtgctagaaatagctatattttaagatagaggaagtaaatcgtttaatcatgatgaacgggattttttatatacttattgtataatatactttattaataatatagtatgttggacactcttacaaatttattcatgaaagtgaagtgagtgtatttagctagaatcctattcacctgggtttaaatcctagaaatgacacgggtgtatgactaattgttctttcaatagtaggtaatgtatcattcgacagcgtgccatccgtggtgagttcatcaattttaagatatgctgaaacaattttttgaatgtgcttataggatagggtgtgcgtgtgtaagttcttaggggtgagttgcctcgtgatggcttactcaatttaagatatgccagcctagtttttaggaggtgcttatagaggtatggtatgtgtgagtgtgtttttaagggtgagtgtgtgtttgctgtaagcgtttacgtttgtgccatgtttcttttaaaaaaatattcatgaaacaggagtagtcaaagtaaaacaatataatgtcatgaaacaaagtgggtatctatataatattattttacttttagcgactaatccctttatcctagaatataagagatttaaatggatagtacacattctagtagtatgaatctagacaatctttatgtttaaatttgtagtactagtatatgtctcattccttcaaaggccttgtttagttccaaaccttttcttcaaacttccaacttttccatcacatcaaaactttcctacacacataaacttctaactttttcatcacatcgttctaatttcaaccaaacttttaattttggcgtgaactaatcacacccaaaatatctattctaggatgaaggtagtattatactgaactattaaaggcaagatgcagatatgggccatgcatgtttggctagccagatggatcatagatctggtgcatatatatcacgcacatataagtcacattcgtaggagatatgatgggccatgtcctggcctgattgcatatacagcactgcctgctgcacggcatgagcggataggccagggatccagctttttactcctacatgttttggtcttttatgagtaggtgcggtagtactactgtactggctggtcgagtggctgcccatccgggcccatatatatgcaggtttgacccctccagtcaaatactgcaacggcttcatgcctgtatatgtcaatacaaaaatatattgccttcgctcttattttacttaaaagttttgatttcagtcatgaaggcacgattttgggtgggcgttcggtcaaaccaaaacaatatatttcggttcgctagaaatataataaagttcaaaatgcattgcatgataatgaaaacccatcggttttggtcattttagtttggtcttcaggagatccaaaataatagaaaccactactaaattttagtgtaaattggattcgtgccattgtaaatatgtctatttagataaatatcattataatttgtctatttataattgtgtcactggattttacaaatttggaaccatgctagggtcatgtttttcattcatttccttccttctccattttcttccttctctcttcccattgcaacttcatggcaacgcaaggtttcgtgcagagcagaggggtttgtaatggtgtcaaaaccttaagcaatatggaccttgggtgggacacgaagttttagctcctctctcacaaaaaatacattagtgttgcttggatcatagtttaaacgataattttatggtttaggctcatcttattgttatttaaatgtgtgatattgacagtttaggatcgtctttaactgtctagacggacaagtctagcgtcttaattagaccattagactacggtctaggctagctctcgtctcaattcatgctcacctcggacaagctagtctagctaggtatagtgatcgatgattaaaagtgattttttcttaaccaagttggtaaatataatgtcgtagagatatcgatcttagctgaaagtcgtcgtatggtacaggatatataggaccattattcttctggtccgctacatatatgtacagtatttgtactataacatattaatgcttgtatagtagcatgacgccggctatagctagctggtcgttgcattatgtgcggcgtgtcagtggatctgcaagcatgtgcaaccgtgaaaaatcaccggaggagccaccggtagtacgcttaatcatgtgattaatttttttaaaaatgtatttttacccggcctttatatccaactagattatgcagccatttaaatcagtggcggacacagcataaaaatttagctatggcggatcatcacaccagaacgaatattttaaaaatgaagtagcattttattatacacaaactataatatatgttcgcatttattagaatatatgctattaacgatgattataatcctaaatttgtgatgcaatttttacaactgacactttaaattcgtcgaataacaaacaatgattataatcttaaatttgttatgcagtttttacaactgatgcccttaaattcgccgtataacttttacgactaaactacatttccacgagtgttcccctgttttttaggtgtgtttattcataacaagtagacattcactattatttagcatttgatttttaccgattgttagctagactattcattcatttgtgcagacacaaggcagtcccactataggtctttacctccagttaattagacgaataagcttgtaccaattaaaatacagctaactaatcacataattagcatatgtaatcaaggctgagatggccatatgcttaaataccctatctattttgggcatggcataggtatggccggtgccatcccttgccacaagagaagatccgccactgatttaaatagaaaacttagcccctcaaataatctaatctaaaattcgctcttataaagatttaaactcagcactcttgaagtgctgcttagttcattacaaatactagactgcatgttctttcgcaatcatgtgattacatgtatacacacatgtgtgccatacccatatacatatatacaaatacgccactgtcacgatcgttcatttatgtcatgttaaagaaaatattctgaggaattattgacctggtcatattaaaggaggtattataaggattttagatgaacgccttggttcatctcagtcgaaaattttctatgatattgtttaggtatttttgttaaagaataaagaaacaaaggttttgacacacggatttactaacaaactgtctgcactaatttattcttacaagtggttcctttagagaccgttaacagaaatatattttacttcctccgtttcatactataaatcattctatcattttccacattcatattgatgttaatgaatctgtctagattcattaacatcaatatgaatgtggaaaatgctacaataacttacattatgaaacggaggaagtacatatgatctacaaacctaaggcgaggctaactatttagctaaacacatttcggctgtatgtgcaaagaaaaacctagctaggacatacaaaaatcgattttatagcagtgatcgatgcatggctgccactactacaacaacgatctttccgtgtgttgcaaactcattttcacgtgcagtagtttcgctcgtctggaacccaacgtctacgaaaatcatgatttttccgtgctcgcacgccgcacggtaaaataaaaaatcaaaaaaagagaaaaaaccaaaaccctaaccataatccagccatcgccccgcgatcgccggcgacggatccagacgctgggagaccggtgccgccactgccatcgtcgtcgcctgccgccgccgagctcgccgccgtgcgcacgccgctctcggtcgccgagcccgctgctcccgcccgccagatccgggcagcttgggaggagggggagagggagatggagatgggaggagggaggagatgggagagggaggaatgggcgcgcggccggattaaatggtgggcacctattttcgtgtgcgg

SEQ ID NO: 43059 - DNA, 47747 bp, Oryza sativa
tgacaggtccgcccggacgccgaaccccattgttgcctggcggtccatatgttggcccgcacatgaaaattgatttttctgtgtgagcgatggcctagcgccggtccccccattttcctgtgcggttccacatatggtccgcctggaaacaaaagggttcggcgtccagaaaaatctttcatgtagtagtgtgcatagcatgatgataaaagcagtgccattgtacaaccatgacaaaaaacccgcggccggtgccggtaagtcttcatttgtagtgaatctgcgagaggcgcagctagcgctacctagagatgaggatgatgtgtcgttcgtcaggctgtgttgggaacatttcacaccgacacgtaaatagagtaatgaattagtacatgattaattaagtactagtaaataaaagtttttaaaatagattattataaatttttacagtaatttttctatagaaaatttttgcaaaatatgtttaacagctcgggaagctaaaaacgatggagtgcagaagttgagaacctagcaaaagaggacgcaaatccactgctgtactgcacctgcagtacgtgtcactgacatgcatgtgggtcccacctataccgggcccacatgtcattggcacttactgcacatgcattacaggagaggatcccaactcagcaaaagaacgttgtttggctggtggttaaacttacaacatcatatctatactaatataaaaaggaggagttgtccccctccaatcctacaggccaaatcacccgaatcaatccctaccgttcatccgcatccgcatcgcctaatccctaatccgcaccgttcaccggcgatttcacccttcccacagcgaccgtgatttcaccctatccatccatcatgattttagctcgcgcgaagactccgcctccgcgctcctcgctcctccttgcttgtccccgttgctgccgcattcctccactactcctgtcgaagcctaggtcgtccccagccgtgttgccgccgccgcactccatcgctgccccgccggaaccgaggtctcccccggctgtcgccgctgttgccgcactccacagctacccccaccgaagaccgagccgtggtcgcccccggccgtagccaccgccacccgccaccgcactccaccgctgccccctgacgtagccgaggttgtccccagccgccactgccctccatcgctgtccccgccggagccgaggtcgtccctagccgccactaccgccgcgagcgtatgagattgagggaggcggcgccggtgatcgggcacgggcggcatgcgttacgaaaggcggtggcggtggtggtgggccgaggcctgactaccagaggccaaggcggcggcgccacaagagcgcaatgcaactgtgttgtgcgggcagaaagccagcacgtgggtgggcgccgaggagcaatcagctgcctccctagtaagcagcaaacaggaccgcatcagtcggccagcatttgctagctgggcttgggatcctgttttctcttctcatatacttatttgtgatttgcaaattgtaatacctgatttgtggatttgggaattgggaagatggattgaaaaggaagggaaagcatcaacatttcaagaggtagatttggggaattttgatgagtctgtttatattagcaccaaattgaagagctattttaacatattcaagtactccgttgtactgcgccccggtcgctaccgagacaacatcaatgccattatcctacccacaaccgccatgccacaaccgctggatcgagcagtcaagcaccccatgtatttgcgtaaaccctacaatagtctacatcgatccttcttctaattgtgttgaggtaattttttaaaaaatcatcctaaaattagtgggctgcaccaattaccaatatttttatgtataatagttttgaacatggtgtttgctatttgaaatatgatgttgctctcatgaccaatgaagatttacattaactacttcaggttagatttgtaaattatgtagtttttccttaatgcataatcattggctgtgtttggtgctaaatactgcagtttcttttaattttgtaggaaaatctgtaagaaattggaataacagagcaaacctgaacattttcttggtatgtacctatacctggtattcatattgatgctattttattaagtgaatagccaatatgttgatctttcatctgaacctgaattactagattacaatgaattcgttgggttgatacatgagcaatacacataaattttatagcatacgctcttttataaattgaacataccacgttgtctgctacaggtcatgtgattaccggtatatcatgatcactttttttaattaggatttaaggaagttggaaagtaaattatgaacaattggtgcctacacatgctttggcttctattcagacgaggtaattagtcttgatttagactaaatataaagggtaccaattataattttctagaagtgaaaatgagctaaagggccaggaaaacaaaatggaaaggatgctaggaggcagttgcaatagtactcgcatcatccctttaccaacaaaatgaggctaattaatttgtattttatcaacatcctgagtgcaaagacaagcagtggaaaccacttttcaaaggtgtggagactgatgaactggagttgctgacaagaagactgaaggaatgctgtgctggactgcaaaatatcagaactggggtgggttagttagagttttttttgctgtctgttactttgtggaggtgttttggaaagctttttgaatcgatgcgcctgctgtatcttcacttatgggtcttgtgttgtccctgctgtctaaaaattggttgtttctctaggccggaggggcctcttttggtcgatgtatgcacattgatgtaagctggaatccccagcaagacaaatttgctttctatataagcagggtcgttcttcgaccttttctctaaaaaaacatcctgcgtgcaaatatcttgcttacagaattaggaatacaatgtgatgtactatcagatgctttaatgatctaaaatatgtatggacaaattcccatagttcacaaattagttttggaggagatgatctatatgattggtggaatgacacaaaaatatctattattttgtttcaatgagaatgagaatgctcgacgtggtgcaaactgcaaagtggattttctaggttttcttttatcgaaataggttcaggattagtgaagtaattatagtttataggcaatattgttaggaaaaaccactaaaattttggcatacttgcctcatgattggttaaacggaaactgcagattgaagcagaaataaatttcttgaaaaatcttggttgttctgtaagtgggatcctagagttgtgacctgacatcaaagttttcattgttaattcacccattgaacatttatacggtgaatttttgcacgtccattgatcctgacaaatctactgttatgttctttttcttctgactgtgcagatgatcagttccactgccaaatggaaacaaatatgttagcattagagttgaggtgcctttacaggtctgctggtacgattgcagatataactttttatttgtacaattgtatatgtgtgatatttttctcagctaaaacttgtgacctatctttattcatgtattaggaatttgtttttggatgatcgattctgcatggctaaatccattgtggatttgttgaggtggtcctccaggtatggcccggggcactcaagttttaacaaaattatgtgcaacacttgggggtgtatctatatggtattgttgtgatgaaaggataataatgtgagtgtggatttataatatatacctcctcttcaaattagattgtaagaatgagtgtgttttctcaattaatattctacatggattcctatgtgcacgaattggttgtttgttcatttatgtttgcatgaaaatagaaatgatgcttgtttcacttctgtttaaatagatttatttcttagctacatggattccagtgtataatagtgggtatttttacacattgaagtgttgctttatttctcaagatgaaccgccaatatttttaagggctcatgctgataaattgtaaaatttagtcgaaacatgttatgatggaaagaacatgtattgcacgtgcatgattactggttttattaaaaggacgaaattgactggctaaacttgaattatcagcggtgttgaaacacggcccgactcctatggaaacaacgtttgggaactttccacaacgggtgaactttaccgttgtatgctccatttttagtaaggtcccttttctgtgctcaagtttttactgacagccccaatattcaacacactggggaggagtatatcacgagctgacactgctgcagtctgcagagccaacgaactactccctatgtctctctctaaatataagcaattttgcttgaatgtggcatatcctgatacaatgaatttggacaggagctgtattagaatatgtcacatccaaccgctcctgtctagattcgttgtattatgatatatcacatccaaccaaaatcctttatatttatggatggagggagtagctagctagctagccatgcattaatcttcactgctaaagcctgtaaagaaatatatgtggccagagatatgctcctgtgaataatactccctccgttgtttctaaatatttaacgctattgactttttaaaatatgtttgactattcatcttattaaaaaaaattagtaattattaattcttttcctatcatttgattcatttttaaatgtacgtatatgtatacatatagataagacgaatggttaaatatgtactaaaaagttaatggtgccaaatatttagaaacggagggagtaatagccgaagatattcttctgaagaaatgataatactatgacgagcatcattatttgatttgaagcggtagatttatacgcagacaagtagacaacttgcatgctgctacatctatatagcttcgcatgcagccgcaatttttcaccaattccacttttttgtgctcttgcaaaactcattctgattatcacttttaacatcaaccaagatataataaaaaaatcatgcgacattacagacgtatttatgatgactaacgtagtgatatactatctccgttttaaaatatcaggtgttctggttttgtcataaatcaaacattatcaagtttaatcaagtttactaaacaaaaatattctaaaaaattatattgaatggtagaattaaataaaataatttgatattgtaatattatcgcagttttaatagatttggtaaaatttgcatagtttgataaaggacaaaaccaagaaaaacacacagggagtacttcctatttgtacaaaaccagaagcaatactgcctcgggatccaatgtgatccggttttgtaaaattcgggatgtgttatatctgctattcagggataataattttaaaaacgataacaagataaggcataagggacctcagctgaactttttccttacgccgaacacccggtgtgctcggggccttcgcggcacttggcccatctcgtcgctgctgggctgcagcttagggcctaaaccaactcgcgcggcccaatccatttcccccgcctcgttccatttccctctccaacatccaagccctaacccgcgcggctcgagactcgctgccaagccagcttccgcccacgacgccgccgccgccgaccggtccggcgaatcccccgctctcccgactcgcgagggctctctctctctccggttcgtactccctccccacccctctcccgcttccctctcccacaacaccgctcgcgtcgagtgacatgctcaccgggtgttcggcgtaatgcctctcccagaccaagaagcagctgcaggcggggacggcggcgcgatggcgagcggcgacggcgcgaacggcggtggcggtggcgggcaggggaagctcccgcggaagcggttctaccgggcgcgcgcgcacagcaacccgctcagcgactcgcacttcccgatcccgatatcgcccgacgaggtagacctctcgcagcactacccgcggtacttcccctccggcgagggcgaggcccgccagggcgacgcggcggtgccacggatccgcttcgcggacgttgggtgtgggttcggcgggctgctcgtcggcctctctacgctcttcccggacaccctcatgatcggcatggagctcagggacaaggtttgttagaatttccccctaaactttgattgggcagtagagatacattcatgtgtgaatggataacagcacaaggtgacactgaagaattcagtgttacattactcatagagaccatttgagctttcctttgtagaatgattagatcgcgcatggcttttacttcatgaatgtttagtgtaccaaatattgggaatttgggttgccttccaatttagattctatagtaaatatggatttctactagacaaaagttgcatagtttagtttgtgatggtattatattatgcaatagacatgtatttctacttaacaaaagaactggaagttttttcttttcaaagctagtacgtatttacttttgattcatttttttcttcgttgtctatatttttcaggtgactgagtatgtcaaagagcggattttggctttaagagcatcgaatccgggaaagtacgacaacatatctgtcgtgcgcaccaattcgatgaaatacattccaaactatttcaggaaggctcagctttcgaaaatgttcttcctgttccctgatcctcacttcaaggagaagaaccaccggcggagggtgatcagcatgcagctgctagatgagtatgcttatgtgatggaagtgggaggaatcatatatacaatcacagatgtggaggagctcggagaatggatgcggtcatgcctggagaaacacccgctgttcgaagctatcccagaggaagagacaaaagcagacccagttgtcaagctactgtctaccgccactgaagaaggtcagaaggttgcaagaaatggaggtcagactttccaggccatctttagacgcatctccttgcaagagtaggcaactcttgaatttactagcctgcagtgccattgcacctattgtatggattttgtgtcatctctacaaatttatgttgcatgaattttgctgtttaaggtgtactagttactcataccatagtaatgatgtgtgaaatgtttgtctaccttacatgctctgtttggaagtttgcagtgacatgttgccaaaccccatgaattactgtagaaacatgtgtcttatctgtagctgtagaaacatgcgcccttactgtagctagtcgtgtgataattgcatgttcagaaaatttgaggtttatgtgcaatcccattctgtttcattgcctagacaggtgcatttctcaactctttctaaacgccaaatgaaatcatctgaggtttaaaacttggcttcgatatgaaaaaaatatatttataattaacgctcgcttatgtatgtggtgatccttacttcttttattaatccaattacaaaacgactgttatgcaatctcagtgagatcattttatggaggtgtcctgtttgcttagccagctttgtattcacatagccgaacggtaacacatcaaacgtttaaaataacgcctctgaggaacctcggtttgcaaataagaaaaagatcatctaaatttggctatttcttccattgtggcattagctttttcgaacccctttacataagttgatcatgaatcaggattagacaacttctctaaaataaacaggttctaaaaatggattgaacaagcaactatagcaaattggaggaatcatcccattaaaaacaataggaggaatgacccaaatcaacagttgctaacatctaaatcttttttttttctctgattcttgtgacagagctgagtcacatttttctatttgccggaacaagtttgacaagctttgccaaatcataagacttgaaatctcttccaaaacacaagcttatatccaaggcagtccttccatcctgtaaccaaatctgagatcagaaagcagtattggcctatagactgtaatacaaagctgatgtccatggaaatacgagcatttgagatgacaatgccatagaagtcaatttctgtgaagcggctaaaaatgacatgaaaatgtatgccaatttgccaaataaaatcaaggctctgagtgcacaagaggcagctgttataggtctaattttttgggataatgcaattccggaaaaaaaaacccagtaaaccataggggcataacataccttggttcttctcgtcttatctgcaccattgacaagcaatatctttgctatatctctatttctactctgtatagctaaatgcaacggtgtccagccatcctgcatgaaacgagacaaaataaaagaaaaatcaatggcactgaaaagggttgaactaataagaaaaaaaaaagcaccatagcacattacattatcagcaacattgacatcaaccctattcttaatcagtaacttcacagtttgcagggcaccaacttgaactgcataatgtaatggtgtggctccatcctgcaaatcagacagatttaattcaagggccaacatgacataaaaaatatctcaaactggagtggaaattgttatgtacttatgttgctagagagagaaaccagatcaatgtgataggcgctaacatcacaaagtttactatattccacatactaatgttattatggaacacataattcatagaaagagattgcagccttgcaaggttaccctatctctgacatgaggatttgcccctcttcgcaggagatggctaatgacggcctcctttttgcctatgacagccttgtgaagtggggtgaaaccatcctgtatcatcagcactcccaaaattaacacggttttctttttcgtgaatgcgcaaaagcttttcacaggcataatccaagatggggtttttcacaggcaccaaaatagaaaatcatgagcatgaaacatgcttcctcaacatgttatgtagaaagaacatactttgtcaagtaaattgatatcgacaccactatcgagcaggctgtccatgagaggtatctgcagcgccaatgcgtaactatgaagtggatgccatttcggctgcacaaaacagtccaatttcaggaattgggaacagttaaaatatcaatggtgtgcacatttccttaatcaagattctgtagcaatgtaacaaatttatgacacaccaaaatataatatctgtcagacatttacagagtgacacttactgatgatattttggtgatatccggggtctcgttctgatccaggatagccatttcttcaggcgtcaagagaagctcgatttctagacagaaaaattcgacagaattaagtgtagaacatgaagcatttcaattcagctgatcaagaaactgaaaaatgaaaaaagaaaatttgatttgtctagcgcatgcagcagatgaaccaatacctcctcgaagctcctcttcttctcgctgctcttgccgccgcgcggcgccgagcctggagaacagcgagggggaagggaacgaggagaagctgctcctccgcccggtggcctcctgccgctcggcctcggcctctgccccatccccatcctcgtcgtcgctcccggagccgccgtcgtccggctcctcccagaacacgtcgccgtgggaagggcgcgcggcgcgcggcgccgccccggggccaaccgagagaagcggcggcggaggaggggaagggtggtgcgggggcggtgggaggcgcggagagcgcgcgcgccggggcatggcgcggaggagcggagccgacgaggccggggaggtggtggccgccgtcgccggcggcggcgcccatgggagcatcgcgcgcgtagcttaggtgttcgtctgggtgcctcttatcgtgaaagaggaggggtgagctggagctggaagctcctggagttgaggttttgggttctaccgtttcaccgtttggaaaggaacaaaatctggaaggagatgtgataaaaaaatgaaaaaaacatttttttttcagaaaaaactactccatggatcatggtctctatacagcattaggctagtgatgtttctatggattgttcagattgatgtcattttaaactataccaattttttttaagaaatgtcgttaaagatgtgcatctatttaggaccgttttggattgaagctaaaactgtgccctaccaaaattttggtaatttaaatagtaaatatgctagtttggtttgaagccaaacaattgatagtgcccatactcaatttggacatattctagaatattcttcaccatactactaaaatttggctccatattggtattaaaccaaaagtagtctaattaacttttccctaccaaaaaattggtagtgccaaaatttgcctagattttggcactaccaataaataggtagggtagagaaccaaataagcccttagtttttactccttccgtcccattttaaatgtaaccataagtttccccgcacaaacttgattgtccgtcttatttgaatttttttataattagtatttttgttgttatgtgataataaaacataaatagtactttactcgtgacttatgttttaaaatttttttgaaaaaaaatcaaataaaacggacggtcaaagttgagcgcggaaaatcatggttgcacataaaatgggacggagggagttccaaactttaataaatacataagaaatcatgttaaaacttggcaatattactaagttgccaatgacaaaatttgataaggtttaatttgattacaatctgaactgccttttaactttttagaatccccaatattttacaatattttgaatgtgacttgaaaagggacatatactcggttgtactgagctgttttcttgcacatgaaactgagacatgttattagctactttcgtttcgtattataagttgatttgtcttttgtataattaaacttttttaggttcaaaaaaaattaacaatatctataactttaaatttactttcaataaatgtaacattgaatgtaaatatattgtgatcatataaaacttttgggttgaaaatattactatatttttctataaacttggttaaacttacgaaatgagaaaataaatcaaaagcgacttataatatgaaacagagggagtagtgattaattaagttttaactattacaaaattaaaaaaatggttttatttgaattatttaaaaaaacttatatataaaataattctgtaaaaaaaagcaccattcaattgatgtttagaaagcatgctcacggtgaatggagttgcaaaagttaataaaaaacgaacgaagcattagtgatgaaagcaatgaaaaataattttaatataaatgttagtatatactttcattctcaggctttcatcggttggccaattacggataatgcgccaaacaacatattatcgattaaaaataatttacggttaaaactaataacaacttaaacgttaatgtttaaaaaatacgatgaaaaatctttaaattaactctaaaattaagttttattattcaaattttgacaaaaaaaaatgtgccttttagaattctaaaggtgcagggccgagtggtaagaccaaggaaaatcccactaaattggttatgatatctattttggaaaacaaaaaggagaaaaaatcaatcttactcgctcgaagtatttcatttggatcacttaaccactaaaatatttttctaatttacccctaagtactttttggttcattttgtctctaaactattgaaaatgattcactgtactcactaatagcatttttttcttctttttctttctctttatacctgaaattttttaaaccatagagacaccactatcaaagttcaaataatatttgcaacttttttcatgatcgtttacttgaactttaaaatctcaaagttcaaaattaatcttaggtatttccaacctatgtaaacacctataaaaaatattctaaaaggataataagacataagttgtaaattgttacccatctatcatccaatcaaatttcagtgtgaaatacaacttacatatggagagaaaataccgtgatggagtaaattgaaccccttttttatagttgttgtaatagcaaatcaattttattagggtttaattaaaatgcaccattttttttgcagatgagcataattctttaaaaataagcacacataatctttggcaactacacaagcacaaatggaaaaataaaactttttttttacttaccctccaagccagaaggcccttttaatgtccaaaataaattggagagagtgagcggtcaagcaaaaggaaaccaacacccgcgtgttgtgtgtagaaccaccgcctcgccgcgccgccgccgccggcggagagagagagagaatgctcacccgaaccctcgccggccgcgtccgccccctcctcgctgccgcgggcctccgcggctacgcgccccgcgcggccgccgacctcgtcgtcgtcggcgacgaggagcccccgccgcgcaccgcgtcctccgcctccgccgccgccaccgtctccatcgcggccactgcgcccaccgtcctgcagccgcgcgtgctcatctacgacggcgtctgccacctctgccaccgcggtgagcacatgtacaggcccccaattgtggggggactcatttctacctcgaatcggcgacgaattgggggcatttggttgtgatcgaaatgcggtttggggctttgcattgcaggggtgaagtgggtgatcaaggcggacaagcacgccaagatcaggttctgctgcgtgcagtccaaggccgcggagccgtacctgagactggtcgggatggacagggaggacgtgctgcggcgagtcctcttcatcgaggggcctgaggcctactacgagggatccacaggttagcattgcatctctgatgattcggaaatcggggcaatgttgtgatctttccaagaacatgttggctacttgttagagcaggtacaatagcatactatatgccagctataaatatattttaaagagataaatgaagatagagaagaacagcgggctatagatctgtaaccagctacagcacgaactccaaaacgtaatgtgtgtatgacaggtgggaccagatattaatagtgtaataagcaactattgtatgaattggctattacattggctatagatgatttagagctagtagtgggctatactattaaacttgctctgtatcaacggactagtagattagcaatgctggggatctaagagtggtagaaaaatttgcaaccattggtggatggataccagtgagtgatagttagtaccctgtactcgctggatttgcataccttgtttgaatttgtagcaattttgcatggcatgaggcaaaattcgttgggaaatgcagtggatttctttgtcattttctgcaagaatgccatcatggagggcattggagtttagaggccacttgataaatgctttgggtgattttcagtaccatctagtgtctgtggttatggctttgattttctgaatgggatcacctctgaacttctttctggtgtttatgagttgtgtcaaatgcaggattcaacatttgctaggtttgtgatagataggtgtgcccccttatttaccagtaatgcatgagagcaacatgctttacactctagtattttttttttggatcatgcatttgttcaaccaagttattgcaatgatagccattgctgtgctcctgcaaaaaagtacaaatttctagaggccacagttcctttcataatgtagctcaatcattccctgagacaccaattaatctggcagaatacatagattatagatatggttgtactgtccatatagcagcactaactggaagatcgaaagtactaactgaaggatccttttaatgatactcatttagggaaaaaaaataaacagcaattctttatgtactttttgctgtttaatcatgtcatatttgcccacccttatttcctgtggtaatcagggtactaaatcttccatgttttggttgcagctgctttgaaagttgcatcgtacctgcctcttccctactcagctttgagctccctgctgatcatccccgccccactgcgggatgcaatctacgattacattgcaaagaatcgctacgattggtttggcaaggatgatgaatgcatcgttaccaagaacaaggagcttcttgagcgcttcatcgacagggaggagatgcttggaggtggtcccagcaatagcttctgatgatcacagtttttgctgccctagttccacttcttagttccagttgtaggtttaggcacagagagatgtaaataatcttcacatgatcacatccatgtagggtactacttatggactaaagggttttcttgacttttgagtgtttatgcctacaaatttgacaccactactagtgtccgggatgcagcattatcattagtctgcatgcggaacttggataggcaatgtcaagagaaaggagagttttaggattgtgattattatctcagtgtaacaggttaagaaatgccttttgacctgtcaaatttcacaagaacattcaagatgaaccacattatgcctgaattcttgtatgttttgtgttcattgttgccccgatgggatatggtttaacatcacttctttttttgccgttgtgttatcatgcatggttgcttgatagtttgtgaggccttgcattgttgaatttagaaataatcttgatttgactgaaaaatagacacaactgcggtgcaaactctgcttatgatctttgcaaaccattgtgatgtctgagaggtcataagaaatggatttacaacagagttatatatatactgttgtctgcagttagtacatgccagcaaaagagagtttgaccattgcggcaagtgtcaaagacaaaaacaactctgcttttctgcagtacgagaaaacaaaactataaaaatctagcaaactacatctacatttttcctaatttctacagacaggtttggaaacagccagcctactggcaatagaaagtaggggaaatacaaaaggtatatagctctagcaaactgcattttctacagaagggtttcgacaaaggctagagattacgttcgtgaggttccaaccaggggaatccaagtgtatcgaacacatccttctcggtgtcacaattaattatagcatctgatcttcccccctgcaaaaactcacaatgaatggagcaaagcaaacaacttgtatggatttggaatgaaaaatcacatgtacatacacgctttccaccactgcccggtgtagcaagatacaaaccagtgtcgtcaagaatgtagcctttggaatctgctagtattcttaatctgcatgtttcaattacgaaacttgtaaaaaaaagctgtggtcttgcattcctgatcatgataacgtgtatgactaaagagctcaaatgcataccgtcgattcagaacatcattgccagtccaagcaagcagcccaaatgcatgtctgttccttgggtataccttctaacatcgaattgtcaccattttatcagcatgagttggtacatgaatgttatgcagcatatattgcatggcatagtcgatggggaaatcactataaatgttgttttatttaccaagatgaaggattgtaagtttataatcacattcatgccaatgccataaataaaaggacaaagaacaaagcagtgctttgttgatgtgtcacgaacataagaccaagactattgaagacactggagatgcaaacagcaaaaggaacattgaaatttgtttagttttaatcaataagaaacaaatcctgtcaaatgaagatgacatgaaccaaattactcctgctggaataatattataccttgaggtcgatgcgatggcgcagctcacgcccaggatatgtgcaaagaccaaaatatgtgtcaactccacaatcagttccctgcattgagatgagcaatgccagttcgttcaaatcttcttacacaatttctcaagatgttaaaaaggtactacttccatcgatttttataagatatattttgatcttaaaaagccttcaagattaaaaactgatcattcattctttctcataaaatatattcttaatagctacaaaaccaatattgtgtgatagcactttgaaatatgaacatttagcccacttttatatgatcttatctttttttttctcaatttgtttaggaaaaagtccacttttggtcctttaactcttgctcggatctagcattctagcttacatccagaactttaatattgttttgctttcatccattgactatcaaagcagtgtaaattacattcatagaagttcttgagtgtttctggattacgtggctgccttttcaatcatggtatccacaccacctcatttggggaaaaaaccagaacaaaaattttctttggtaaattattaaagcatatcaacccataagtaaataggataccttgtcacccaaaatcaccataaaaaatatactcgggatgttatttgaacagtttttatggttgaaacatgtgctctaagcggtattgatgttcagagtataaattaaatccaagcagaagtggagggaccaaatgtgatctttcccatttgtttataatcactcttctcaaaatctctgaaagtagtggccaagaacttacctcaatgctgtgtatgctgaaaataagatcctccctcaaaaaattgatgcccttcaagcgctgaacaaattttggtaaaaagcctacatgactggagaaaaatgtatggtcccttttacaatgtccagatgattaatcattgatgttcttatataaaaatgtgttgtgtgcagaccgcataatagaaacttggtcataatgaataattatgcttatgatagatgacaaattgataaaccaaacctacaagttgccagaaaataactttccatgactgtaaaataactaaatggctgtttggtgtggtgccaaggttcagtgttgaattcaatagaatacactgaacgcacagcagatgggtaatttctcatcatacttaaataaaaatcacgtggcatactcaataaccaacaatttttgaaagttttgaagtatacctttcaccatcaggatgagtgataataatatccatgtcaccacaagaagattttccacgtctgtatgatcccccacatacaattatcacctccaaataaaaaagatcatgtataacaacccaataatcacttaagggaaattattgttctactaaaatcttaaatatatgagctatttgttttcaagaatcaaatcggcctaggatctcgataggatgaccccattcctcatttttgtactggatgtgtactttcagaggatgactggaggaatggtgatgaaccaacccatctagttctccaaacaaaataagtagtcaggttcagactaatagggaactacaaaaaataggtgtaagcaactagctgctacaggaaacaataaccaccgcatatgttgagacaaattgaacatggaactgatgcttcagtattagtttttgaatggcttgtgtagttatatgtaatggagacaaatggttcctttaaatactatatggaacttaccccaggcaagatatcagtcccaacttcttgcaaaagcttctccatctcactaacctagataacaggagagtaaaatacgtgtaatgttagattgtacttcgaatagctagtaataataggaaaagaaaacaattcaatgggcttacagaatacatacctcatgtcggggtattctttgtttgatatcgtcaaagaacttcaggccaatcctctgagcacttgtaagtgaatcgtctttttgaaggtcatccagtgtacgatgtcctttatcatataacttgagagcagttgcaggaccaacaccccaaacttcgccaaataggctgacagttcgaacctttaaggtgatatgcaaatcagtaaatatcagggagtatggctggataatgcttaagagctactcctgttcactgaaaaccaagttaccttctcatcattctcaaagtgctctagcttggaaagctttcctgtatttactatctcattaatctgcatatacaagggtagttagacaatcaaacacctgagatattacatgtagaacgatgaatgtatgaattcatattttccttggaacttctgtggtacttttagaacctgtttgctcaatgaaggtgtgaataaattttcagccctcaacagcaaaacaaaatagaagaccaacatatttttaagaaaacagagttatgacacagttactacatcacccatagaccatagtggataaaaaaatagaatcatgaacttgtacaaaggccaaaaatatatatgttgacttgtaaatcaccaattaatatgaattaatggtagaaaaggattaacatacatggtctttcaatgatttcccaatagcagggaggtctttaacttgatcagcgctttctattttgaatggcaatttctcaatcactggaatagccttgtaatagctaaatgatcttcggtcatctcccagggcttcaagtgaaagggaaggaaatgttatttgtagagaaagtatatgaaatgttaatacaatgaataagaagaatgagaagatttctgtacaatgtccttacctctatatatattgatcagctttccaaaaatctcagttatgttcctgttcaagtctggagagcatacgttgaggattctccagaagaggcttcctagttatataagcaatgaatcaacactaggaaatataaatcctcagggttcaggagttatatgttgtatggtacagagcaatatatcaccattgagggtgcaaaatagatatacagctgaccaccaaaggtcttaaagttgctacagcagtgttttcatttttgaacagataaaggcaactgcgtacatttttatagcagaagaaaaacagtctcaagtctagtcatgttgaagtcagtgtagatgtaacttagagcttagagtaagctaattacaaaaaggagaagctaaaaagtgtttcctcttttttgtttacatatgttcagaatggagcttgtacgaatttgagcaaaccaaagaggataagtgcagcaaaacaacataacccagactttagagcccagttagtttgtactataatttataagaccatgcttatacctcagctttgaatgcattttgagaagctatggtttccttagaatctccagaggcactttggctacttgtacacgtgctaggcccctttacaacatccgaatcttcatttggatgtgcaattgcatctcgagattctcgattacccccagcagtttccttccgattctcaggaccgtctgatgatattttgctcctctttgcagactgcaacacacctgaacctgcagcaccaccttccttcttcggcttaaattcctcttcgtagttgatagcaaacttgtgctccggtagcctctccccggatttgaggcactcctccagccactcgaatgacaccacgctctgcaatcaaaaaaaaaatcagttcttatagtagtaaatacaatcacttgatgttagccgagatctctctgcaacaaaaatccagtccttatagaaagaaacacaatcacttgatgttagcagaaatctttccatgttatgaaatctctataactcaatgtagtactactactagcagtagatttgggctgtgaaaatgcagatggtagcaaggcacaccaagcttgccgagaggagattagggtttcaagctagggagccaagccgattaccccgcgaaagcggtggagccaggcggcgtcgagctcccggagcagcgccttggcgtcggcggccaggacgtgggtgaccgcgccgccgccgcccttggcggcgagcttctcctggacgcgtccccccatctgcgccagcctctgcttccacacctgcaccgacgacgaaagccaggaaaccctaagcacaggagagagagttggtgggggttgggatggattgctcggtggagccgcgacctcgaggcggcgagactggacggcgtgggggacgacgaaggcggagacgccgcggaacatgccgtcggggtccaacttcgccgccgccgccctcgccggcggcttccgcttcggagccatggagaactcccgccttctcccttcctcgctgacttcagagttcagagccacaggggttttggggaggttttagaatttcttcttcatcagggttcctttaaaaccctaaaatttagaatttactggattttcgtagaatctactagttcagttattttaaaaaccttttaaatttttcccatttcaaagaaggcctgacaggttgtccaagaaattatttctgaaatttgtggatgaattgaaattcaaaccacaagccacaaggcacaatcaagaacagctccacagattatcagagacaaatgagcaaaagcacacagtaatttgcataaatatcatttacatcatccgatgtacaacaaattaatcaagccacacgcaaaatctatattgtaagtatgtaaagctcaaatcctcaatgctgctctcctcctaatattgggaggggcttattgcttgtgagcaaatcaaatcaatacctatagttccttttctgttttccctcaaattttacaactcaagcattgtacaaaacaagaaaacaagcaaaatggcaaaccaaagtatcaacagtagtatccacccatctgggttaaaaactgtgtactgttgctaactaactgtaaccagctcaggcagtttctgtggtgtctgcttctagtgagggtttgtcagtggctgtttctgtgtcaccttgcaatggcgcctcctcaacggcagcatcctccggtgatgacttggtcgcgccatcttcttcctctgatggtttgtgagcctctggcttttcaaggtccatgctatcctctgatggcttggcgctgtcatcatcttccactgatggcttatcaagaaccacactgtcctctgatggcttcgcactcgcctcgtcttcctccaacggtttctcaagaccagcattgtcctgtgttggctccacacttcccttgtcttcctctggttccttctcaagagttacagggtcctctgtctgcttggtgccagcatcatctttctccgatggcttctcaaaggtcgtactgtcttctggtagcttggcactcgcctcatcctcctccaatgttttctcaagagcatcattgccttctgatggctttacacttccctcatcttcctctgatgccttctcaagagttatagtgttctctgatggctccacgctggcgctatcgtcctgcggcggctcctcaagagcactgctgtcttcggatggctttatgctggcctcgtcgtcgtgttttggttcctcgacagctatggcactttctgatggcgtttctatggatgcactgctctgaggtggtgcctcctcagaaacgttgccgtctgcagcttcgctaatgcttatgctactctttggagtgttatgaggcagggtttcagtatctggggtgctttctgatggtttatcatgcacatcatcactttcgatttccggtggcttctcatcctcgacagatgcatcattttcaggctccaatggctgctcagttgacttgtcagaagcttcatcagtttgaggttctgatggaacctcgttagttctatcactttgatgcagcactggtgtctcaactccagtttgagattctgataacacctcagctgacctttcagcagctgcatcaatttgaggttctgctggatcctcggtaaccacatcactttcacgcagtgttgccttctcacctgcagttcgagattctgatggctgctcagccaactgatcagaagcagtatctctttcaggttctgatgactccttggcagttgcatcactattatgctcttgtggattctcttcatatgcttcgtgttgaggttccaatggctgctctgaagctgcagccttttgattttctaatggttgctccgttgcaactttagcaggtgcaacatcttgggactctgatgactggtcagcagctggatcggtgttagcttctaatatctggtcagatgtcttctcggcagatacaatgccttgaggtcctactaactgctcagcagttggcctgatttgagcatctgatgagttcacaccagaagtggcatcactttcaggctcggtaggattcccaacattggcatcaacctgaggtggcttctcaagactgagatcactttgttttgttgtgctttcagcattagcttcattttgaagtggcttctcagcagtctcttcactctcgtgtggctgctcagaaggttcattggtttgcggtagcttctctgcagcatcttctttagatggcttttcggttagagtagcagtttgagatagcttctcaacagccatggtactttctggtaatttatctgtcagtatctccctctcggagatttcctgatgagctgcatcacttggagatggttctgacatggcttctacactttgggtcaggggtagctcgtcagtagcaatatcagtctgtgatggcttctcattttcagcagtgttttctgatggcttcttagatggttcagtgatctgagatgatgctacagcaagtatgtcactttctgacaatttttctgtggaagtatcagcttgcgatttatttgcagtaagtggtagttttttggcactttcacttatttgtgatgaattctctgtggtagcaccattgttctttttatcttgaatgatctgtgatttgttatcagcagtcacattggttttctctgcttcttcagcaagtacacggttttgtaacggtttgttgctagatatatccttctctggctctttttctctagacacgcttctttgccatggctttttcacaaccacgctgctttggagcgggttggtgctagccacactaacttgtgatggtgtcacaaccgacgcaccgctttgcgattgcttttcagttggaacattgcgctgccacaatcttttgcccattcccctgctttcaggtgtctttgcatcagttacactgctctggggctgtttctggaatccgatgttacgttgccattgctttttaaccactgctgcagtgctctctgatggctttacatcatctgcactggtctgtgaaggtttctccgtgattccactgtgttcctgtggcacagtgggtgttgtactggtttctgccagcttcacatcgatagcactgctagatgacttctcagtgtctgtattgttctgcagtggcttctccgtgtctatattgttctgcagtggcttctcattgaccactttgtgctcccatggccttttaattgatgtggtgctttctgatggctttgtatcatttgtcaatgatgacttctcagttggtccactgttctgtatctgcgcctcagcagccacagcacgttgccatggttttctgatcaatttgctgttttctgatggcttcacatcatctgcactggttgatgatggcttatctgatggcgaaatgctctgcggtagattctccgtagctaccctccgttgccatggcctttttaccactgtgctggcagtgctgctttctggctgttttgcatcaaccccattacttggcaatgattcctcaatggcagcactgcttggagttgacttttcagtggttgtgttactcagcaatggcttatctgtgggaagattgcgctgccatggttttcttacggctgcactacttcctgatggctgtaagttaactgcactgctctggaatggcttttctacactgctttccaatggcttcttgctgactacatgactatttgactcacccttggtaaccctttccccttcttctgacctctgaactgttgtgctgctttctgattgttttgggacatcaacgctactttgtgattgcttttcagccacaatatcgtcttgtgacggtttctcaggagtgagttcactttctaaaggtttctcagtgagcccatcaccttgacctgggcctcctggattcttggtagcatcttcatgttctggttgcttctcgatatccacttttgcatttggagtactatcctcaaaattgctgaagtttcccttaaccataaataattgagagtgatgggtcttgcaataaagtttgccttcatgtgtgacattgttggatgggctaagagtacagcctccatgggtgcaacggaagcatgatttatgatatgagctcccgttaagattaacctgcaaaatattaattgaattaatcatttcttatcggttatcctaacattgcattcttctatagcttacataagttagccacagaaaatgactaatgcagtagtatgagggaaaaaagtatataacgcccaaatattgctaaaaatatagcatattggcatgtaataaatgtgttcttaaatattgtcaaaaaataggtcaatgaactgattctacaacattgtgaaaatttgacagcaattcagtattttaggaaagggtatagaagtctccatttggcttagcttgccactctttttgcttgtgagaagaaaattattgatacttaattacaactggaaaactttatcagatgtagtaattctaattattgtggatatattctaataacaagcacgataagatttatcgcattagcagttgccactgaattagtcttgtgatggagcacataagatgatgaggccaactacaatgctcaattgtcaaccatatcataaatagaagagcgcttacatgattaattccctgaacaggagaacagctgttggtttataacatttattgaagttgaacaggggaagattaaataatacagtagtataatactgaccttttcaagagggtacacagtcttgttacaaactacgcacttgtcttgtgtgccaacaaacatgctagagaatctgttcggttgcccctgcagtttggataacataaaagaggaagtggacatgaatgttatgtcctctacatcaaagctgccaaacaatttagatactagggacgtgcttcaaaaacataaaagagcatatcttagaaatatattacgataccttgtttccattcgatttttctgctttagctgattttgatgtccctggcataatatagtcaaaatttagggcaggcctaaaaatcatgagacaatagcaacaatttcgaggtaaagacactagcaataattaaggcatcaagcccagtggatttagttttctcttcagtaccttcaaaacttttctccaaactgccggttgatttcaatatctggtcatagtgaggtttgcaatataggacaccttcgacagaagaatagttactaaactgtaaaagataataaaaaaatattagctggtttcatatatgtagcttagttgcaaacagaacaagataggtgtagttctagctagtatgatgaggcataaagatttagtgtgatcattattattctcaacagaaatataccaaaaccaagaaaaaaacatgctagctgcatttacatccatgatgcattgaggacagcatgattaattccatgttattactttcaaaaggcaggctaatcatacggcactcaccaacagcataataccaacctagcaaatcagccagcactatatttaataggtgaaccagtcagttcaggaatatgatgaacagacaacagttgtaccaaaaaaaacaaacatttatttgctaccctatccattccagtccatccctcatgccacaataacaagaaaaataattgggatatttactaagacgccaagaaattgcgtcgaagatggattaaacaaataaaccgtggttaggcaaatttactgatgcttcgtgggttcgttatcacataaacggatagcaaagtgattggttatccagttagtcaatcacagtcgcaacttgattattgaaatgagcatgcaacctaactcccatcttcgactggtctcgagaaaagaaaaaaagaaaaagaaaaaagcaggccatacagtacagcaacaacaactaaagcattccaagatggatatgatttcaggaagccgatagtactcgcaataatagcatcgacccagattaacaaaaacaaggcataaagccagtacaaaaaaaaaatctggtaattaatggatggatcgagcagagtaggggacgggggacctggagggtggccttgcagtgggtgcagcggaagcacgggcggtggtagacgcggccgtcggcggcgagctcctcgacggggtagaccgtcctcccgcacgagtcgcacttctgcgtcgtgccgccccacgccgccgccgccatcccggcttccccccccccccccctccacctccgcctccgcctccgcctccgcgccgccctggatgcttctcgttctcgccgcgcgcgcgcgaggttgtgtgtgtgtggggaggaaggtggtggggaagaggagaaggaggaggaggaggcgatgatgattagtgaaggcgaaagcagcggcagcacagctcagcttggggagggggcgggtggagggaagcgttggcgaataacggggaacggcagcgcagaggagacgggggagtgggtgcggcgtgcgctcaaaaaggagggaaggggaaatgctacgggcactccgacgagaaaaaaaggaataagagcctcatctttccgcttacttatcagctagtaaaatttaaatttttaaccttaaatttaatttaaattgattttaaggtttattttactcgaattttattttttaatctttacttttaaatcgctaagaacacgtttataaaagttttatttacaaattattttttagatcaattttacgtgcggttaataagctcgacctattccccatattaacggggccataattatctgcgagactgcgactgccctactagagacatgcatagtatgatgtgctatgttagtgacactaactacacatgaagttaagcgaaggatcgcctctctctactagcctttaaactttgacctaatattgtctgtgtgattttgaacagaatggaaaacccatagatgaatacatgtgaattgtccaatgcattttatgctttatcagttatagatggtacgcgctagtataaacggttgtccgtgctcatcaatgatccatagcgttatatgtgttggtagtgtttttcattcattgttactatacttctagactgttttataattattttttaacaagttgttcttttatttctcttacatttcaagcagtatgatcacttgcgtgaatagaaaaaaacaactttcccaacgtaaaagaaagtattttttttgtcaaacgtaaaattattgatcgttagacaagaacacatatgcaaataaggcatcttcttttcgcttatacttatgcttataagttaaaatttaaattttcaatcttaaatttggagctgattttgaggttttttcatcgaaatttattttttagctgttgcttttagattgataagaacacgtatataaaagttttattcacgaattattttccatttgcaaataagctgtttcgctggatggctccgtaaatgttgcatcacacgaacacaaggttaaataggaacctgtcatgtcaataaagttagaccgtaagatagcatctactaatattcatttaaccgtttaagaaaatggattattagacatttggtacataaaacatgtactctcagcattatcattgcctactaagggagcatttatttgcacctttaccattccattatccagagcccacccaaacacgagcatgacacgcagaccctacactatcgtgcacccacatgtcaaaaataacaaacaagagtgtgtctgtgtgtgcaacatctccgtgaccgtaccatttcaccccccgactttccccaccgaagtggcccccggcgacgatttctttcttttccttctttcccctctccaaatccgatccagcccgtcgcagccaactcttgccggtgcatatctcctccgcttttttcgtactcaccatgcatgtacctaccctacaagttccactgacagaccccgcctcttggttgaagggcccacctgtcatgcaaaggggtagcctaccacggttgatcggggattgcggattgggcttattatggccgattcgccgaaagtgcaacagggtgtggccccaccgtccggcgccgtcgatgtcatccctcccgacgccgagcggcgccgcgagcgccgtccgtttctggcggagcccgtagggcgctgtcgcccaccagggttcccaattcagccccaatcgtttgtcacgtatataaataaaaaaacttatatatatacgtgttcttaatgatctaaaagtaagactaaaaaataaactatgataaaaaaaatccaaaattaacttttaaatttaaagttgaaaatttaaattttaaatgataagtatgggcgaaaagatgaggctatagagttgatcgcaacagctgcagcaaacctaatataatgtctactactgtagatacaacacgaaaaaaattactaatatacttatttttttcaataatttacgtttatatatctgtattgtaaggatttataaaaatatacccatcctacaacggtcccgcagctctaaaaacacgggagcgacggtcccgtaaatctaaaacgcgggaccgtcacggtcacacgtgaccaaaacgcggcaccgccatagcagcgatttttatcaatgcgttgacactgttcacgcactgttttatactgttcacacactatctggcaatgttactatttggcactgtttgcatgccggttccgcacaatgggtctgcgggactgtaataaacagtgctaaacagtgtttaaaacagtactaaacagtgccgatcggataataaaatcgctctagccgcggtgccgtgttttggtcgcgcgggaccgtcgcggtcccgcattttggatccgtgggaccgtcgtggtgcagcactaccgtcctgtgggaccgtcgcgagataggtatatttttacaatttctttccatgcatatatataatggtaaattattgaaaaaaaaagtatatttacaaattttttccgatacaacacagccacagccatagcttgctgcaaagcagcacaaaagatcagcccctatatcggatcaaaatccactcacaagctgtatcatcagatttcgtggaacctattaacaaaccgataaaatccggcaaattttatcaaaagtttaaaattcactatggatttttgaacttaacggaaaaaaaaagagtggtttgtatttttaatccggttttcacgaaatccaaatcggatctcactcaggcttggttcgatagatgagtttgaagaaagatttccggtgcacgcgaaacaagaaaactcactagcaaatgattaatcaaatattaactattataaatttaaaaaatagatttatttaatttttttaaaaataacttctatgtagaattttttttaaaaaaaaacacacatcatttaacaatttaaaaaaaatatactaatggaaaataagaaagttaaagtttggagtcgaagaaaactgtgaacctgatcgctaccgtcgtatgggtgcggtgccgcacgcccgcacggcgagaggtggctgggctggcgagctattcgagtactcgtatcaaactagacaacggggcgagctttcgggcaaaagaaaaatgcgatggagtgcggccggttttttctgttggctgtaaagcggttggttcttttccgctggcaaaacctttcgttgcggcgcacacggccagccgggcaccgcgcacattctgccgggccgggggcctctcttttgcgggcggactcctggtcgcgaatcatggcgctagctagcttcgtgcacgcacgggcgggcacacggccgcggaaagcgtacgtacgtgctcgccactggagtacgactcaaatcgatcggatatcccgtgcaaatgatggtgtggtgtggtgtcccgggatcgttcgctcggcgggcacagcagcgaggaggagaacgagagctttggctgcgtgccgtggcgggaggtggaatggactaatgggggcgggggcgacggcccggccgaaatagtataggttttggatgcgagaaacggcccaacaatggcagtggtgtctgggcctctctgcctgagggacacacggacgcacagggcactgtcggtgtcaatgagcagccttgcactgcagtggcaatcggcaacttgaattccatcctccttctaacccattggtgtgacctctacaacctcctgcttcttctttttttttaacgtgtcctgtaactcagacttaggccctatttagtttcaaagttttttttcaaacttccaacttttcatcacatcaaaccttttatacacacataacttttctatcacatcgtaccaatttcaaccaaacttccaaacttcagtgtgaactaaacacagcattactaaaatgtgactacaacatataggtatagaaaaaaattttggttgcaaaattgtactagtaagggcttgtgtagttcgcgaacgaaaattttaggctgtgtcacatcagatatatggacaatcatttgaagtattaaacgtagactaataacgaaacgattttgcttggaaactgcgagatgaatctattaagcctaattaatccttcattagcaaatgtttactataacaccacattatcaaatcatggcgtaattaggtttaaaagattcgtcttgcaatttacacgtaatttgtgtaattagtttttttactatatttaatactctatacatgtatccaaacattaaatacatgtatccaaatatttaatgtgacaggtgaaaaattttcgtttcgaaactaaacagggccttaagtcaagaacacaccatatttatatcggaatggctatctgtaatcacaacctttccgaattccaatggatgaacacggggcttaattgctaacatataccagtatactgctgcacctttcatcctcgcaattaattctgctaattttgtgcagtgaatttattcacagttagcttaggtgaagctgcactcgggtggcggcactgggcgcttcttgctattgtcggtgcagtagtcataggtcaggttccccctcacgccatcgtacgccgcctgctgcgccgccgtcagcctcctgtactcgccgccgttccaccaccacgtgtccggcgacccgcagtcgtccgagctgacgccgccgccggcggcggcggcgcaggcgtcgacggcgaagccctggaaggccgcggtgaatggcgcgcgggcccagtcgaccttggtccggccgccgtccgtcgcccagtcggaggcgtcccacacgctcccccgcggccgcataggcttcgccgggaactcgaactccgggccccggctcgtcaggttcttcagcaccctcaccggcgtctcgtccacgaatatcctgccaaataattaatcaaatcgatggcttgtacatgtgatttgtcttagcttctacagaattcaggtggtcattttgtaggagttagatttatccaggttttaaatctccgtctagagctgcttgagaagggtcaactgctaaatgttatagcccgctatttaaaacactggatttatcccatcgcttattgtatgtgcaagtgtttgttggtagagacggaagatgtaactatttctactatttgttttaaaacaaaagtgtatacggccgtcatggtgacattgaactgagcttacacgaggtggaaggggttccagaggatggagtagtcatggaagtcggcagcggggtcgaaccagaggcggaggcgctgctcgcggtcgccgtggccgccgacgaagacgttggtttgaagggtgatggggttgccatccttgtcgccaaggaactcgaagtccacctcgtcctgcacgtcccagtctggctctgacgccagctacccgtgcaatttcagaaataaattaaattaattgttacattcagttaattactggtgcttagtttttagtcaatattaaagaacatgtgataggaattaacacttatataattaagtgaagttgatttagcagtttagcactcacatagtaggctgtcacaacgccggcagtgtagccggcaggaaccttgatcctcatgtggaagaaccctgagccgtacatcaacttggacctgaatccagcacctgcatgcatgataattaatttgcatgatcacatcaagctagttaagcataaaatagagagagaaaagaagcaaaaactatgatcaagctgatctaaatgctgaatctaacagtgtcatatatataatctatctgtgtgtataccagagctcttgtccagggtgaggctaatctgcgtgccctggttgaccaggtggtagccgtctccaccatatgttgccacgtagttgtcgtcgaacaccgtcgccaccgccggcggcggcgccggcgccggcggcacactatccacggccaggaggaggacggcgatggcgatgaggtggaggaggagcagccatggcggctgcacttggaaaaccatatatatactttagccaatgtttgctagtactaactaattaattaactcgattgattattgcaatggagaagttcttgtgtacgtagctcacctagctagctagctagctagcagtccgttatatagtgttgatgtgtcttgatgatgatctgatccgagctagatttgatatatagtagcaatgatcatcagatggagatttttcgatcgacaggaggatgatgatgcatgaaacggattgatttgggaaggtgtgagctgtggagtgtacgttttatctgcctgcctgcctggccctgagagcttctcatggagttcgaacagaagccaacttgattagcgttgtgtgtacatcagcttacttgattagcaaaaacattgcctttgttctatcacctgttcctaagggcaagtgctatggtagatgtgactaccatctccaaatttatctattttattcactcatgaattaagatgcaacacatacaatatatcgtatttggtacacaaatacaaatatttctaatactctcacactcttcttgaaatttgtgtagatgttgcctcttgacttagggatggctcatcttctctctcctcacttctctcctccacctcatcactctatccaatatggtatttttaagggcaacatatggaacattatagtacttgccctaatgacttcatctttgataggtcacaggaaagaaattaaccgacacaaataactaggtcatcttttacgggccgtgtcaagtagtattctcacccgatacggatggggcttatttgtaacgtgcatcttttaattaccacccttcacccatcactgatgtggtcttttagaaaaaaaaatggttttatcggaataaatttccacaatatatatacaaatgtttttcttcacacatgtgtgtgtgtgtatatatatatatatatatatatatatatagtgatcgactgatcgtggaacattccaccactcatcatacattggaataaatttccatacactgaaaattacaactagcatgtatttggtgctagttcattggtttcattattgttatttggttgtctcctgtgaggactggcatatgtattaagggcttgagatttgagaattcgtatgctagtgatagtggtttacggatatagtattagtccggcaaagtttagctagagtttggcttgtgtcttcagttccttgaaacacttccaatattaaccaaattattgcacttgatttagagaaatgacagaaatgatatggggaaattggttgctgacaagattccagagaataggcacggtgaaagacaccaatttcgtgatgtcaccaaccaaaccaaaacattcctttgcaactaatgctagttccaatgaaagattttgtcagaattagggttttgaccacggcaggattactagctgaacaaattccgtccaactacaacaaatatcgcctgacacaaacgacaaccaatcaatctgaggactagcctagtaaccaatggcatcgacatctcccatttttagtttaatttgtgtcgaactgtcgatgaacgacacactctagaatatcccaagtagtagtcttaaacagtgctttattacatatgttgaacaagatcactgacaacacgataaattattgtagtagattgcaagaatcattatatgtcacaattggtactttgccatttaagaaattaaacatacaaccacgcaacatcgataggagtaaatttggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatggtgcttcctaatcttatatgcttcctcatttgagaaagaagcatctgcattaaggaaatcatccaaggaatgcccagcaagggattagcatatttccatggaattataacaattaaacatgaactcagtcaatcccattctacatggatgatcttgcaaatttggatcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatgcaaagagtgaagccattataatataatatataatgttcatcatatggtctatttcaaccaatatgaatgatcaatttgagatcaatgcttccagaaaaaatgcatatggacagttcaatgactaacctacagagttaactagtttaccaaaattttctatgacaagcataaatcatgctctattgctcttccccatgttcttctttcgtttcttcaagtagtgccaaaacaaccatgattgtgtggctaattatgcagaaagtatcccttccaagcagaagtcatggtttaggccattttttcgaagctactttgcaaaaataaacaagaacacctaaaagaaaatgtctatttccttttcgctcatctcatatacatgatcccgtgcctcagacagagcaacctgcattgactcaaccagcatgaataaaacataactcaaatgacaccatgaatagccaactggtacggcaactgacctgtccaaatttagtgaagaagttgtttgcaagatttaatgatgtgactgcaagatcttcattagctttaagtgcttgtgccaatgcaaatgctccatcatcctgttaggagcataaagggtattgaacatggtggagatctgcatagacccaccaatagaaaatacaaaaagaaaaagacactgcatttagtgtttacttactctaatctcattaaagcccaggtcaagtgaagtcaaagattcattgatgatcttgaaacttcgagccaagcagatagcacccttcaaaaagagaaggatcagaaggcatgggtatgaatcaaagcgcaagttataaataaaattcaacgaagattgtgcatacatcatctccaagtccatttgccctcaaatccaatgtagataatgttgtgttgtacttcaaacaatcagcaacaaattctgcacctgatacacctatctgcaaaatatgtaaccaggctgaagaggatataacttaaatctgcatccgcgattccattcagttatgaagattacctggcaccaaccaagtttaagggtttggattttcccattgaacttgagaacatcacaaagagcctttaccccctctggcccaatcggattatagctcaactccaactacagacaacattcagaattagtgcaagtacagcactaccttcttgtgcagactaaaaaagtcagaataagatgacttactgttgtcaccactgaattatccttcagagtttcagctattgcacttacccctttagagtgaatgttattaccaccctgcaaatttaaaaggcttaagacctagagcatgtgtatacctgtttacaagaatatttggatgtgggacatctaaagaatacagttccttttttccctccaagttcctctattctgaataaggtttgttgtataggttctacactcactttacaacattagaaaagcaaccctgaaggttatggggaattcaatagtccatggattaagagatactagcatggcagtccgcacgttgcaactgatccgaataagtattataatatctaatattacaatgaagacaataattaacatcaaatctagaaaatttatagtttactacatggagacgatcaatcacataaatatacagatgtgcaaataatgcagtttctttaagagaatcatgcaaacaaccatatacttgtctacatatatctagccacaaaagatttattgaagtaggactgggtcagtgggtgaactgtagacggtagaacacacaatcaactgaactactctttataaaagaacaaagatataaagaggagaaacctgaaactttgttctgagattatatggtgatattataataataatttacaaaacagagggtagtatatgaaactcttgggtgttattaatagtcaaataggtgcttaccaagtctacagtagaaattgttttattctgtttcagagcatctgcaaccttttcagctccctggtgacattcatattaatttatgttacaaaaccaaacaaaatcaccttccttctctaaaaatgccaaacaaagtaaacataattacataaatgtgtacccatttgatacgttggatcacatgtgaaaaaccatgtatatgaattaagaaaacaagtaaatctcccgctctttgatgtactatggagttaaagagtgatgggggtagcatcgaattataaagtataaaataagaactggagcatcatgtatatgtcaattttacaagaaacaggatttaggcaagaagtttaaacctaagtaactaacagcctaagttctaaagcagtactctatttagctcatagttccataatagcagaaattatatattggtttggcataagcatcattaaatgcttaataaaatcttgcgggtgtttgataagcaaatttctctagcttgatcatgtcctattatatgtagcaatcagaaaatttcagtcactggcataaaacagaacaggtaaatgataacagaagtactacctcatcacttatatcgttcatgtatagactgagccatagtaaagactttgtccttttgatgaactcagcaacatgaagagaaccttcagaggtaatgttgttgttaccaatatccaaaacagtgatcttccctgtagttcatccaagaaggccaaaataggggtaaactaatcccgtaagaagctactagttgatttgtttagtgcagaaaatacctttgtgagcagacaacgctgacatcaatgcacgtactccctcattcccaaaaccattgccatgcaaatgaagttcctaacaaaggtttaaaacaatcaacaatctagttattatggtataatgaatgtgcacctgactaattaagtaagacaggaacaaaataccatacattcgaaaagaaaattgagaaaaatggtaaaacaatagctcatggaaaaatttcctagtttactattgaacaaaaggttgtaacttgcatggattcttaacacattgtttgcttttagtaatacatggtattggtgttgaaggagtttaaggatatcagctaaccaatactccctccgtcccaaaaaaagtgaatctaagactggatgtgacatattatagtacaatgaatctggacagaggtatgtccggattcgtagtactaggatgtgtcacatccaatactatattggttttttatgggacggagggagtatgtgacaaaaatttcatattccaataggagtacaattttccttaaattgagtaaaatttaattaactggcctttaagatgcacgtgttgtgtattgctggcaatttgatccaatttcttacacaacatagagagttcagcacaaaaatgcgggtgcagtacatggacaatcacaactgtgcactgctccccatgattgctgcaaactttaaattcaacgcactttgaaagggtataggatagtacatgtagcttcacatgcctttggagatgcatgtatctattatatgggttccttttttgcttgtaggtatctatgattataagtgcaaaagctagtctaacaatcttatgcatcgtaaaaaagaaaaagagaaggtctaaccatcttgtgccatgcatcctttaatattgagaatgtcacatttttaagtgctcacgttttttaaacatccactcagcatttcaactttaaatttgagaagaaagtcaatatagtacgaaaccatcagaaagaagtaggagagaaatttggttgcatgtgatatcattcatacaaaaaagtacttaccccatcagtaatccaatataaatattgtatgtccctaatataaaataaaaacaaaaagatagaatggcatctggtttgctcacaagatttgcaactttaccaaacattcgaacaatcaaactacactgaagtatttcatcaagtatgtgtggagttgtaccctcaaagttttgttccctagaattccttttgctaggctggatgcaccaagaggaccaccatagttgccactagagtaaatagacaaagtacatgtcagttagttccagaaaatgaactaccaatgtaatcactaccgcagtatctcagcacaacttcatatgcacactcatcatatatcacatataaagccactgggttgtgagcaactaacttgacaaataagctccgtagcacattattctcaaggagtgcttctgcaatacttgcaaaaccctgctccaagaaaaaggagatatagtaaatagcaatccttcaataaacaatcatatggttagtttttcttttctatttgtgattcaagtgcatgtcttcgatgaagtggatacatatacatacgctgtattctattgtgttgttgctgagttgtaaagtacgtatcgtcttgttctttttcaacatatccgaaattgcttttgccccctgaaaagaaaatatcatgttacattgcagtgcacgcgcatgaaacaacacacaaagagtgcaagagagacagagagagggaaggagggagagatacaaacctcgtctccaatatttgtactgttcaataggagcttctggatacctacattctctaccaatatatctgaaagacactgtaagtattcatgagtgttacattcagtcaggaggacttagttaaagttaagtttacatctatacatatcatgctgggtaggttctatcatatttgctcccaatgaatgataatatcagcaagatgagtatttgaataatcgataaactatcacagtgtacaaactccagttaggcataaaggcaaacaataacaatgcaactcgtaaaaggtgctaatgtgaaacagccaaccttttgataacaagttaaaaggtaagtaataacatggttatgtaatcatatgagttcagacttcagaaaatgaaattaagaagagaacattgtctgcatagtatacatcacaccaacaatctacaaaaacaaaatgatacgaagaggcaataagattgagaagaccttagctccttcgtctccaatggcatttccagataagttgagagattttaaggctgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttcattatttcatattataagttgcttcgacttcttttgtaatcaaacatttttaagtttgataaagttttaaaaaaatatatagcaacattattaacacaaaataaacatattatcaaaacatattaaatgttagttttaatgaaactaatttattatctagatgttgataattttgttccataaatttaatcaaacttaaaaaaatgactagaaaaaagtgaaagcggcttataatatgaaatggagaaaatatatagcatctaacggtgtactagtatatccgcgagatataaatgttacaagcccttgagaaattcgcatgagcttgcaactgtggtaattgtgcacatattcagatatattctaccaagtcctgtgaaacgatgccatctaatgtgcagggaacagagctccccacgcatgttggatcaatgggagtcgaattggcgaagcaaaaggatgcgccgcggcgggggagggggaggaggaggaggaggaaacaaggcaaaggccgtaccaaagctcagggcgaggaccgccgcggccgggacgacgtacggcgagacgcccctgaccgccgccgccgccgccgccgccggtggtgcctccccctgctccacgcggtactccctccggcgcgcgcccccgcggccgacccccccggggggcctgtccgcgctgccgtcgaacagctcgcgcgcggcgcgggtcacggcgaacgagtaggacgcgggcgatgcgtggcgggacgaggacgaggaggaggggaggcgccgatgcggcggcgtggggagggagaggtggtgatggtggcggcggcgcggggcggaggggaggaggacgaagggcttgaggaggagggaggactccatgggaggcgggaggggtggtgtcgagatggagacgaggaaggggagagtcggagaggggggaaggtaaggttgtggatcatgtcaggtttttttggttttttttttagtattttggtttatccagtttttagcctggctggccaattcaacctttttttatcttgatttttgattcgttaaaacgatatttatttgagaggaaccaatttaatctatagatttacaaattttgcgtatggagggcactctttgtattaaccactctttcctctcgaagcaaaagtcatccaacataaaccatgagttgacatttggaagaatcctagaagatagccaccaacaatcctgatgagatgatgagatcacttctcttaaactaagggcctatttggtatagctccaactcctaaatttagctccaggagtttggtctggagtggagatgtggagctacctaaacccagttccacaactctagttcattttatgagagagctccacccagctccactcccagttttggtggagctgaaactgtttggctgagctccagctccaggaggggtggagctggagctggagctgtgcgaaacagaccctaatactccctctgtctctaaatataatggattttggtggatgtgacgcattctagtacaacgaatctggataaaacctctgtccctaaatataatggattttggtgggatgtgacatatcctagtacaataaatcttgtctagattcgttgtactagaaatgtgtcacatcccaccaaaattccttatatttagggacggagagagtataataggttagagttagagttttctttccccctcaatgtataccaagtgtgttcacaaatcactccccccgacctagtataattacactagtagcatttatcccctaaagggtctatttgtattgaaatcgacaaaggtggatcccacttcatatagactgcactgagccataaagtactgatagatatcttttcagcgttgtatgctcgtttattgctatatgaatattctatctgccctcaaaaaatattctatctgcgggcaccctaggtaatataccgtccagtgtccaacgtgaccatcacatgtatttggataagtaggataaaaatacatttggtgatcacgttggatattggatagtatattacctagggtgccccaacactatccatctctctttccacaatcacatcatgcatatcacaagcacattctaactatctaagctaccaagactaagaaaaaaaagacaaaaacggagcccaaaacaatcatcgaagaagagcttatcgtaaggccgcacaaagtcttcgacttcacgagacaagtgttatcattgccgagcttgtcgcctagcgacatagcagctccaacttcacagctgttacatcatcattgccaaaggtatcgccaaaacgaacaaaacaacaccaactgcttgctttggacatcaacccaagccaaccaagcaccacttcttgcaaacacttcttgcaaacagctaacaccagcacccctagagactacaacgtgttatcgttgccgagctttgttgcaccacaacgaagtagcttcgacttcacctagccgaaacgaagaaagttggatgctcaccacaaccaagacaaaagccagaaggtgaatgccttgccaaacagctaagcctatggagtttcgacactggagtctaccaacgaccattgttgcacaggcaaggttcttgatagtggaggagaaatgacgccaaaacgacgcctccaaggagggaaacaacacctaagggtttcgtcgttgtcaagctagccaaaggctagccaaggctttcaccaacaattttcatccaacaccacacaacccacctgcacaacatcgtcaccagaccatcgcgttgtccctctagctgccaagcctagccacatcacccacagatcaggcaagttcacgccgcccccaatctggccatggcataccatttacgaggattaaaactgtataaaagtttttcttcctgtctctagctacatcttcatttgcatttcatactaaccgattgttccaactctatacatacgaatactgtagcaggaagtggaactttcttcgtcgacaatcaacatttgttagagaacggttttaaatagttacttttaccttgatactacttcatccgtttcacaatataagactttctagcattgtctatattcacatagatattaatgaatctagacacaatgctagaaagttttacattgtgaaacagagggagtagtatttaatttatttgttcgtgccttgataatcgttagaacacagcctaaagtatatgactacgaaatgatttcacttgtgaaagttgattatttccccttttttttcctctctgaacagcaagatattttctttttatacctactaatttgaatttctccgtgttatcttcctgcactaatctaagattagactatcaatgcttcgaggcaccgccgccgccgccgccgccaccgtgcgcgccgcgatcagccgcgcgggccgccgttgtaggcgtcgcaccggcggcgcacctcgccgttggcgccgttcttgacgccgtggtggctgagcctccgggcggcgcgcgcgaagtcggcgaagaacgccgtctcgttggcggcgtaccgctccacgtgcggccgcgtccgcgcgtcgccgtagagctcctggtcggtggcgaggaggccgaggcctcgccggaggttgacgaagtacatgttgtcgaacctccccggcgtcatcacgtcgttgaacgccgcgatggtcgggcccctccggtagtccctgcacgcctcctgcagccgcttcgcgagcgccgggttcatggtcgggtcggcgccgccaccgccgccgccgtagatgcgggcggcgaactccttgcaatgggagaagccgagggtgtgtgcgccggagagcgcgacgaggtcctggacggtgaagcccttggcggcgaacacggcgacgaggcgggagacggtgaggttggcgtgcgggatctcggcgtcgggcgccgacggcgaggaggagagcccgtccttgcggccgaggcggagcgggtagtagggcccccccgtcatggtgacgaggtcgcgcgccgcgacggcgaggaggtcggcgcaggagacgacgcccgggcactccacctccagcgccgccttggcgcgcgccagggcgtcgaaggcgtcacccgggagcgacaggttcacgtcggcgtcgcgctcggagcgcgccgcggcggtggacgcgaccagcacggacgcgtcgcagccgccgacgaagcagtcgtggaagaagaggcggaggacgcccgccgccgtcgtagggttggagatctgcttctgcgccagcacgtcggcgatgatccggtccgcgcgcgggcacgtcttgctgtagtagtccgccgacatcttggcctccgccgcggcggcggcggcgagcaatgccaggacgacgacgaggtgagtgtccatggtcggtttcttggcagcgtgcgatgctacacctaccttttgctagctagcttaccttcaggtatctgagatctcgccatggatggaggaaggattagatggcgggagagcttcttggaggagagcaaatggagggaaagagagtggtagggaatggtctcaggacttggtgtcaacagagttcataaagccgatcgattttcgttaaaccgttaggtcttggttcgtaaaaaccgatcgatattaaccgggttctgtacgacattgatcgaaaatcgtcgatttttattggttcttcgttgttgatgaggagcggtttttacttcgaaaatgaaaaggggattttattgtccaatggaaatatggaataatttgaaattatcttatactccctccgtcccataatagcttacgtttttgactttttatttgcaacgtttgaccattcgttttatttaaaaaaattagtgtaaatataaaaaaagataagtcatatgtaaagtacttttgataataaagcaaatgataaacaaaataaataataattccaaaattttttgaataagacgaatgatcaaacattgacaaacaaaaactcaaaaagacaagtaatatggaacggaggtagtaattcaataaaaacaagagttagttgcgttcgataattcctcttcccaatttctactccctcgtttttcgcgcgaacgttttccgaactactaaaacaatatgttttttttaaaaaaaatatagaaaagttgctttaaaaaaccattaatgtatttttcaatttttaatctaatatacttaattaatcatataatagtatgttacctcgttttaatccattttgtaattattgcatgctttgggctgacggcgatcacatgatcaataacattttgggccctcgttttaatccattttgtaattattacatgctttgggctgacggcgatcacatgatcaattacattttgggtccttttggaacgaataaattttgcctgaggatctcaaaggacgctattcagtgctagcaaaatcgttgacaacttgagatgtgaattgcttgttaaaagagagattccatggagttggcatctcctatggctcatggcaacattccatagcttcagaattttgcaaaaacggcaacttagttcgatgcaagaatactttgctccagcttagcatgcatcaacaaactacacatgaatgacaaatccaaaactgggtaaatggtttgtctttcttacacatcaggaatccagacgagggaagaaggtacattatgtacagcaagcatatggtgaaaagaacctatatttacaactgcttacaaagggaatcgaaacaaaactaaacatacgaatatacgatgaaaagaatcataattggacaatggtggctgcacatatgacaagctatggatgcttctatctcacgatcacatcacgagctcggtctcttaattattttgatacagttcgatgagtggccactgaccaaaaggagcttcaaggggatcgaaaaaaatatttctccaaccatctcaggcctgcacccaatctttctagaataaaccagggaggggttctgttatgaatggtcagggccaaaatgctctgtattttggttaaacagtatgatgcagggaattacctgcaaaaaccaaaggtgaaagataagtatactgaggatacttcataagaaaatactaaaaatagcacagcgaagaatatattacatcactcagcatggctttctcctgtcaattttgaaaggaatgtttaaccatttcttctttgggaaccgctctttggttttcttttcgtttgaatcttcatctgcacttctgcatccacccgtgggttggtctttcactttcttttcctttctctgactgttttcctcctcacctttggaaaattttgaaggcgatttagctttactcctgcttgaactcctcttcagtggtgaattgttggtataggacgcatggatttcattcctttccttcagaagattatcgatctacaaaaagaccatgtggactaagaaaatagtagaatactccctccgtcccataata

SEQ ID NO: 43060 - DNA, 15693 bp, Oryza sativa
tcccttatattatgggacggagtacaaaaatgactatgcaatagaattgtacatactgcttgcatttcttgtgtgtatctgctggtcatctcagtgaactttgccaaaacctgtgaatctcggaatatgaaaaatgttgacagctacgcccagtgcatagaaagaatgtgagggaaaacaaggggaaaggcagcaaccacatacttctctgtgtcggtctcaaatttggatagctctgctcgttttgtgagtatctttgcctcaacactctggagcttctccttttcagcagggaaagattcaccacatacaacctctatagtatagttcacacttctgaagaaattgtcacctgagtgaagcgtagagtttaaggggattcgtactgtcttaagtaattgacactgcaccaacaaacaaagtgattcccatagacagcaaagaagtgtgtgcctggttttagttcatttatatcacatggttggaagctgtccaatcttttaaagaaggcactatcaggatccttgcagcagctgcctgaaattaaaaggaacttgtgagaaatgaatcacagagaagcacttggaggattcaacaacgatgacacatatgtaaactcaccaggttgttttgttcaaaacgatacacaggaaagccaagaaaatacatcccagcagaagtaaccttcccagtctttacactgtcttcctgcgaaaggttgtgcagatggaacaagagaaaacaaacttaagccacttgcatattgcatgaagcaaaggttgtcaaagcaaaaacatattcaccggtttgctcattacatggtgttacagtttaatagcgaattcaatagacaagagtataggactactcaaacttgtttgtgaatctgcaggactgacaactatgcagcattttatattgctacatagttgaaactatgataattttgcagataataagctaacttttaagtcatttttgcacacacaatgtttaaatagcgagaccaatttcttagtaatggatagtttagatagggattgcgcgcaaccccttgaggtaggcagggttttaatctctatccaaaacctctacatgctcagatgtaaagctgattaaatttatgtgcagaagaacaggattctggcactcttacctgcaaagcaaggctcaggccaccattttcttcaagctcaaagtaaagcaactgaaattgtatgcaagaataacaatgttaagggtctaagtaaaggaaaaggacattaaaccaagagaattttatgtattcaatcaatagtattgaataaatgttttacatgctaagcattgtgtgactcaactttatcaaagccatgagataacaggataaacaaaagctgacataattattacagaaacacatgtggatgatgcatgttgtattccatcatttaaactgccagatcaaaataatttcattatcagagccctctcaaagaacccttccaaaagtgaatacaacaaaacaatatttttttgtaccataggtgtgattattctatatatgcagcacagccagtacttattgatcacacagaacatgcatttaaaggacaggttaccattgtttattactccctccgtttcatattataagtcatttgacttttttcctagtcaagtttgactaagttcatagaaaaaattagcaacattcaaaataccaaactagtttcacaaaatctaacattgaatatattttgataatatgtttattttgtgttgaatatactaatatatttttctataaacttggtcaaacttgattagaaaaaaagtcaaacgacttataatatgaaacagagggagtactatatgtcaaaagtaaatcatctaaatttcaccaactgaagggcaaattttctcattgtcaaacaaggatagcttcactacgcaggataaatgtacacaacttgaacaagtctagatcaaaataaattaaaacagaactgacaacaccagaaccgcatgaaatgtacttacgaaacacaggttacatgataaaacatttgctaacaaaaaccaaccttaaatttgcttctatcagttgatttcacacgacaaactaaccccattttagcttccttttctgttatgtcaacagaataaaaatgagctgattgcttttccacctggccacatgcagctttcaattatttagttgctaacatcaagaaaagaagcattggatgatggacagctagttgccattacctaccttcctgtgaacagagtttccaagctggagctgagaaaccataaccgatccattcaatgcctcctctaaaactgttgctgatacggttgtctttatcggcacaccaagtttgctgcacatacgtacgcacagttaagaagaaaaaaaaagcagcataacaagctagtagcaaacagtaaaagaaatataacatcagtaaaatgtttttacctgaaaagagcagcaaacacggtgttcacggtattgagactcgataggtccagctccaattcctggctatcggcttcgatggcctgaacaaattgcaccagttgccataacatggtagattaaaaattaccagttcatgcaagaactaacctcaaatcctgatgtgtcgtactgccgcctcttatcgggatctgacaggatgttgtaggagaatgtgacttcctggaacatgtctgatgcaacaggatcatcgccattcttgtccgggtggtacctgcctcaatttgcaaggaaaacttctgaaaccattgcaacattgatagcaaagcaaaaaaagaagaaccaatctccacacaagaatggctagcaagattaaatgcgcccccaaatccctccaaaagttcactaaacagtaaataagctcctataatttatcttatctcgcacgaattcccgcgagacgcgttcatctaggactaggatgccagaaggatcgaatgagggggccgaatctgagggtgaggcggggagtgctcacttgagcgccatgcggcggaaggcgctcttgatctcctggtcggtggcgttgcgccccacgccgagcacctcgtacgggtccctcctctgcgccgccgtggcggccgggtcccccttctccgacttgaacgacccgaacctcgaacccgccatggcctccgcctcctccctgacctctcctccgccgccgcgtcaacccctcccggctcttcacagcagcaacagcaacagccgcgtcgcgctcggatctcgcgccgagcggtggggggcggcagtggctgctgcgctgttgcggccggggcagtaggcgcaggctcaccgccccctcatccccgtcgcggcgaagacctccgccccttctggctcgcgccgtagcagcggaggcggaggcggagtggaaggcaaggggaagccgcgcccgcgcggcggtggcgtgaggtggcggcgcgacgcgacgcggcggcgagcgaggccggcgaaaatgggaggagggaggcgtgggagtgaggtggtggtggtggggggaagaggtggcatagtaggtgtacctcgtggtggggccgtggggcccgcagctcagtgggtgttggtgtagtgtgggccccgtcagttgtagccattcgctgtacacgtgacagcggttggcctggccttggccttgtggccttgtgggggcacgcctgtcagtgatagcggccattattctctactagagtatatatttttctctttgaaacattagagcaagtttaatagtatagccaactactaactctaattcatctataaccaatctaatagctcattcatacaatagttatatacctccctctatctcaaaatgtttgacgccgttgacttttttaaatatgtttgaccgttcgtcttattcaaaaaatttaagtaattattaattcttttcctatcatttgatttattgttaaatatatttttatgtttacatatagttttacatatttcacataagtttttgaataagagcacggtcaaacatattttaaaaagtcaacgacgttaaacatttagggaaggaggtagtactacactattaatatctggtcccacatgtcatatacatactatgtcttggagtccgtgctatatttggctacaaatctatagcccactgcttttctctcttcttatttatctctttataatatgtttgtagctagcttgtagcctgctattgtacctgctcttaggtacatctaggagtactccatatctttgatgttagtgatagcagctattagcctaataatctctctttttttttttctttttaactgttttgaaaagcaaagtcgttctctttcctctcctttaaagaaaggtttcaaaaaaactcaagtaaactgatccataaaaaaaccacccaaaaaacttatgatcccgttatagcatacttgtagtgatcctccaccatcacataaaaacatttttggtctcataaaatccgtaaaccttgataaacagatttctttaaaagccaaccatcgtaaaaagaccgaacaacccaccattgcaactcatgcttcatctctcctggagttgaagcccaaccaaacagtttcagctccacataaactaggagcgaagttggatggaacactatcacaaaatgaactagagaagtggagctaggtttagattgctccataactctactccagacccaacttctatagctaaatttagaagttggagctctaccaaacagagccctataactacatactctctttgttttatattataaattagtttgattaaatacaaaatattttaataatatgtttgttttgtgttagaaatgctatctttttttatgaatttgaaacttaaataaattgaacttgagaaaaggtgaaagtgactcgtaatatgatgaaacagaggaagcatttatgcgaagtgagcgttccgattagatttcttgtggtgaaaccaacccactcagattcaacttagacacaggtgctcggctattttgcggtaggcgacgtatccgtcgataacaaggcacccgtggtgactttgtaaatctcaagatatatcggttcagtcttctggctatgctcataggggtaggatgtgcgtgtgtgtattcataggaggtgagtgtacgcgtgttgtaagcgtcttcgattgcatattgttttaaaaaaaacggaggaggtatgtatgaagtttcagttgccctctcgcccctggcatgtggggcccgtgtttttgattgatgagccgggcccaatgaggctgttgccgaccggagtgactccttttgttgcatttgcacggttgctcacgcctttagactttatcaaatgatgatacttaataagcaaacataagtagtgaacgcttacatgttcttgtagtttaaaactgtcatgatctgttaaagtttatgttttaggctgcagcttatatagacagagacaatgtaatagtaccgttgttaggtaacatcatcacggttttctttatgcgaggataacaccaaaagctttagacctaacctaaccacttccgtcaaagaaatgacaccaccccataaatttctttgggcttgagctaaataaattagcccagtgaataggcttcagatcacaccactgattctcgaaaaaccgctgagtagcagaagtgagatttttttagaaaaaactccgagaaaatggtcaatttatcatattattttcattttaattacgctctagcctacttacttagcgggtcaaccgatcaatttccctaaagttaacgatttcttaggtttgggacttttgagctaaacagattttaagcatttggggattattcttagaatctgtttggaatgcattttttgctacggcttataagcgaagatacgttgcaacctccatgaattctattcttatatattatgttcatgtaataaaatcagctgtgttgctatatatttttgtgtacatgtgtactcactaactttagttttgtgctttacaatttcattttcactgaattagatggatagtataaatatatgataaaatgtttcttcgaaagaaaatccaatttcaccttgtcgcatcgcattattttcttgctgtctatactcattacatagagatgacattaacaccatcaatttaaaatcctagatctgaccctcgtagtttatactttataggcctacccctccgtctcaaaataattcaaaggttgagttattttggaacgaagagagtacacgagtatgactggtcgatccaaatacttcaaaactataagttaagacacgtgatctaggatttgaggcaacgaaaactaattttaggatatgacttatacttttacgtttaacattttcaaaagtcatggctgaaaaaagaaaaacactaaagttaattctaaaattaaaatttggctatggatcattagagcttaagctatattgacaggcgcgatgttactacagctcctttagttgatgacatgatcaatatttgaagctaagaccatagctaatcatgatctatttcctcgatttgtactgttaaggtgcagaaaaacgtgcatacaacattagaccactatagcattatttactgtagctacatatattgccgatcgaacggtgtacgtgcaccccaagcacgggcgatgcgatttactgtagctgcatctattgctgatcgaaaggtgtacgtgcatcctaatgcacggacactgtaaaacctccgtagatagttgctacggcagaggatccatttccaattgatcaaggatatatgacagttgtttaaaaaaagatatatgatggatgcaggtcctctagaatgctagatacatatgagcctcataaatcctcgagcctatatatacaagtgagcactactacatactccctccatcccaaaaaaagataaaccttgagtttccgtgtccaactttaactgtccgtcttatatgaaatttttttataattcgtatttttattgttgttagatgataaaaatgattaagggcccctttgaatcgcatggtagaaaaaacggaggaataggaaaaacacaggattctgacaggaattgaagtgtaaaacagaggattgcaaaacacaagaaaaacacaagaatggtcgtttgattggagcacaagaaaaacacaggaatcggatgagagagatagactcaaaggaaatttttcaagaggttggagctcttgctaaatttcctccaaaatccacatgcaatgtgccattccataggaatttcataggatttggaaagcttcaatcctttgaatcaaagggccaaataggaaaatttactataggatttgaatcctatgaaatttctacataaatcttttgattcaaaagggccctaatactttgtgcgtgacttgtctttttaatttttttaataattttttcaaataagacagatggtcaaacgttgagcacggaaaccagggtttatcttttttttggacggagggagtatgcaatactgcattaaataatactgtagaggatctagattgatattgtatttaacagtgccctgatgatgcccattaagtaggctcagtaagtcgctataaaacccacttaataatgtagttatatttataactctatttttactagtcaatcaaaaataaactactatttctgatgaaatttttttgacatttataataaaattcgatcatctatacccacaactagcgtatagggtcggcaaaaagtgcgagaagactttaccttttttttaagccacacaggcaagtcctcacacaagataaatacgagaattaaatacccttattatggaatatttcatcgctctatctctatgatatattaattaatagtaataacttctcttagaggctttaaaaatatatattaacttttttttaaaaaaaatccgttgcaatgcataggtattatgctagtacttttaaaattcagacaattaataatttcccaaatgcttagttctaaaacaaaacaaagggtatacgtagatttgctaaaaagtgctttcatgatcataaaacttagattttataaagttctacaaattgatggttggaatcttaaaagtttaaacagatcttttcctaaacattgaatatttatgacaagagggagtagtatgctagtttttttttttcagccagtggtacagcccacttgtatctctgttagcgttaagacagatcaataactgtaaaaggcacttgactttcactccagatgttcccattaagacaagcctctcaggttaacttgacagagtgcattgcaacctaaccaaagatcaaatcaaatgattcgcagtactaaacttcgtgtaaagcaagaagcaaactgcccagctgctccatcacatcacatggcagcacattgctctactccaaagcatacggtaccaaatgtgcatcaaggtccagtacgttgtcaatcaagattttcaaaagcgactacagttaagtttagtactgaaacctggttgcacaattgcccgtcccattggggcaggtggggtggcgagactcagatgggattgcactgatggtgaccgagaacatatgctgaatctaagtgacataccagaatctttagctcaccgtcagccactgcttgcctggaaatcacaagcctccttgtcaggcacaagacatcatgtgcaccagaaaagtcgaggatacctggtgcatacaattggttttggttgtggtctgttggtgcctttttctctgtttagcgcactttagagcaaaaatgttaggattcctttggtcagtgtaatcaatgagatatgtatcgattaagtcgatattcccccagtgttttgcttctcatccaaagttccaaactaaattccctagctagtgtcacttacatggtagaaatgagttcatatcatacaactgaagcctggaagctctctagtctctactgataaaacaagaaaccgaacctgaggtttccatcagatgagacatttcagcgcataaatccttttaccattagcattgttgggaggttatgacaccaccttcagaaaatatcaataaccacaaacaattcctacatttgcaaaagattatgtcatgaatgattgggtggagactggaacagcgattaggtatcatattttacatcattcagagtgcttttgccagtaagaaagtagctgcaagcaaggtcatatgattaacttacaatatcccaacacaataaagagggcatgattcccataggcaaataacacagtagaattttcattgaataaatttcatgacaccagaataaaacagcattgtaaaaactcagcatgttacccatgaagtataactctctttatttttgacataccaactataactctcttttaaacataggtacttccttaataagcaagaagcaagtaatagttgacctctctaggataaattttgggcctatattatgcactttaagatgtgcagcagaagtgtagtgcttacgaaaattctaaagttgagaaaccagctcatgatctaactttcgaataataaaacagctagttgaagaacatttactggagagcacaatatagttggcacgcagcatatacatatcatttcgaaatgggaccaagtagcttaccttggctattggcctattgcttcatcttttcttcagtgcaacaataacttgctagggggcacatagaatttgaaccggtggttttctggcctcctaactttttggaacatgattgacagagctttccatgagttacaaatagacaattcagatcaaattttagatcatcaggaattttgctgttcagatgaagatatgccctctctctgctagctgttgcaggaacccaaccaatagcgtttgtaatacggagtacctattatagaaatgtatgttattacatatacgccatacacactaaactgacttcttggtatggacaagaaccacataaagttacacatacatgagtatctactggaaaatcatccttctgaagatagaacatcagcacacacgccacctgtcataacatgcataattgcatatattagaaagatcatcagctatatgcacacttactcaagcagccaatatagtattaagcaagcaatcaaagagcgtaaaaagatattataaacattcacaagtaaggtcccttctttgatttgggaatgctgtttgaattccactgtcaatcataattgcaaaagtttccattgacaactccagccatgattgtaactaccacccttagtagaaggaaaatagttggacaattgcactccgaatacaagaatctagaagaagctccatgccattgcacggaggctaccaggcacctgtttctgttagccattcattgcaaagcaaaactggttgttggtgactaacacccatccataatcacacagcaatatttaagtataaccgacacaagcatatgatttcagtcacaagggcatactttctctaatttccttttcatacaacttagtaccaacactactgttagccaaaatactttgcaggcttttgcggaaacttgagttcaggctgtattaacttacatggcaacaagaaaagcaacttgctttgcttttgatcattatctaccatcatgcaaactacaactacttctcactagtcacattttatcaattcctcatccttcacaacaaaatcaatactagcattctctacattacgatgaaatccaacaggacgaaaaccaaattcgctgaagaaacaggagaagagagagatggaactcacagtctttggcccgatccctttgaaccgagatagctcagtcttcacctcatccacggacagatcccgcaaatactcgaggcaaatcttgcctcgcctctcccggacgcccctcagcatcgcccttatcctcgccgccttcgtcgccgcaagccccccgcaccggatggcgtcctccagcctcttcccctcctcctcatccaccacctccaaaaacgaaaacgaatcgcgcatcagaggacacgagggagcttctagaagcttcctggatgcggccaccaaacctggtcccaggtggggaacgcggccttgagggcggcgaaggcgcggcgcgagatggcgtcggtggtgttctgagagaggagggtcgtgacgaggccgtcgaggacggtgggcggcggagacggatcgccatccgtgtcctcctccgggtccggggatgtgtcgaggccgaggcggcggcggcggcggcggaagggcgcgaactcgtcggggaagccgtggaaggcgaggagggcgtcgcggacggcgaggcattgggcgggggaaggggaggggtggtcgtggtacggctccggcgagggcggaggcttccgcttgggcttccgggtcatctcgctggcctgcgcggcttggccggcggcgccgtggaggtggcggttgccggcgacgaggtgtggtgtgggcgtgtggccgtcaataggtgaacaaatgggccgaacgtcatggcccggcccagccacgattaggcatggctcctgtagcgggccgtaccgtgcaggcccatgtgctaaggcgtcggcccaagcacggtccatggaaaatacgggcagtgccggcacgggcccaaatatgacatgtgggccggtataggcccattatcacgtttggcccacagaatttgaatacgaggccgaaaaaagagaaataagataaaaaggaaaattaaaagaaaaaaaaagaaaggacctgtttactttgatgaaaaaaaccttaccaaaatttgccaaaaattttggcaggatttcttatatagttaccaaatttggtagcaaactaaatgtatccactattttggcaactttattaaaatttggtaaggttgaaaatgtcatcaaagtgaacaggcctaaaattatggggaaaaactagaaaaaatgacaaaaatagtgggaaaaagaaaagaacatatggaaaatttgggaaaatgagagaaaatagacaaaatatattttaaaaataggaaaaatggaaaaaacagatgaaaaattatggggaaaatttggtggggcgatcgaccatgcgatttttttcatttttaaatttatttttttaatatttacagaaatattatatcggcgaaaagatttacaaaaatagacactaatgctctccatttgggtggcaagctgacgtggcacacggacgcatgacggtctttttagggggctgcgaattttgggcgtggcccccttaccgccctctgtttgggcggcaagaggcctccgtgcaaaattcgcaagggcggcaaaggtctcatatgcaaaaagaaccatccaattgcttttttggcagcgcaaaaattgcatttagccccttaccgtccttacagagggctgcaaagagtctaaatgcaaaatgcgcacacgacaccgttacgacgccgtgtgccacgtcagcttgccacccaaatggagggcgaagggtctatttttgtaaatcaatccgccgatataatatttctgtaaatattaaacaaataaatttaaaaatgaaaaaattccgaccatgctcgtacttgggccgtagcgtgctagcccaatggaaatcgtgtcatcctgtgccagcccatggactcaagcgtcgctccaagcacgacacggctaaatgggtcgtgccggaacaacccacgagtggccgtgcttgggccgactatagtgctgtcttgtcaggccggtatgcctcggcccggtccatatggccacctagccgtgttggtggttggagtgggcaggtttgaggtgaggacgtcgaagagattgaagaaatgggccttgccgtgcttatgggccatgctgaaaagatgatcttggaccaaaacatgaagaatctctttttaaggcttgatcatgctttgtaatggtacatgcccttcccttataattaaagaatagttggttggacagattaggaataaagcacggcctacacctatataattggggattgactggatgggtggattgagaagaaagtaacaatactgcgatggttaagcccaataaaaaggaggacacggtaagaagggaacaaaagcaggaagataaatgtagttccccctgctttgagaaaagagaaaaattattgtacgggataccgtccgaacggaatagtttaatgaagtattctatgacttcctcgatacggacataagtcaacctgatttcgtgcacaatcatacctccagcgacacgcggacatgagcagctaagtgtgttgcaggcctgcaatcctcatgagtactcgtgggcacgtgacacgagcagacatgtcacaccagtatctgagttggtgacaatacaatatgataaagctaggcaaatcagtgtatttatgggtgcatgttcacactgagaagacatgggactttaatagtatttttttaatcgttcgtctctttggaaattgtgctgttctcattccatgaattgtacaagaccatatcccgtttggacagaaatatgtatcagttcttgatatcttttaggtatcatgacctaatatctaactggtatcaggtgatacctctcaagtattacttgatacttggtagaaatcgcgtggtacctaattggaatcatccgatacctgatgagtatcaccgtttggatagaaatatgtatcgggtagtcctaataccagtttctgatacctgataagtatcaccatttggacggaaatatgtatcctgtcttgatacctaaccggtattaggtgatacctatcaggtatcgagtgatacctcgcaagtattatatgatactcggtagaaatagcgtgatacctgattggaatcgtctgatacctaataagtatcaccgtttggataaaaacatgtatcaggttctgatatttttcaagtatcatgtcctgatacctaaccggtatcaggtgatatctatcaagtggtacctcacaagtattacctgatacctggtagaaatcgcgtgaaacctgattggaatcgtctgatacatgataaatatcaccggtgatatctcacaagtatcatatgatacctattagaaatcgtctcaatctagttagtactagtagaatagcgtggtaataaaatagttgatgatgcactacacatgcttgttctgacctacaaactcaaggagaagcgctagatacacgtgggggccaaccattaattcctatgtgcagatttttgtgaaagccatgcatattgatacgtcaggctagccgagtccatctttgatccttatccatatcttgctcggggaggtggaggtgtcatttaattatcctgttcggacggaatgccgtgcactagactccctcttgagaaaaccaaactacccattcaggcaggcttcgcatcctctgccgttccaactggaacggcagagagctacagtgccatgcctttgggggcatttatacccgttggatcaagttttggatgcaagagtttaaacactacagtaacgatgaaaataattaatatatatttttcactgtagctacagtattttccactgtagagactgcacggcactgtagcttccctcacgtttaactgtgcgcctttgccgttctccccccaacggcagaggatgggaacccatttaggcaagactagattgcggtcgacatcttttgcttcaaactttattttggaccattgaaaaaaaagtatattttggaccattctttacttaatattttcatttttagaatttatcattattgtactttagacggaccatctcaactcttttatcaatcggcatccaacatcttctccacgtgggcataaggcacacatgggagagttccttggtgtgcaagagctgctgtgtttgaggttcttgatgtgttagagttggagaaaaataaaagttagggtggtccaaagtataattgagtctgcactctggaccatctgagccgaagacggaaggtatgaaccattgaaagcaccgtcggcccttgccacgaaccaaccctgatttccactcttgggccgcttagtaatgctcaattgcttttgagcacgcctaaccggctatgattatatatttttcaactagtgcttgtctaaactcaaaagatcactcattagaagattaatagtgttgagaaaaagtccattttactcctttagactatctccttgaagaacttaacctcctaaataatttctcagcttattttacaccgagaattattgaaaatggttcacttacttcgtaatagtatttcctgttgtattcttcaactccaaacttcaacttcctcattttccgttagcacatttttcaaattgttaaatgatgtgtattttaaaaaatagtttctatataaaagttgttttcaaaaaagcaactaaatctatttttcaaatttataatagttaatacttaattaatcatgtgctaatgaggtttctcgttttgcaatgaaatttagcaggaggattgatagatgtgttataacttacctctcaacaaattttctttagaaatgctttatcattgtttatatatgttgaaagcgtctgagactggtttaaacatcgagatttccgaatagtcatgataacttttga

SEQ ID NO: 43061 - DNA, 20288 bp, Oryza sativa
ttcctgcagcccctagcacagacaatgacactgaagccaggctgaggcacagttactgaatgggatccggattccctatcttaagttacacaacttttacatagcaaagttagagaaaattttcctgggtacccgtgaaacttcacctaatcccttttatgcccctgagatttgttcattccctatatacccttaatttcagtttggatcccttttataccccttccattagttgaccgttagttgacagttaaatttatattataaagcccattttgccttttgatataagaaaatataaatttatgaagtatattgatggagggtataaatttattgtatgcgactattatatgcataagtttattttgtgagatattatttaacaaaagtaatattttagtttcgcatcgcaaagggaaaacaaaataatttttatctatgataaaatctattttagataaaacaaaaaaataatattctttaccattgaaaacggtatatataacatattttgttatactagtacggatttttaaaagataaatcttgttatgcgagataaaagttatttttgttaaataatatctcacaaataaactcataaatataatagccgcatacaataaatttatacactctatcaatatacctcataaatttatattttattgataccaaaaggtaaatggactttatgatatgaatttaatggtcaactaacaatcaactgacgggaggggtatagaagggatccaaactgaaatttagggacatggaagggaatgagcaaatctcataggtatagaagtgattgggcgaactttccgagatacacagagaattttctccaaagtatacctacatgtcaatagctatatgttcacctatctaagatcacgttctatatcatactttcctaacttttccaaacttgtttttcgtgtgtatgcttctcaaacatttaaacaatacatttttaaaacttcttttataagaaagttgcttaaaaggtcatatcaaccattttctaattttaactaatacttaattaattatgcgttaatccgctgctccatttttcttgcgggaagaaaatgtttctaaccttttcaaaagaacaaaaccttaagcaaagcgagcctaactcaactgattagattccttgtgatgaaacttgctcactcgggtatataccaaacacgggtgcccacccatgttcaagtagacttgacataagtgctcacatttacaactagtttttttttcacgacgtactcgttgacatcaagacatataaagtgactttattaatctcaagatatgccgcctaattttatgagcacatactattgtactacgttttttttaaaaaaacacagccttagggcgaaggatcttgttccgacttaatgatgtggtagcgccaaaagattaccttagaggctagtagtatatagatgtgtcgatcttgccttacaaaagatcactgcaaagcagatcgccgtgcgcctgtgtgtgctttgcttgcctggattctttgcctgtaacctgatcctgtcgcaaagacacagcttaagtagttaagtgtaagcatactttgcagttttgagccatcactccactcgcaaaaagtggccaaaaggagatcgagaaatttaaaaaaggcaaagctagtttaaaatcgaagggaattgtttgaccgattttgtttggatcatatggattctttgatgcttttctcccaggacgtgccttccatgccataagctcagcctcagctgtcgctaaattctatcgctatcaaagagctcgtgcacaacaattcgtttacggacagaagcaactgctagtttttatttctattttttaatttttgcccagctgctagtagaatatatatggaataatggaggttttcagtttccagttatgaaaaaaaaaactttacgtcataatacgaacaaggcctagctgttgcattatgttactggaaggtatttttggaagttgcaacaagtcacgatatcacataaatttgcatgttcccttatcttagatgaaatttaccatttgctagtgaaccaaaattctgtctaaaacaaagtgaacgtaacttgattggttagcctcgttatggtgtgcaacttagggcctgtatagatccactggcaaaatttttcaccctgtcacatcgaatgtttgatacatgtatggagtattaaatataaacgaaaaataactaattacacagcctgcgtgtaaattgtgagacgaatcttttaagcctaattgctacatgatttgacagtataatactaccgtaaccatttgctaatgatggattaattatgcttaataaattcgtctcgcagttcataggcgaaatctgtaatttattttattattagtctacgcttaatactttaaatatgtgtccgtctattcgatacgacaagctaaattttttttacccctaatctaaacaccgccttattatccccctttgagttttcaacccatcataatcgtatgggtgatttgcgcgtgcgaatatgagcgtaatttttttgggactgtatttaaaaaggattttttttgttaaaaagcatttttgtaagaattttttttgttactagaagtattccagctaaaaaagtcatcgtctcccaaatggcgcgtcttgaaacgctgtagcgattggcgttggcgaccaccacaagtagccgtcgctacaaaccacggtgcgcagcgcatccaagcaaacaaaccaatcacacgagacgcagccgacgaacgcgtccatggccaccgcctggccacggtggcggccgtcctcgccgccgatgccgtcctcgtcgtcgtcgtcgccgtcgtcgtcgttcacggcggacccgccggcggagttcctctgcccgatctccgggacgctgatggcggacccggtggtcgtcccgccggggcagacgttcgagcgcgcctgcatccaggcgtgcgccgcgctcgccttctccccgccggccgtcgccgccgacctctcctccctcccgccctccgcctcctcccctctcgtcctcgtccccaacgtcgcgctccgtaccgcgcatactcaactggtgcgaccgcctctccctcccctaccccgcccctctgtcccccgacaccgcgcgcgacgtcgtccgccgtctcatgccctcgccaccgcctcccccgcgaggtcgcaggcgccgccgcccccgccgccggcctcctccgtccggacgaggagctactacagcgacgacctcgtgcagcagcagcaggaggcgaggcgggagggtgggtctacggaggagaggatcatggccatgctcggcgctggccccgcggagcaggaggcggcgatggcgttgctgcggaagatggcgcgggagaacagggagatgcggagggagctctgcacgccgcggctcctcgccgcgctccgcccgatgctgctgtccggggacgccggggtccaggtcaacgcggcggcggcgctggtcaacctgtcgctggaggcggagaacaaggtgcggatcgtgcggtccggggcggtgtcgccgctggtggaggtgctccgcagcggccacccggaggcgcgggatcacgccgcgggcgccgtatacagcctcgccgtggaggacgagaaccgcgcggccatcggcgtgctcggcgcgatcccgccgctcctggagctcttcgcgtgcgccggcgccgcccacctcgcccgccgcgaggccggcatggcgctgtaccacgtctccctctccgggatgaaccggtccaagatcgcgcgcacgccgggggtggtgcggacgctgctcgccgcggcggaggcggcgagggacgaccgcgccaacgaggccgacgccgccgccctccgcaggatcgccgtgatgatcctcgcgaacctcgccggctgcccggacgggaggaccgcgctgatggacggcggcgcggtggccgccgtggtgaggctgatgagcagcggctccgccgcgccggggagcgcggaggaggagtactgcatctcgtcgctgtacgggatgagccgggggagcctgaggttccgagggctcgcgcgcgccgccggcgtcgaggccgcgctcacgccggtggccgagggcgccggcggcgtgggccgggacatggcgcggcggacgctccgggcgatgcgcggggaggacgacgaggcggcggtcacggccacggggctgctcggccggcagtgggacgacgggagcgtcgtgtcggaggggctcgtgtcgatccggcggccgccgccgcgccggagcagctacggcgccggggcgtccgggtcaaacaccacgcagttctgaaaagtcaaagtcttcgcttctcttcttttatttctttcttttttatttctttttttttttgctggctcttgttgaagtatttggaactgtatttgccataggccccaaaaaatctggtggttaactacttctgatgaatggtgttggtgtaattggatggtggattcttttgttggaattaagctgtaatttaattggatctttgcacatgttaaattctttatgactgaatagtggaacctagaactgtgacacctatccaaattaggtctgtacattaatccatcggttctcttagaaggtatgtatgtatgtatgtgttactgggatttctgagttctttttcctgttcttgtgaaatatttgggatgtcggtgttctttttttctaaaaataatatttggaagttgtagcatgtaaaaattctcagaatgcatctacttgtttagcttccatgattgagtttgattagcacgagatggtttcatctacggtttacgattccgagatggccttccgtttcgggatctggcggaattacggttttcgcgaaattcggtgtaaagccggtagattctgaataaatttcataaaccaaaatttgaatacaaattctctgagtttacggataagcttgcgaaaaccggtcggctttgacgaaattccgagtgaaatcatcgaaatttcaatcggtaactagaaaaagaggtaaactgaaagtgttcccctctttttaattcattattattttatttcccattataaatttcactaaatacatggaatacatcattttttaaaataatatatcccaataggttctatgaatatcatactatttataagattttatttattttttcctttttatcaattcaaatttgaatttgatgaaacttatcaaaatctcagacggcttctactttcgagcctcgtcgaaatttcgaaatttcgcggaattcgaccggttttcgtcgaaattgtgaaccctggtttcagctgaagttcggaaacaagtatcatctcagcatttcatggttgtcaccaactacaaattaaattttacattagaaaccataatatttctcggtatcttctcaaccaatgcaaactcaattaatgctgtgtttagttccatcaaatatatggacacacatttaaagtgttaaatgtaatctaataataaaacaaattacataaaccgtatgtaaactgcgagacaaatttattaagcctaattaatatgtcattagcaaatatttactgtatcaccacattatcatatcatggtgcaattagacttaaaagattcgtctcgcaatttacacgcaaattgtgtaattagtttttttttcaatatttaatactctgtacatgtgttcaaacatttgatgtgacggggaaaaaaatttgccagtggatctaaacaccctataacaaatagtatgcgacagtgcaaaacttttgatatgtcgggtgtgttcttaaggtaaggttgggaaccttccgtcctagcatgaaaaacgaaacagtagattagtgcatgattaattaagttgttaactaaaattttaaaaataaattaatataatttttaaagaaactttcatataaattttttaacgaaaaacacaccgtttagcaattcggaaagcgtgcgtgtaaaaaatgagaaggtaaagttgggaaccttaagagacgaacacggttctagaactcttttcattggataaactttgacaaacaaactgtttaaagcgctgttaccaaagctagtcctcattttgaatgcatcattcttttcccaaattacatgtaaataaaacagagttcatgtggaaccctataaaatccttatattccaaaagcctagaagtagaatttaaggcaataccattccttcttccttcgactcttcacttctccagaagaggtcaactcttggcactctggcaatgtcttcaccacatctcagctcatcgaaccgttccacacaacagctacttgcgtaaatcccccatttgacataagcaaagactataaatccagcacgtaactgcgcgtaatcaacagcataataataaattaattgtaaccagttgtaggcattcataatcctaattggctcggataatgaagtatgacccattgagttacacattttaccttggttttttagcacattttttaatactaaactatacattttgtgagaaaattttctatataaaaattgttttaaaatattatataaattcattggtcaagtttaaaataattaaacctcaacatcagtgactcttattttatgcgttggtacttaatcttccgtccgtcataggttcgaatgtggcctatacattttcattgatccatgagatcttccatttcttatgaagttaaattaagggtgaatagccaattcaattttgaacttttgctcacggatcaaattagttcatggtgttttgtattgtccaaacaaatctctaaagattgtcatgtgactaaatatagccattggacacacttgacatgtcacatcattcatgcatgtacagtcaatatttaagggcctatttggactgatgttattttcaatcatatcattttttttataaagttaccaaaaaatgcctatatttagtttgttgccaaacttaatttggtaaacacgtaagaaatcatgacaaaattttggtaatattggcaacttgccaaaatgttatcagtaggtttattttggctacaatctgaacaaaccctaaatatccattttacccttacattttcttttaaaaaagagaaaaaaaagaaaaaacatgaagaaagcaatcataaaacaaaagaaaaataccacattctttagttaccaatgcaacatcttttttccaatggccaaatgcctttcttttactaattctttttatttatttcctacggagaatgtaagggtagctagatggatgtttcaaatgttgaatttgcatgcacgggtgatgcggcatgtagacgttgtatccaaggactatattaaataacataataaagtttagggacttatttggataatacgaaataccaaagactttatggatccttaagcgaaagtttaaggatcatgttgtttgttcacactttaattaataacactcattatttaatcaataaaaacaagaacaacaacaaccaaaaaaaaatcatcttgtaaaaagaaaatttccaaggctaccattcaaccagctgtccagattcaacttaaccctgtcctgtgagacgctctctaaccgccaaaacgaccagaccagtgtgtgcgcctcgccgttgacttgaccacgtgccatggcgggcgccgccgccgccgccgccgccaccccgccggaattcgtgtgcccgatctccggcgagctcatggccgacccggtgatcgtccccagcggcgagaccttcgagcgcggctgcgtcgaggcctgcgtggcgctgggcttcaccccggcggcgctgccactgtccgtggacctcgccgcctcgccgccaccggcgctcatcccgaacgccaacctcaggaaggccatctcctcctactgcgaccgcgtcggcttgccgcgtccgctcgccgtctcgccggaggaggcgaggggcattgtccgccacctcatggcgatgcgggagcctggtcgcgccgggggagtcaacggcgagcggttcgagtcgtcgtcgtcgtcctcgccggagttcgcggcgttggggttgaccttggaggaggctgttctggtgaggctgctcgacgacgagccgagccggcaggagggcgcgctggaggcgctgaagcagacgctgcgcggcggcgagaacggggtgaggcgcgcgctctgcacgccgcggctgctcgacgggctgcgccgcctgatggggtccggccacgagggcgtcagggtcagcgccgccgcgtgcgtggtcaacctctcgctggagccggcgaaccgggtgcagctggtgcgcgcggagctcgtgccggtgctcgtcgggctgctcgccgcggcgtccccggagctccgcgaccacgccgccggcgcggtgtacagcctctcgatcgaggagaggaaccggatcccgatcggcgtgctcggcgccgtcccgccgctgctgcgcctcctcgcgagcgccgccgacggcgaccgcgcgcggcgcgacgctggcatggcgctgtactacctctccctcgacgagatgaaccggtcgaggctcgcgaggtcggccggcgcggtggcggccctcgtcggcgccgcgggggacgccgcgctgcgccgcccggcgctgatggtcatggccaacctcgccggctgcggcgaggggagggaggcgctcatcgacggcggcgcggtggcggcggtggcggggctcatgcgccgcgccaccgtggcgccggggtccacggaggaggagtactgcctctcggcgctgcacgggatgagccgcggcaacgtccggttcggcgggctggcgcgcgccgcgggcgccggcgaggtgctccggcgcgtcgcggagggccccggcggcggggtgcggcgggacgtggcgtggcggacgctgcgcgccgtgggcggggtggccgccgccgccaccggcgagtctctgtacggcggcgaggacgccgccgccgccgcgccgtggatggacgacgtgagcgtcatgtcggaggccatggcgatgccgcagttcccgagacggctggtggagcacgcgcacgcgcacggggcgccgccgcggtcgaacaccacggcgctcgacaggctcaggcaagcgcccaacggctgacgtgtgggtcccagtgtcagtttcgtaccgtgctcgaacggtttgatctttttctcattttgcttaagaaatggtttgcttaaatttgtatatagtgtaaggaaattagattatttggtgatagtattgttgattccatatttcttgctaagcttgtatatacacatttccgttatgtgtgagaacaatttcttcgtatttatttacactgtatcatataccaatattgtcaggcatgtcccaaagtactggaatagacatattacatgtttcttttgctagtactatcttatcagatcaatggtcattgttggaataacaaattcagatcaattagagaagctcagtttccataaacaaacataataacgtttttattcaagatgaacaagatgtgttcacagtatgtaaatatgtacatagcatatataattaatttactgtttatctttacaacatacatataaacgtggtgcgtcgcttaggatgacttcagcaaggcccggttcctgcataaatcataattatgttaaaaaatggtttcttggcaatagatcagatgcacattgtaagttcatatctgcaagtttgttgtatactcacttctcatattcaaggtattcagtgggggatataggcttaggacccccaaaccaatcaatcaaaaatatgtttttgatttccaatttgaagatttggaaatgatgattctttggccaacctatcaaacagccatacatgaatgttgtcataaaataatcaccagttaatctcacattagtaaaagacacaaagaaatacttggatttaccctccatttcaggatgtttagtaaaaagtgcttctttggccaaatctgcttcagatgattgagggtcaatcaacttcaactgaaaacatgcaattcactggttccattacaacttagtaagtcaagaaatgatccaactatatcacatctatgtatggttcttatggctgagattaaatgaagtgcctatagcccctgctacttgcctacttcattgatctcacatgtcacaacagttttataaactataatttcttgatgaaatatcatctacataactttataaaccatgatttcttgaccatctgctgttttcttgctcacagtgaatccatgatagataatttgagaggggacggacacagttaggaacgtgggggaaaaaactataagacaatggagtatagttgttttgtctctcgatcatggttatcatattgtctactgagggtatctccacaacaactggaagactaggcgataacttggtcaccagtccacctagttgtgaagaaaacttgcaaagaacatgtaaaaattgagcctacaactacaatgccacaagctaaaccatccacaaggctccaaagttccaaaagcctgagctctcctgctgaagtctctcaacctctcatccccatgccaagaaattgaggcccaaaactataaagttgaaggcagacaaaacagtgataatgtttggttacgactcaagtccagcagtaagtattcactctacagcaatttataacttcaagctgaattaagtatgaattaataaaaagaaattaactactgtacattcttagaccagtcagcaccaagaaaaatagatataagaagataaccagatcagtcactaccaaagcaaaatagaaatagatagataaacagcaagtgaataatcatggtaccatggatgcaatttgtctgtacctttccagtaagagtaagttttgcacaagttgggttttcaggatcaatcttcccacatgtcccaagagggaactcgctaagggtaaaggaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatagttttattttgcctgcttaatttgaaatttgttttcttagaaatcaaagactatttagaatcttgaatatccttgttttcacctgaacaagtactaaaatattagttaagaaactttcatactttttatgacttttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaacaatttctcaatactaagcagcctcaggcgattagattactagccactaccaacacttggccgcgctaagaacccccaatttcgatcgagccacccattgtcatctcctaaagaaccgaggcatcaaccaatcagtccccccaaacagtaggggatcacgagcaagaagaaggcaaaggaattgggagggggacaacctgaggacgccccacgtgttctgggcggcgagccacctcgcggtggcggcggcctcggtgggggcgggcttgccgccggcggcggcgacgatggggcgggcggcgagggccggcagcggagggcggaaggcgaggaggagcgcggcgccgacggcgacgacgaggaggagggcggggggaagcatcaccggttttcttggtttggtttgtgtgctccgctcgatgggagactggaggaatcggaggatttttcccttcttcgtcaattgtgaattgtctcttccaaattttcttggttcttccggcggatagggttgttgtcgtctgaagcggcccggccggcgataggaacgtctcatagagatggaggagctgataagggtacagagaatcggagagagaaagactgattgatttgcaagcagtgtctttttgcttttggactttatagataaataaacatttcgaaaatagttgtatgtattttagaaacggacttgataaaaagatgtcgacactttttttggctgatctcagtcggttttgctatccgtctgatcgctaaacgtacgtataatatttacaagaaaaaccctccctcattttcagttacttttgaatggctcggattgatttaagattcatgcaactatagtgttttcaccttatactcttcttgacagaatgctcgttcactggatgtcgatgtcgcaacgtccgcctcccccgccctcaccggctggctagaaggcgccaacggcaccggcaagccccttcccctttcctcttctcctccttaagctagcggcagtaaagtgccccgtcccgccgtctttcctatctccgacagttccctatcattggttcccccaccatcgactatcgccttctaaccactcgcttcgctctggccctaccaccaacaccgacccaccgtgctcctccatccttgtggcttcggcaccaccgccgacgtctcaccacctgcccgtgtccactactcactatcgagccgctacctctcacggccatccctttaagcccggcgatctctccttctttctcatcccacccctaccccaacccaagacctcgtcactcgctagagcttcatcggagctagaggagaaggagttgggcacacgaatctccaagcaaatcggttggttcaaaatatatgagaaatatccctcgattttccgttaaataccatcggttggttcaaaatatatgagaaatatctctcgatttttcgttaaatgccatttagcaattacgtgtttagaaaacagttaataacctaggccttgtaacacttgggcatagcccaagattgggaaattaaagaccactatggacggaaagattgtggtaaattactcatgtatattaagcctactggaatatatcatttaccattgtgttagagagagaaatgtataatatttgcccatctcgtctgttatccgtttttgctatctcttctctcgtgtaagtgaaccatacctcctaattacattgaatcagagtaactgatgtatcaacaacatgttagtgagagcaaaacctttatgcaaagattagcggcaatgttggcggcatgataaaaatccaatgatttgatgaattctgtgagcaaaacacggtcgcatgtgcccatatggcaactaggctcctagtgtttgtccggatggatagccgggcaataagaggacattcttcacaactttcgatccatgtcttgctccatctagatcaagtggtggttcccatgctcttgaggaatggtgtagagtatcatgacgaagcttatcttccttggtgctaggaagatggaacatattacgaagctccagagtccggcaagatatatcaccgcatatcctattcttcatcgagtcacaacattggcaaatccaagcatgggagttcaaatctaatggcggggggctcatgatgaacagatcgaatgaacaccaaagagctcgaagccaagtagatcttgggacggtacaacttaccagcatctggcatacttcctccatgatcaccctgcccaccatcatgtgtagatgaaaaggaaagattggggaaagagagaaaatggaagaggaatatggggtttgtttgtagcaaaatatttcgatacaaatatctctctctaactcaatagaaaataatattttaatgggctcagtatgcacccaacaaattttcattatctttcagcaaatccaaaattttgcaatgtctaccggcaaaagccatgtcctgtaacaaatttttactatactaaagttcattgtaatgtttttgaatatgcataggcatattccacagaccggcctatagcttggctcaaagctaagggctcttctaagttctaaccctataggcttcttgttggtctttgcatgcttcaattcatttgatgagtggattatagtggtatctttggtaccgtatcatctgaccacattcagttcctaccgcctatggaagggttccagaaacccaaaactttagacttcagtccaactctctagctgctccaaaagccactcccatttcagctaaggagtactcttatagatttagggggtggttagatgcaggggtgtaaaattttagcgtgtcacctcatgtattatatagggtgtcgcaaagggtgttcgggcactaataaaaaaactaattacagaatccgtcagtaaaccgcgagacgaattaattattaagcctaaataatctgtcattagcaaatatttaccgtagcaccacgttgttaaatcatagagtaaataggcttaaaagattcgtttcgcaaattagtcacaatctgtgtaattagttattttttagcctatatttaatacttcatgcaggtgttcaaatgttcgatatgacagggtgaaaaattttggggtgggatctaaacagggcctcaagtctaggtataaccatataagctagtccttgtttagttccaaactttttcttcaaacttccaactttttcatcacatcaaaacttttctacacacacaaactttcaacttttccattacatcgttctaatttcaaacaaattttcaattttggcgtgaactaaacacaccctagtccattcaagctgaccctaacctagctaaatcttcatttaattagatgtaagaaataagcgaatacacacctttgtacacacacatcgtacttgctttgatcgagggtgtaaaatgtattttttttcgttgtgcatgatcaactgattgttgccgctgatgagatgaggacgatctgtttgttgcaggtgaacgtcttctgcatcaagaagggaggacactgctttttttcccccgaaacttgttagtagctttcttggcaccttcatatcattcttgttttcctttgagttgatcattgtaatattttgattcttccttcacggaacatcattcaattctttttgatgattctgaatatgtttgccagaatgtataagttctattatgcatttccttttgtgatttctgtgaggttgtgacaagcacggtgggcgagctgttgacatccgccagtgtgccatttctttcttttatgtctcaataatccacatctataacctatcggtttataacttgtaaacggaatatttccccctaatatttcacatctataatagtttataattgtgaacctattataaaaccaacaccgaaatagacattggcaatcaaacgcaaaaatacactaagatccaaacgtggtggcgacatcgtgccatgatatttaactaaagttcagctggaacctatatccccgagacactaattataggcgctcctccctaatccaacataattacacatataagggtatcaacaaccattaactggcaattatactgtttgacttacaacactattggtcaatcattccctcatttgctacagtcgtcatgcggttataacaagtgtctctctatttaaagagagtttaggaagagtattactctacttctattagaatacaatacaactttaatcctaatttgtaaccgactttatatatatatttgacacaaactttaacaaaaccgttagagatcaatggatctgtaacgggtcatgaaccattatggatgatatatcccatgccagtgacacaaatactgtaatgggtaaaaggaaccattattgatgatgcttttcacctattagtgataaggtactctgtagtagtgcctagtaggagagctttctatagcatgaaaaacaaattctgttacaaaggactacagctacagttcgatagcaaagcagcgtattacagaaccacgactgataaaagcaacagcagtagccgagaaaagctaagagattttcacaaaacctcaactggggtacaaagcaattaggtcaccatgttggatcacacacccgtgccagctgcaaaattctatactactaggagtgacattttcaatctccacaaagaaaaatgcgagaacaacttcaaggacagagaacacggtcatgagaaaaccgagggatacataaacaagaaagatagctgcagctattactttcagtatgtcctgccagaaatgcagatgattgcccctccacaactgcattggaagccgccaacatatcgggattgctaagattgacaaaacgaaaatcacccgaccaaacatcagaagaaatacgaacacaccgacggtaatactgaaaataagatcgtcccagctgttgccagagtccaatgttagatcagttgttaccaccagaaatgtaagaaccatgcccacaactgctaggaaaaccagtccagcagacaaagaaagataacggcggcggcgccttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcagccgaaactatgtaatataaacgcaaacgaagaacaagtagaaggcggctaagaactggaatatgcgcggtggcgtaggcggcggcggctcgatccttcggggttgagaaatcttgtatgtgcaattcgtgattaattccagttcctgagagataatcgttgggagttcctaacaatctggtatcagagcgcaaatttgagccactcttcctacaatctctcggttcggctgtaaaattccagttcaaggattggaatccgtctcttcggaggtggaatttccgcgaaaaggcaacttgccttgactggttagctgaatttggagcgggaatttgaggggcaagtgagagagtgtgtagcgccatggatatagaaggaaagttcgatgtactcctgaagaccatagctgagaatgagaagaagaggatggcggcggaagatcggacccgagaagatctgatggaactcaaggcgatggtggaggggcgccttccccaggtagagaagcgggtggaggatctgaactctgccctgggaaagctgaactccaaggtcgagcatttggagaagcagctgccgcgcgtgatgaacacgaacgaagaggtggcggctgcgtccgcagggttcaggactccggcttctgcccagggtacgcatgaatctcctcctgactccgctgctcctttcagctttgattcgtctgcgcaacacagtactttctctgcaatgtccactggagtttgtggtagtgttcctccgatgacttgtccgcagttcaacggtgataatccccagatgtggcgagcaaattgtgaagtttattttgacatctatggagttttaccgcagaattgggtaaaagtggctactctgaatttttgtggtaatgcggcattctggcttcaatctgtgaggaatcaactgattggtattactttgtctgatttgtgcgagaaggtgtgtgcaagattttcgcgtgatagacaacaggccttaatccgacagtggattcatctgaaacaagggggatcagttggagagtatgtagagcgttttgattgtgtaatgcattagttactggcttatgagcaagctgttccgccgatttacttcgttacaaaattcatggaaggtcttagagatgatattagatccatggttctgatgcaaaggcccaagacttggacactgcgtgttctttagctctacttcaggaagaaactgctgctgaatcaaaaccaaatagtttcaagagatctgatagtggaacttatttgaaatccccacccagaagtgctactcctcccatttctcctaactcatacagatccagtcccagccaatcccctgaagacaagagaaacattgaatcacctagagtgagagaagataggatatcagccctgaaagcttacagaagatctaagggattgtgttttacctgtggagagagatggagtagagatcacaagtgtgctactacaatacagttacatgtggttgaggaactattggaagcaattcaggctgatcctgagattatttcaaatcaaagcagtgttcctgagggagatgaagatacacttatgtccatatcttcacaagcattacatggttctgaatcttctaagtctatcaagttaagaggatgggtgcaaaacagagaacttttaatgcttgtggattctggcagcacacactcttttattgatgagcaaaaaggtcaacacatgagaggcttgcaagctcttcagtctcctttgaaagtgcaagtagcagatggtggccagattccttgttccaggattataccacagtgtagctggtggactcagggacacagttttaagactgatttcagacttttacctttgggttcatatgatgtgatattgggcatggattggttggagcagcatagtcctatgcaaatcaattggtcccataaatggttagaattctagtataaccagcagctcaccaggttacagggactgattcctcagttggatcagtgtgatactatatctgtccaccaattgcaaggtatggctaaaactgattcaatagaatgtatggtgcaactcattcaaactgctgaacaagaaactagtgaagtgcctgctgaggttcagcccctgctacaagaatttcaagacctcttcactgaacccactggcttacctcctaaaagaacttgtgaccatcacataccacttattccaggagctaaaccagtgaacttaagaccatacaggtacaaacctgcacttaaaaatgagattgaacgacaggtggcggagatgctgaaatcaggagtgatccaacctagtcagagccccttttcatcacctgctctcttagttaagaagaaagatggctcctggcgcttatgcattgactacaggcagctgaatgctgtcacagtgaagagtaaataccctgtcccaattattgaggaattactggatgaactggctggctccaaatggttttccaaattggacttaagagcagggtatcatcagataaggatggctgagggggaagaatttaaaacagcgtttcaaacacactcaggtcattatgaatttaaagtcatgtcatttggactaacaggagctcctgccacatttttgggtgcaatgaatacaaccttggccactgtattgaggaaatttgtgctggtattctttgatgacatcctcatctacagtccaaccctcacagcacatctggagcatttgagacaagtacttcagctgctatctgaacacaactggaaggtgaaattgtccaaatgttcttttgcacaacaagagatatcctatctaggtcacatcattggttctgagggggtttccactgatcctaagaagatacaagatgtggttaactgggctgtacccaatactgtcaaaaaactaaggggatttctggggttagcaggatactaca

SEQ ID NO: 43062 - DNA, 5958 bp, Oryza sativa
  unsure (1)..(5958): unsure at all n locations
atccaaaattattgatgctctacactctgcacccattggtggtcactcaggattccctgttacttacagaagaattaaagcgctttttgcttgggctggcatgaaaagaatgatacagaccagagtgaacacctgtcaggtatgcattcaggccaaaccagacagagccaaatacccaggtttgctacaacccctgcctgttcctgcagcagcttggcatactatctctatggatttcattgagggtttacccaggtcccatcattttaattgcatcctagtggtggtcgacaagttttctaaatatgctcacttcgttcctctttcacacccattttctgccgcaactgttgctcttgaattcttgaaacatgtttacaagttgcatgggttacccaacattatcatttcagatagagatcgagtctttaccagtaacttctgggagcaactttttgcgaggtctggaacaaaactgcatatgagctccgcgtatcatcctcaatcagatggccaaacagaaagggtgaaccaatgccttgaaatttatctgagatgctttgtccatgccactccgactaagtggtcccaatggttatacttggcagaattctggtataacacttcttatcattccacattgaacaagtccccatttgaagtcctgtatgngcgtataaacctagtgcactttggcatcangcctcaatggactggtgccataccagatgtgtctcaagtggtgtgcagcagcgcaaatttatgcaacacctgcttcaacaacatctgaacagagctcagcaacaaatgaaacacttggcagataagaagaggagtttcagggaatttcaagttggtgattgggtttacctcaaacttcaaccttatgtccaaacatcagtttctactagagccaaccacaagttatcttttcgttattttggaccttttcaaatctctgccagagtgggctcagtagcttataaactgcaactacctgcttcctgtcacatacatccagtattccatgtctcacaattgaaagcagcccagggattctctcatccagtgcactctaatcaacctcctgatctgaatcattttcagattcctcaccagtttattgattatagagtgactaaaagaggtaacactcccattactcaattgctaactcaatggacaggttgtgatgcttctgcagctacatgggaggacatggaggacttgcagtcaagatttcctcaggcaccggcttgggggcaagccggtttccaagaatgggggcttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcagccgaaactatgtaatataaacgcaaacgaagaacaagtagaaggcggctaagaactggaatatgcgcggtggcgtaggcggcggcggctcgatccttcggggttgagaaatcttgtatgcgcaattcgtgattaattccagttcctgagagataatcgttgggagttcctaacacgcctatttgttagactgtcatgcacaagcagacatgtcgcaaatgtggagcaatagaacgacatgctatttgcagccacgtagctcgagaattcagcatattctttgagcaatggcatgccagcatcctcaccgtctgcaatgtatcccccaggaggagtgaaagcagcagcaaatgaacctgctgcgattagtacggagatacataagatactttgggacacattggtgtaaacgcttgattcctccttgtcttccaagaacctcttatcagctcgatttaggaatctgctggtataagcattacaagcttgtaggcacatggtgatgctggtactagagagctgcacagaattcagaagagaacaaaaattaacacaaaattaaggtgatacagaatgttgaaagagcagaatgcatgacataggaaacgtacccatgataatgaataataacgagtgctcttgttgaaggcaacatctagaggtgttgatcccccatggttaataatgctgagattcactctagtattcatcataagacaggagatgataattgcattgccatgctttacagctagatggagcggtgtgtttccttcacaatctcctgcattcaacaacctcgtgaactttgggtttctgcatatgtaccacaccaccattaaccttccatattcaacagcgcagtgtaaaacatttctctgtttgttgtcaagcaactcatcacagtttaaacacatttccatcaacatacgggtaacactggccttgccggctatagcagcaacatgcacaggaaataggccatcattatctggaatgtatgcagctgaactgttgtccagtagaagttcgaccaatccagtttccccagttaatacagcatagtgaagggcagttcttccatcgatgtcaaccttttcggcaagtgttggctcccagcgcctcagggactcgctcatttctctagtggaaaaagaagtaatataggttatcagttcactaactaaagctgtgttcgggagttagggttgggaaccctcactccccagcacggaaaacggagcagtgattagcgcgcgattaattaagtatttgttaatttttttttcaaaaatagattaatatgattttttttaagcaactttcgtatagaaactttttgcaaaaaatataccgtttagcagtttgaaaagcgtgcgcgcggaaaacgagggtgggagttgtgaacccctgctaaagaatgcagcctaagacaagtaaaaacacaatcaattttctgtatctccagatatgcaaaaacatatatacatagttattttgtactactccactacttaggacatatacgatgaccattattagtacgctcttagccttgcaaattatgaatatttgccgacatggaagagataaaaaagagtagatatagaacatcgttgctatgattaacaacggctcaacattgattcttaccctctataaagtgagaacatggcataacggtgaagaaaaggaataaatagtattaaatagtattttttaagttgatggttagagcctttatcgtcttaacagtataaacggtccgtaaataatatttgtattgtctaagagctcatactagactctaccactgaagcatatcccaactttcgcaaaagcttctccaccagggagatggagttgagaacggcaaaagttatggattgtaaggaacatggacgatttctagttacctttaccgatgtagaccgcagcgtgcaacgcggtttttccatctggccccgcgtagcttgctggcgacctcacaccgtcagaagattttccgatcaatatgccaaccatatctggccggttggacacaaccgccaagtacagcggtggccagtccgctatcgctcgacatcagcttctgcaagaccggtgcgtagccgttcctgaccgcctcatgcatcgcggtcgctccacctgaattccatgccctcagcacagaacgttcaggttcttgcatggctgaagcagcacggacaaggtaatcgaccacatcggcatggccagccctcgcggcacagatcagaggtgtgtccagctgattgttcctcgacttgatgagcgagatgtcgtgagtacatatcatcacgacgagcttcaggtgcccacggctggctgcgatatggagcacagagctgccctctgctgtgacaccttttaggcagcagctctgatcaacgtcaccttgctcagctgttgctgttggccatatgcctagagcctgcgctaagaggtctgcatcgccggtggcaacagctttgagcaatttgtgttccattgtgtgtgaagtgtgcctccctgccatggttcttgcttggctcacagaacaagcgaggcacggggaagtcaagtcagctcttgcaggtaagttccagcccatatataatacagggtcccctgctatcctatcaactgtttctctgttcagacaatatctatgtactagtggagaaagaaaagtattagcttagtcacttgcattcgtaccttggaacctttcctatgaacctcctgttttgttagtattataatcatcatcatttttttaaatgtaacaggaagggttgacccctactgattatattatggtcagagaaaaggactatattatggttaaagaaaaggatatttatgtacaaattaatttgctaggcttcagttgcctgattttagttatctgttcaatcaatgcaaagcagccgtccgttctcgatcctatggttggtgcttcatctttgggcaggtctaatgcatgggtcgcacgggacccacgcgaatgcggctaggcacacatgcacgagggtctaagggggaatccaaatcccaaaaaggcactctagaatgaggttcaaaacacaatctacctttatattttttacatctttaaatgtgttttctgaataatctgaagcgtatatctttttaacaaatcatgaagagaacaacccatcctcctacaataatgatcagctccttgagtactgataccatgctttatccaatcaaatcatactttcatgaaaacgtgaatatatttttttaaagaaaaactaaaattgttagtgatagaataacacatgatattgtaattaacatgcaacaactaatgtgatggctcctatgagaaaactcatctaaaagaagggttataaacaatcacgatgatagttattaaagacatatcttcccattgattacataaaaaataatgatggtaaaagagaacgtagtaatatttctactaatcgacagatcagttggcaaactgcagaagcactaaaaaatttgctcactttagatgccattaactggacctgttcagctcctatatggactggatgcaattggactttgtagttccatttagttttatttctgaacatcatcctcagaatagccatcaaccagtaacagtaaccatcaccgtgcaagcttgagcaccgacgttgtgccctagcactggagtactgaccccttcatctataagaaaagtatcttatcaggtcaaatgtgcaatgaaaatgctagattagaggaatgcacaggcaagagcaccttccctataactttgttgcagaagggcgtattgttgttgctggtacaagaccaaattctgcaacagcagatccagcggtggctgcttctcaattggcattcacctctgtcagtgctgccatcatgatcgtcagagagatcgcccctgagcaccagtgggcatttcctgtgaggataatgagagggaagggagtgaccgcggagcgttcaatgcatatatccgtttgcaaactgaagtatcttctgaagaatttcatcccccgtggcttcttctgaagccaatatactctcagtagcttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43063 - DNA, 22272 bp, Oryza sativa
  unsure (1)..(22272): unsure at all n locations
gcgggacaaagggtcgcgatctcgtgagggtgagctaactccaaaaacccgtcctcagttcggattttcagttcaataatttaagctaaattgtattgtttgcgattttgaagacttttatctgggtatatgaatgtgcaagcatcattggcgatgaattacaagaaaaaaaaagttttataacatcataagacacaagaaacgacgcatcatatactatagcatggtatcggcgcgggacggcagcctcttgaagaagttgccggcggccgacggcatccggctccggaaccgcgggtggcggagcaggtacagcccggcgacgagcgccaccacccggggcggcgtggcgtacgccacgacggcggcggcgaggcaggccgccgtgaacaccgccgtcgccctcgggtccctccacgccagcagcgaccgcacccgctccccctgcgtcgccacgtcgctgaccaccgcctggatcctcccggccaccgtccgcagccggtcgtaccgcgcgcgcaccacgccgtcgggcctcgacgtcgggaacgtgtccgcctcctcgtcgaactcgtcggcgccggccgcctcggcgcacgacagccccgcgtccgcctgcggcgggcggcgcggccgccgccgatagctccaggcgccggccacggacgcgtagaggaacgcggtcggcaggatgagctccgggaagcaggcgaaggtgacgagcaggaggtgcgcgaggatcgtcgtcgcggggctcctccagtggcacacgtcggcgagccaccgcgccgcgccggcggcgccggagagcagcgccgtggcgcggaggaagttggccctgctccgccggatgctccacaggtgggagccggcgtcgagcatgtactccacgacctcccgccgcagcggcggctcggcgcggcccagccgcgccgccacgacgcccaccgcctgccgcctgaggccgtcgagctgcgcgacggcgaaggggtggacgtagtgcgccccggggaggagcggctcgccgtagaggcgcaagacgctggcgagggacaggcaggtgaggcgcacggcgaggcagacgtcgccgttcttgcgcaaccccgacgggtgcagcaccacgagccggtgcgcgttggtgtacaccctgtccatctccagcgtcgagaggcgtatcctcaccttgccgatcctctggtccttgccgccgccgccgccattgccgaggttgcagttgtcgaacacggcgagcgtgagcaccgtgcacgggtcgtagacctcccaggtgtactgctcgttccaccgcggggtggaggagtcgacgacggtgcgggtgcgcacccacttgtggccgtacttggcgacgcagtacgcgtcggtggtgccccggccgccgtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttttctcacgaaactgcatgtgtttgtgctgctctcctgtaacctgtcgagttatttagttttcagggtgatctgcattggaattcatgtctttttctttcatgtttcagaactaaaaggaaggtttatctgtagtatcacattttttttgtgataaatgagagtggaagaaattcgactttcatataatatcttaatagaattccatgtaatgatcaatgcattttttggattctatccttttgtcgaagtggaatcgtagaacagaatgtgatacgatgagataaaatgcaatagaaacaaggatagcgaacgggttacctactcctaagggtcaaagcaagccctttgattcaattctttattcttacattaaagaatgaatcaaatctccccaagtnnnnnnnnnnnnnnnnnnnnnnnnnnnnnnnnnnnnnnnnnnnnnnnnnnnnnnnctgaggaataagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtctaattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatctaatttggttatatcatggactcaaaaaacggatctgaatgtgattgaaatgcacgatcttcacaggtatcacttttcacgatacgtaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattagaaagttacggaaggagatccatcattttgcaatgaaaactacataaaaaactctggacaattcgaaatcaagccaaacgtcttaatacatatgcaaaaaaattcattattggcccaccattgattagaagatttaacttgtatgaatcgctattggtttgatacgaataatggcagttgtttcagtatgttaaggatacagatatatccataattcatttagagttacttaatagcctatttcttataccatatctctatcccgtgaaattcttgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaataaaggatatgagtctaccgcttacaagaaaagatctcatgatagtcaatatgggccctcagcacccatcaatgcatggtgttcttcgactgatcgttactctcgatggtgaagatgttattgattgtgaatccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattaggataattatgttagaattgagccgtatagcttctcacttgttatggcttggaccttttatggcagatctcggtgcgcagactccttttttatatatttttagagagagagaattaatatatgatctatttgaagctgctacaagtatgcgaatgatgcataattactttcgcatcggaggagttgctgccgatctgccttatggatggatcgataaatgtttagatttctgtgattattttttacgagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcgatgaaatgagggaatcaatcaaaattattcaacaggctgtagaaaaaattcctgggggcccttatgagaatttagaagtccgacgctttaagaaagcaaagaattccgaagggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaaatgaaattggctgatatcatgacgatattaggtagtatagatatcattatgggagaagttgatcgttgaaataataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatattcgcatcgatacaacaacgtattggtcctgaatatgctggcccccgggactgcttcaagctatagcagatggaactaaactactttttaaagaggatatcttgccatcccgaggggatattcccttatttagcattggaccgtctatagcagccatatcaattttattaagttttttagttattcctttgggatatcgctttgttttagcggatcttagtattgttttatcgatttgttacttgtctctcccccttctgaataagtagtggagtgtacccattgtaccgagttgaggtgatattctgccaacagcatatcatgataacaacttggctggaaattgcaggatcattcagaacaaatatttggtaactctgaaaatggtgctcgcggttcgccgctgtttaagcctggcactgaaagtgtttgccgcttgattaaagctgtaattttgtgttctgaagttttaacatataaacccagaaaatatatggccatcatttttactgaattaggcacttaggcctcactttccttgtgcgtttcgttttaaaaaagaacgatcttacagtttttgtgccctgcagtattcagcaatgtacaactgttggtagctgacggtagtctcatgtcaatcttgctctccaaatatcgtagacaaacgtaagcaaaaactcttctctgaagccagaaatgtttctatcagctgtgataattatatgataaagacgaaggtgcacattgcgtacttgtttcgaaaaagcgaaagtgattcagaggcttttggcgcctggacctggtttttgctttaaccaaagaagctcctttttttttatctcgtttcatctttattctccccagttaccatttaactatattgaccaatggctatagaagtctaatatagcattataccatttaattatttttaattttcattgggcaaatacaaagatcaatgtagggtctactatagctcttcaagaactaaattttactttgtactattatgaaatcaagatatattttttgcctactgatttgtttatcctcctcgatatttcacccgatgttttgtttttgtttttgtttctcctttcactcattgctctggtttaagtatacatgctttatcaaaggtcatgttcccagtagtagagaaatagccaatgcactacattgacttatgtagcacatcataaggcagcactattatcactttagtgccaaatggccagcagatagggtctaccatgtgaatctgaacaaaatctaataacttcacagtcttcagattttacaaagattaggtaagattgatctgaacagctttgtttaccgagttttgctgcttttattctgttctcgtcttactttcaagttgttctgtggttactacatgagatatcaaatggattgtttttttataccagtacagttattatctttcgccatatgttttctgaagtcataaaaacaactgaacgatagatgcagccaggaagtcgggcaggttttgctcggtaagcaactatagccaactacacatgtgcagatgagtgacaggtagtaccaatcttcatttagtcaagtgaatggcagcaaaaactagggtgaaatgccttgcaagtttgatcaagctttgtcagccacagccactccagttttcctctctttttcggggacaccccagtcttcctcatggcagttttggtgcttcactattggcagcaggtattgtgcattcttgctatacttcaaaatattctgcaaggaacgccatacatcaagagtacagaaacacatatgacgacagtgtctgaattgcctagaacacatcatctttgtattcaagacaaagcggtacctttatagagtacatcagcttgtataacaatgaaacgcatgaattacacaaaggtctaaaaacatgcatacagtagtggttcgtgcaatattgcagcaaaaacaagtatttctacagagttcagttgttccttggtccactgcaactagtagtagaacacatggttctacaatagcataaaccactgccagtgacagcacagctgacacggtggcacgagctacagttcagttgttctactgcagaagaatgagccattgccattgacagcacacctggcacttccagctgttaatcctagaactaggtcctcgagcagagcaccatgcaatggtaagcctagaaggagaatagcagcagcacattgagcagtttaagttatcagatatggaagcagcaggcaagagggaagaagtctgagatggactttctccccttcccaactatgaagcagagcatacaccttaacgcatcgacatgagtgtgcgcctctggatggccctcttggaaggctgagcagccgccgccttcggagttctcttcaggtttctcctcaccatcttctctatctgctctattgagctggacagtttcttctccatatcatccagaaggactggatccatcggcttggacggggtaacaagtgatgtttcagatggcgaggagaaaatcttcagactgtccttggccaagctagatgcaggggtcgcaacaatttgagttgagttgatgccaggttcaacatcaagggagtcccgaacttcagtgcaatggggagtattctgctcaggtgtctggcttcgctgctgagcagcagcaatccttaagcggcttctctgaatagcctgaaagtcttaagtcagattagctgcaccagcaaggaaaaagcaaagtagactataacattcatgtgactaacgcaagtacagctgaaaaatatcagtactcatgtcatataaattcagattcactgaaagtctatacaaatgttaatttaaattttgcagtggttagatggtggatatgtgctttgagcttaactaagaaaggccaacatcatgcccagcaaatagtaattcagaatatatatatggaaatcggatcgactagaaaatacatcacttgacttgagcaatgctatagaaacacttcaatgttttccatacaggtaataacattgtggtatagtaagatgaagccgttttgactcaaaatggcagtatcaacatatgtacaacagtacacattaagaaattatcgacctaaagcatgagtgcaagaccacaggcgctcgacacaacaattgcccaaaggagggtataacggatgccttagaattcatttgaagagagaacaaggcctcataatactacaagatcaagaaactagaaaaataattcaagatcacaaactaagctactacatgcacatacgcaaagtaaagtatcatggacacttaataggcaccaggaaacaggaaaatgcattacagaatactatgttaattgttaaacatgaaacaaaccaacgtaatgttctcagacgatcaatgcgggtaaacggcaccagaagttgccttaaaattccaactagcactttttaactaaaatatcttgttatgagtaggttactataacaaattgcttcacatggccattggttaagacaaaaatcaccatatataacgacgcggtactaaaatcttaaatagcacaaaacaaacaattccagaatcaatgtagacaaaaaataaacagcgtatcacacatttattgcattttttccattttgcaactatgatcaagtccttaacagacaccatacccactgaattgaacataccttttccgcgaggcgattaaatcacacattcacaatgtcacatcatttatactgcatgatccatatcataatctgaaagaagctttcaatcacctttgcaatcgccgtgatgtcacgcaacggcgtcctcgggtaccaatcaggaagtgggcttctcctctttgtggctgtggccttcacagcccaaaccgggggcacgttctccttgttgttcgatggccgtatgaaccgccgagccaacggcttcccggggcccctcgccgcaagagcacccggcgaggccaccctcctgatgaagaacccgccaccgccggagagctcgccaagggccgtcctcttgctatccctcatctcaggcatattgctgtaatctgcaagtagcagaagaggcaccgatgggtaagaacacgccaaacgcatcaaaagatcagggaaatgggcacatattagcctcacatccttggtcttctctctgatccttacttctactcgtatgaatcctagctagagttccttctcctcctatcccccggaaatctgcaatagcaaaatccaaagtaaccatcgatgcagcaaaacaaagcgatgacgctacccaaaaccccccaagaatctgccatacttctcacttaccctcctcagcctcctgctcagattcaaaaacctcaccagatctgcaacgacagaggcaaacagacgcatcagaacacccagcaaacagttcatcaaaaaatggacaaaacaacggacccccaaatctcaaaaaaccactcaccatttgctcgcctcttcctctaatcctgccgcttcgaacccctccacgatggcgctatgacatccaacccgccgcaaaatctctgaagcggattgctcaaataggcgaagtggagaagagggagaaattggggaaaaattttgcggcggcgatgggcgggctcctctcgaaaaactcaaattttcgattcggcgaaaaacgtggcggagagccaaaatcaccggtccacggctcacccatgggccaagaccccccccccatccagacgtccgtttgtacgacgtggacggctgagatgagcccggtgcgtggacgcggtctatcccgagcgcgccatggacggcccatttagccgagtgggccttcggcccgcgcgtggcgtgaagccggccacgcgacgccaaatttgggtaattcggggggagtgaagggggtaatccgcaagatggccaccggattcgagcatggaggaggaggaggaggagcataaaattccccaacctggcaatcgcctggagccttcgaaccctagcggggtagccgccccggatcagccgccggcgccgcccatcgccgacgcagccgacgcgggcgcggccgccatggcgccgttcaggcgctgggcggacctgccgccggacctgctgtgccgcgtcggcgacaggctggacctcaagtgctacgccagcgcgcgcggggcgtgcacggcgtggcggtcggcgctgtcgccggcgtcgccggcgctcctcgtgctgtccgacgccaggatgtgcccctcggcggcgtccctcccgacgcggcggtgcttcgacctcgcggcgatactgacggggggcagatgcgtcgggtccagcaacgggtggctcgtcctgtccatcgcgctctacggcgggcagagcgcgttcgtgctcttcaaccccatcaccaccacggagatcgtcctcccgcccctgatctacgagagcaggtgggtctccaaggtcgtgttcgcgcccagccccgccaaggacgactacgccgccgccgccatctgcgacatcgacaggatcgcctacgtcaccgcgggcgccaggaggtgggccgtcctcgaccccgtccgcctcgtcaccggcgaccagctcaccgacgtcgtctaccacgacaaaggtaaggtctactgcctcacgaggtgcggagacgtgcacctgctccgcctccccgagcgccgtcgccggaaacccgccgatgagccagggccatcagaacaaccaccagaggcaccagtggtgccgcttcctgaatgcgcagttgcaattcgagctaggcgaacccaactccaccacaactttcgcatggtctgctatgaccatcttggaccaagggatcagatgatgccgatgaagctcactgtctgttcagagacactcatccctttcaattataggaggttcgcgatcggacctctcgaaccggacctaaatgcgccggcgacggtcgagccattgttgccagaggggaacctcccgtttgatcctgccaccagtttcgctccgccatacaacaccgtgtctgcttttaccaatgccaagaacattgtgctgtgtgagggcaacttgtaccagatctggaggaatgcaagctgcactgtgactttgcagctgcccggaggcggtcaccgtcgtgtatcggagaatgaaatcttggttctaaggtactacccccgtcgccagccgtgctgggatgctgtgacagacttggggggctactcagtgtttgttgggcggaacaatgccgtgtcgatgtatgctgagggtgtgcatggtctcaagggcaactgtgtgtactggattggtgggcgtggtagggatcagggcatggtgttcgacatggaaaccgggaggtctacgccttgctatcctttggttggtggcatgccagggcctttgcaaagcacgatctgctggttcttcttgagtgatatagtgaacgccagcaacaatagtggaggaaggagagtttatcagacacgatcaaggtcccgtgcggaacgtgcacaggatatggaagagtaatgcgtcgccagattgcttggtgacatagtgggtttcaccgatcacgatgatagaagtttgagcttatgtaccatagcaaaagtgtgatctgaacgtgcataagttgtggcagagctggtgtttcaaaactgcccgtgtagccgatagtttattgcgatttgtttgttttccaaatcaattttctctgtctagttgtgcttatgtaactcgtatcatccttatatatttgtgtaatgaaacaatcgctgtcatcttgttgagcttgtattcatcatattatgatggaataagaaaatggattctgaaatatattgttgctgtagacgttctgaattgtagcaccattagtttctctgaggttccttctgtactccaagctccggttgcagaataaacccacatttatttctcattattatactaagtggattccttctccaatgtcaatcagaatcccaaactatgtacaacaatgcaagtctgaaactctgaacatctcaattcccatcctagtttctgctcaagcacaacctgaagtcctgaggcagaagtaatctgcaacctggctcgacgagctgttccactcaaggttccacagcaactccggtgaacggcggcggtggcggcagagtctgcggcgaatgcagcagctgcagcgaccggacgacctcatccatggccggtctctggtcaggcatcaccgaggtgcagagcagggcgagctccagcgccgcctgcatcccctgctgcgccgcgtgggagacggcggcggcggggtcgagtatctgcgccgcgccgccggccacgttgacccgccgccgcacccaccggacgatgtccaccgagtcgtccgacgccggctgccccgccggcttcccggtgatcagctccaggaggatgacgccgaagctgtacacgtccatgaggtgcgttggtttcttggtgcagtttacctctggtttcagcaaaagagcaaacaacttcagtgggataagtgcgcagagagccagagttttatgaaatcttgagtgcaattctgctgtggaaatagctatcctaatgaaattctgcttctgggtgaaatgtataactgaaaacacaaacgagctgatgatgcctaagtaccaaaaatacttctgaagaattcgttcaaaaaaatacactccctctatttaagattataagtcgtcgtttcaactttggccaaaatcaaactgtttgaagtttgttactattttttatataaaacttagattaaatttgaagagtttgactttgacttataatctgaaacggatggcgtacttctgaagatcataactgcattatatccacactgtcctgaactggttgcatggactgaactgtatgaatgatacgcttacctggagcgatgtagcagctgtaattcagatcagaagccaacgaagatcgatacgccttctcgccaacgacacgatcgatcccaaatccggtaactctgggctcaaaatcatcacccagcaacacattgctcgacttgagatcgcgatgcagaaagcgaggagtgtaatcacggtgaaggtacaccaacccttctgctactccgatcgcgatcctcaacctgtcgttccaccccaccgcgaacttcggcgcgcgtatcagatcctgcaagctccccatcctcaggtgctcgtagatgacgctcacctcgccgccgccgccatgggagtcgtagcagaagcccagcaatctggcaatgttcttgtgccggatttttgcgaaagttttcatgtgattcttcactgctccgaatgtttggttgcttgagcatatgaatttcttgaccgcgatgttttgcccgtcttgcagctcgatcaggtagaccttgccgaatgctcccctgccaatggcgttcttgtcgcggagtgcggcgagcagctcgtcggcggtgatcttgatcgggtagaagagcaccagcttggcggcggcgtgcagcctcctgcagacggcgaacgctccgagagccagcagcagcagcacgccggtgacgaaggacgccacggttgcggccagcgcgaggcggtttctcgacggcggcgcggccggcgcgtcgcagccgccgtccgccggcaggccgcacaggccggggttgccctggaggaacacggcggggagggcgccggagaccagcgacggcgggacgcggccggtgaggtggttgtaggagacgttgagcagcgcgagcttgaggccctggagctcggccgggatggcgccggtgaggccgttgctggacacgtcaatgtacgtcagcaccggcaggccgccgagggacgccggtatcgggccggtgagcgcgttgcccgacagcgacagcgacaccagcctcctgcacctcgtgagctccgggatcgcgccggagagcgcgttgccggagacgttgatgatgctcatcgccggggagtcgcagagggtgtccggcaggccgccggcgagccggttcgcggaggcggtgaaccggtacatggtgcggaccatgccgatgctccggggtatctcgccggagatgctgttgttgtcgacctgcacctgctcgagccgggacgccgccgcggacagctcggggagccggccggagaagcggttgctctcggcgcggaccacccgcaagtccggcagcgaccagaggccggcggggagctcgccggtgaacccgttgccctgcacctggaacctctgcagcatcacgcacttgccgatctccttggggaacggcccggagaagccattctgcgagaggtcgagggacagcagcttccggaagttgtggccgaacgccggtggcagagctccggtgaggctgttcatggagaggtcaagaacctcaagctgctccagctggagaagtgtctcggggatcgcgccgccgaaccctgacccctgcaagaagagccacctgagtccggccatctcgccgagctccggcggcagctcggactccaggaactggttcttggacaggtcgaggaagtgcagcttcgtgaggttgcggaacagcgccgggtggagcacgccggagaggcggttgccgccgaggtcgagcacctggagcccccgcagcgcggcgaggccgggcggcacctgaccctcgatgtcgttgccgctgaggtcgagcgacgcgagggaggcgagcatggcgagctggtcggggagcggaccccagagccccgcggagctgaggttgagcgacacgagcaacgcgcaccgcgacagctgcagcgggacggtctggttgaaggtgttcgacgcgaggctgagcgccgccagccccggcacccggcacagcggctcggcggcgatgtccccggagagtccgaggccctgcagcgacaggccgaccgcgacgccgccgccgccgccgccggcggtgcaggtgacgtgcgaccagttgcagtacggcgtggagcgcgaccacgtcgacagggcaccggacgggtcgttcagggaggacctgaagctgagcagcagctcctgcggctgcaccggcatcgccgccaccgccggcgctgccgccgaggcggcgttcgacggcgtggcgaggagcaacacggctgagaagaggaggaggttggcggcggcggcggtggtcgccatggacggagcggaagtgcaaggcaagaaggcgtcaggagtgtcgtagcctagcccgtgctgcggctgctgctgctgctgctgctgctgagagtgttgactccgaagcgcaatgaatgacaagtcgctgcagggcttgaccactgtccggggcgcggatcccgcgccgtcgatggacagatcaacggttgtcgactctccggggcgtccggatgagtagaccgaccatgctgacaatggagaaaaataaaagagcaagtactccaatgtagtactatcatgctagtaagcattattcatgaacatgagagaagagaggagagaaaatgggatacgaattcctagccaactgtgccctactctctccgcttcaaaaaaaaaaaaaaaagaagggaattgacctctctaacaaatgtggacatacctattcagaggaggggtccaagatttgattttatgtacgtacgagatatgagctaagtattaatggtgtagtatatatttatattaaactatcgtatgaataggttattagattagttgtagattttttagagctataacagttggctatactataaagggaacttgctctaatgctattcccagtgcatgtttcataaagagttttaatctcattaaataagatgccaagtaagccaaattgatgatatatcatgaaattcaagaaggaataagtttcatctagatgaaacatggtttacctatgccttggaaacaggatgaaaccccactgtgactgaacatttcatcctctaccttggaaacgaaaatgaaaccccactgtgaccaaatagtttcataaaactattcaataattgagtgctatgaaaccaagaaataaaattgtgcattggagacatttgtttcattcatcaatccaaacgtctttagattacgtggcacttttgaaaaccacaaaataaaatcgaatggcctaagggtgtgtgttattttttttcttttccaacttctactttcctgtttttcacaatcatattttctaaactattaaacaatatttttaatatatatatataattgttttaaaaatcatattaatttatattttagttttcatagcctttactgtacttaattaatcataccgtacgttttactacagaggaaggtatccaacctttcagataaacaaagcctaaaaatattgaattgtcagctgcggcgtgtgcagggggttgtacaatgtggcaggctgctgtggtgtcggatgcactgacattttgcactgtgctccgcttggacttttggggtggagcaggaggcgcttttggaggttggagtggcgcccttgtcctgcgcatcgggggacgacgacacgatgtgcagtgcagtgcagttcaccaccagggagggagggagggagagatcgttcgttcgcgcaaaagacgtgatggcgtcacttccttggatggtttgtagttttgtactacagtactaggcacttgattgtgctgtaccatgtacgcccaggcgcccagttattttatccgcaatgcaaatatatgaattttacggggaatttattaaaggaaatgaaccaacccttatgaaaatcatgtactccccttcaatcattggtttagtttgctccaatgcattgtcaaacaaatcatatgagctgcaatcagtgcctgtgggaaaaagttaccttcaatcattgggcaaacctgacaggatttattgaaattagtaaaacaatgctccatccgtcttcaaatatatagatttttagtgtttgaaattagttttacaatatggactccttaactcctttagaacaaaggtaaacagaaattttgaaggatttgattcctaatttcctactccgtccgtcccataatataacaatctagtaccgaatatgacacttcatagtacaatgaatctggacatgtttcctatctaaattcgttgtaccataaagtgtctcatccggtcctaggtttttatattatgggacggagggagtatgtgattgctcggaacaaaggaatagctctcctaaatttctttgaaattcctagggaatgagttgtttcatacgaattttagtgggaggctctacggttctacctcatatattttttttcaagaatacgcgaaagatttgcgcatcttttgaatacctcatgtttttcacttccaatgacaagttcctatgatttaggtgagtgtcatccaaacaatagttttaaaactttcatgtgtttttaattcctataggattttcaataaacacaacattctattcccgagttcttctgtttccgtgtgttttgcattaatgtgttccaaagcagttctttaactttttcaccaactccctcatttcaaccaatcacactcattactcattcggtttcactttttaattatcataaaaaaactccaaagtacttgctttctctgtctcaaaataagttaacctagtacatgatatgatatattttagtattatgaatctagtacttgaatatatcatatctcgtattagattaacttattttgagacaaaatggtaaattttagaacggagagaatactacactgatatttgaaaccttaatggttaacaacactaaaattgttccagcaacaagtccaaacaaaagaagtacgagtactccgtataataaattatgagattggcagataacagcaggagggggacaatgagacgagggctaagacacagattcttgtcctttgtcctcaaatcatctgccttccatgagttgagtcaacgtgaaaaatccttttagatttgagctacccgtgagttttcgttgattccaagcaaaaattgggctattctttcagagtactactagtactgtttacaattcataatagcacaggtgaaatagccagaatttgtagcctgtacagtacaaaattgcctgatttgaaggcaatcatggagccaaaagatgcagcaggatagcattactagtactacaattttttcagatgatcacatcaatcaataaataaaatgcgccgggtgaataacctaccgataatattaaatgttgcggtgttcccatcatattctacaacctttactttcctttcttttttccctgatttttcaatccacaaacttcgcgtagccagcacagcatgagcgatggccggaaaaaagcacacaaaactggtcacagaacatggctcaaattcagttccaaaaaccagcctgttactaagctctgcaactaaataaatagtatttacgagaggaggaggaactatgagataacactaattctgaggtctttctgcgagtttcatcaggagcagtcaaatggtcgcaccaacgtcctgtttttgctcagcacgtgtgtaggtgaagctccgcacaactgggcttatcaactgattaccggtaggtataggtgtgctgtgaccaggttttgccgcatcgacagtatcagcattatcacgcttccattgtaagctccgagcaccacctctgagtggtagacgcccacgcatagcaccaggaaatgctggccttgggtatgcagttctagtgagtcttgaagggaatgttgatccccgagaaccacggggccagccagactgttgagacacttcgagagagttctttctaacaacctgcagtatacacaattaattgctgagatcatgaatgcatggcaacttggcaagccatgaagaggaactactgaaaaggatctttctgccaggaattacaacactgaaaaggttttgactgcaatggcaatgatttttttttattttacagtttaccaacaggtatctataaaagaagaaaatggtggtggcagtgaatctgccacccaccaactctgttgtattttttaccacctatgcttttatgtactttaattttataaaacagtacttctacatattgttaatatcttatttcatctctagaatttaagtttaccatgcaaagacatccacagggaatcagggatgatattgttccaaaaaccttacaaacttgttccaaaatatgttagcacatgcataattcatttgtatccgtagcgaagcgcgggtatttagctagtgatctaacgataaatacacaattcagctggcaatttgtgtgcagtgaagcagctcaactaatatattctcccatacaaataaaactatagcgagcttactagagcagctggatcttgcatagcgatccacaatatttaatagagttgtagagttttagtgcacaatagaaaggtcaacatggggttttaccttgagcatgcgcgacataaaagatgtgttgtcaagagttagggcttgttctgctgactctttgtgcaagaattcaatgtacgctgagctgaatggacaacacaaagaaaaaaaatgaggataatgtctaaaataactctgctgttcaggcttcagaatgaagagaagacttggaattcataccctgttggctgaccagcaatatcagtcacaataagagttttaagcacagctccaaacttattgaaatgacgggaaagagcatcttttgtagcagcaaaatgtacctataaacacgagaacaatcgttagtaaatagtaataaaggcagcttctcagcttcacaaatgaaatggtagtacgagacacttacattggaaagaaaaactgttctagaatcagtgccaccttctggctgacctgtactgcatgatccaacagctggaagggggcaagaggaggaaaatttctgagtcattgagggtgttgaaaaaaagccacagaatcaacatgtaaaataagtaaggttaggggtttaaaaagtctacacagtagagatgttttagatgatgactttcaattaaataaaggtgtctcataatcaaacatggtgttgcgtgctgatataaaagctcaatgcatcgtgtagctgtgataatcaacactcaagtgctacataccaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43064 - DNA, 24286 bp, Oryza sativa
  unsure (1)..(24286): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctttaaacatgtctttaacttgtgtttaatctgtgcttaaccgaataaacatgttttcataaattgcgaactgtcaatatgatctttactaaaattaaataattctagagtacttttgaccttttttgaaagattccacaaatagaattgctgatgagagttgaaacgttgttgcactgagtttctctatatgcaccaaaatgttgaatggaatatgaaaagtctaatgcaagcacttgcacaagactaactcagctagcttagcatgtggtagttctacatcagcgataatgggttaatttgattaagcacttgcgcattaaggtgttttttactataaaattgagtagatgggtgagcatttacaacaaaataacttatgtgatggaacgtcaaactttaagtgacttatagggttgcttttgtaatttttttctatattttaagatgaagagaataatctaaaattttcaaaatattaattaacacgtttctttctgattttctagcattccagagcgcttgccacgaacgaactatatctcacttgattctacccaacttttgagatgaaaattttcttttgtagaagcttccatgtagaaacgtagaaactttacaaaggcagtgtttagttccatgccgaattttttttttacatatatggacacacatttgaagtattaaacgtagactaattaacaaaacaaattatagattccgactgtaaactgcgagccgaatcttttgagcctaattaatccgtcattagcacatatgggttactgtagcacttatgactaatcatgacataatttggctcaaaagattagtctcgcaattttacagtcggactgtgcaattagtttttctttttgtccacatttgatgcttcatacatgtgtccaaatatttaatatgacggaaaagttatggctaatcactgtagtactgtagcactatgcaattagtgtagtacttatagttaatcatgaagtaattaggctcaaaagatttacagtcggactgtgcaattagtttttctttttgtccacatttgatgcttcatacatgtgtccaaacatttaatatgacggaaaagttaaaagtttaaagaaaaaagttggaatctatacacaaccaaagatagaattcaaaaaataagttaaaagaaataccgtatgaacttcttattggccctaaactgtcccaaacatgcaggcacgtgcgagggagaactagcttgttcgaggtgccctcgcgtacatctctcataatgcacaaatcggtggtgaaatatataggaaaagaagattctccaaaaaaaaaaagatcacgtatgtgattctctcaaaaaaaaaataggagtgcgattctctctttaaaaaaaataggaatgcgattctctaaaaagaaaaaaaaagaataggaatgcgatatgtttgtgctcgcgcgttccggcggtgttagcttcgatatttttcttaaggtacgggtgtgatttgtgccaaataaggttgcaatatactgtaactccatataggactagctagtttggtagcaagtcatattggattgttgtcacatccgcagaattgtgcaagaaattcagatttttcacgagaaatccagttagttgctctggttacatctaaacacagaaactgggaaacatccactgtactcgctttgagatgccgcgaattattaaaggcattgaaaaagatacgagtgatctcttcatttaatataatacgtaatatatctcacggattttaatttagactacactgtttaaatttatagaactagaatatattatttcacgtagtagattaacttattttaggagagagagtacataacttgacggtgttccatgcatcatatgcatcttgtggggattcagaactgcaagatagctatacagcctgaacccgaacaagttgtcagcggcaagagtacaacctgttggaattaatgaataggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcagggcaggcggcgcgtgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgtcggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttttgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatgtaataaattaaatcattatatgcccataatatcaacacaaccaagaaccaccaaaaatcattttcctatctctcttcgtgcacgcttaggtcattttcaacccaatgagtaggatagtgtccatagtattaaataagctgtcatttagaatgaaagatgatgtggcaaagtgaataaatgatgaaagagaatgaaaccatgtcttgcatgagatatggtttctacacaacatccaaaatatcatgtgagataagtagcattaaatttaaatatggaatagtggtgtttgtattagaagagtagtgcctagaactagtttcttgatgatatgaagtttattaaaactatgtttagtgtcttgggttaaaaatggccttagcacgagcatctacaacagttttttttcctgattactagtactcccacgtggccacgtcctaccccatcaccgccgacaagtccaaactgatatgcaagtccctatttaagttgagctgtctgtgttcatcagcccatcactctcttctgtctatgtaggtcatggcggttgcaggggcaatggtgatgtcaggtgctcttctccttctccacctcttagcttttacctgcgtcgcctgcaatggcggcagcgagctgccgccgatcagccggaggagcttccccaaggggttcatttttgggacgtcctcgtcgtcatatcaggttaggctttcgcttcattcttcctacaagaatttgggaataatttcataaaaactgccgctgaaactaaattatcgcaagaacatcagttggaacagaatgtgttcttttcaaattggaaaaaaaaaaggggttaatttcaagacagtataaatgaatagccccaccatgatgctttctattagtagtagaaagtaatatgaaccggtaatttcaattgatcgaagagttcggatttatttgtactactatcccagttaacagtagtagaaatatggagggatattattgtcaaaaagaaataagtgtggaggggtataatcatcatttagcagtgactaaaactttttttttctttttttagctttttcgatggaatatgagcaatgtcaacacaatggatgacgtcgtattaatctaaaaaggaaaacaaacataaataataaagttacccctaataatggtattaataaactactaatttatgcttgataacaaatactagtttagattatttttactggtagtataattcactagcaaatagcaccggagcatcgatcatgaatgaaacacatgaaaaaggagcagatgaagataaattgtgcaactagggtacctcatagatatcggtgaccagcaaatgatggcactgaaaaatgctcaagctgccctataagagtaagaataatgctcatatttgctggtagagaggaattcaagccctgatccaatacgtattcagtagtcaattcaactgtttcgtgattccttctcaactcatcacgatgtgctctgtttcaggtctgaaataaacctgacgaattgactgttgttttacacatgatgcagttcgagggtggcgcagtgttgggtggcagaggaccaagcatctgggacaccttcacacatcagtctccaggcatgttaactgtaaatggcaagaaaggaaaggcaatgagacattattttgaattgaaaatccgccaatttggcagacaaaatcactgacagaagcaatggcgatgtggcttgcgacagctaccatctctacaaggtattagcaattactcatagcatttttcaagttgctgtcatggccatttctaattgatcttttgtaaaggttttagtcaaatatacacaacatgtttgccagtctgcctctgccacgatctcttcaaactttaattctaagattctttaaaaggactaatttagtactcatcctgagggcctggccaccaaaaaatgcaggaagatgtgcgcagtatgaaggagatggggatggatgcatacagattctccatctcatggtcaagaattcttccaagtgcgtgaccatatcttttaggaaaaaaataatgatagatacaatgaactgtcatagacttaccaacagatagaggttatctaaatatgttttctcttttgttctcaagcacaatattttgcatttctttttcaatctccaaggtgatccaaccagggttaaaatctcactgacatggcagatggaagtctgagcggtggagtcaacagagaaggcatcagctactacaacaatttgatcaatgagctattatcgaaaggtatgcaagtctcgtcttcaccatttactttcaagttcagaatctagatgcagcttgtgacaaccattagctccattctttggtatgccagatttctttattcaagatgcaaaaataatcttatacatttgcaggggtgcaaccatttgttacccttttccactgggactcacctcaggcgttggaagataaatataaagggtttcttagccctaatatcatgtaagtcaacaattcttcagtacctttttttatcttttgaaaccgaattcttcggtaccttttgctgaccaggttaaataaacactaacttaaaaaaatatttggggcagtgttacctacttcagttataaatattgtcaacctcatcatgcacatcaattggattttttttagagtaccactgagtgaatgcgagccgtttattgtagtagatccaacagatcatatttgtttctactgcacctattagattgagtagtagtgtagtagaagggtattttagaaaaaaaaatacatggcattgatgtaaatacgtagttgttgaagggttccgtagttcatcgctattacccgaaatttcaatgtcaacagcttgtggagttctcttcccatttttgtcgcaaatactcactccttcctaaattgatcatcatacaatggaatctaaaatttctcaaattgatcaacatataaccgtatggacacggattttatcataatacaattaattcagtatgggagaatgtgtgcatgctagggtgtaattgacatgatgttttaatcaacacatgcattatggaagaacgtgtgcatagtgtcttgattgatgcaatttaaattatcattagtcttggtacataaacatatatgatgatcaatttgggatggagggagtattgtttactgcgatttgtggaaagggaagtcgggaggtgttttgctttgaacaggatttatcatttaaccgctgtttgcactgacaccagccctaatagtgctccattgtgatagtcttttcagctaaaacatctactgttacttgcaatcaaagaagtgctaaagttactgactgtgaagaactgttgcagaaatgactataaggaatacgctgaaacatgcttcaaagagtttggtgaccgggtgaaacattggatcaccttcaatgagccttggaccttctgctctatgggctatgcatctggcatcatggcaccaggccggtgttcatcctgggaggtgggaaaatgcagagttggagattcaggaagggagccttacactgcatgccatcaccaactacttgctcacgcagaaaccgttcggttgtacaaagagaaatatcagttcactgaaggaaatgtcaggcagttgcagttcatccgtgataataatttaaatcgaagatccgcaaagttaagtttcataatccaaaattatttattgcttggtattcaatttcagctggggcctggtggtggtagtagagtttatcagtagagacattagcggatcttacattgttatttttcattgtagtaaatttcacaaaaatacaagtacttcatacaaactatcataaaactatatatttaacatgttgtatcacaaagctataaatttagcaaagttatcacaaaactacatatttaaagccaagcattacaaaactacagctttaatattatcacaaaattacatattttagagtttaaatcccaagcactactattatgtttgagctataaaagttgtagttttacgattaaattggtgctaaacttgtaattttgtcataattttgttaccaaatctgtaaatatgtgatacttcatcttaataaatttagctctaaatatataattttgtttttttgaaatagttaaatatataattttgtgatacaccgtcttaaatatataattttgtgatagtttgatcaaaatatatgtagtgtgaaatttactcttcttattatgaactgtaatatggtaaaactcgatgaaacacacaccacaataccaaatagtcaatatggataagagaaatcctagaatcctaagaagaaaaataaaacatttggcccttaatcacaaggtcaggtatagaggtcaaaataggtaagagagatatttatttgtttattatgcaaggccctccagactcaaggggaaaacataatcctataaattctcacacaaaaacaaaacatcatgtcttaatctcgatgccctaatacagaggtctggatctattagttaggttggagatatatttatatactaaaaggggaacgctccggtgctttctacttgtaatattatactatgagtagaattaatcctgaccgtttattttaaagggtagattagtaatctcctagtacatattaggggtaattttggctggaggatgatttctctgtctcattcgcttaattgcatcaggcccgacgcaggaactgcatcttgcatgttacttatcgcgactcctcccggcaggtggcggcgcggcaaaaattgccggcagcgctttgtaatctctgtttggaccagacagcaatactatgcaatgtgcgactggttgctttccagcaggtactgaaacccatttcacgcaggcattcattagacaactgctagtctgctaccttgaaaactgaaaaattatgaactcgcgtaatagcagataaatctgtcgaaaagctgtttgcaagtaacgtgatggtgcatgcacataaataagtgttaaatcgatccattcaggaagatctaaacagccaaatttaacgtataagcagtagcactcacgatttctcttccatatccatactgtaattgctctgaagccatagacctgctagtagtcattccataagctgctggtcgggcgcgacgaccccagcccgtcccctgtccatgaccacagcgcgacagcgctgtcaccccgcttccgaattccgatagctactgagcgcgccgtcggggaggagggagccagctgcagcagtccgtgggcagatggattgataggggaacggatgcgtggtgaccgccgttatgtgcgaagttacaatattatccctccactccattttgcgatggactattatgtccttccacttttctactacccttaattgacgtggaagtataattagatcaggtacattagattaaaaattatcaacggcttagattaattctactaccagtagaaagcgccggagtctcgctcatactaaaaacaatgaaaggcctttagagtcgatatgaaaaaagaaaaaaaataaaagcaaaacattcaccattaatcttggcaaaagatcgccagttgagttattttcaaaattcaaacatatatcagtagccaacaacacagttatacgaggaagttgaaaccaacaaacatgtaaaatacaatttgcaaataagcattaatgtatatgatagctagctgcacaatttgtgcaggtaacttggctaaatggctagcaagttacttttttaactgcagcgctattttatatcatgcattatcatgaaacagattcctatcagatacatagacatgcgcatactctagcctaccgttatattcaaaacttctgcactttactacgcaataatatgttctaggccttataatttgaacatgaatgtagatatgcattagtagttagtattgtataagcgattgttgtggtgtatgatagtttgagtgctgaagctgagtctgtttgctagtagatcaaggctttagcttcagcactcgcaacatcacactccacacacctcacaatgaccaaatgcttatcaaatgcaggctttacaaaaggggaagattggaataattttaaatgcagactggtttgttccattgtcccaatccaaatccagcagtgatgctgcaagacgtgctctagacttcatgcttggatggtattctttgtctcacacataatttcattattatgagagtgaagattctaactatgaaatcccttctaggtttatggatcctctcattagaggagactacccactaagcatgagagaattggttggaaatcgcttgccagagttcagcaaagagcaatctggaatggtcaagggtgcattcgatttcattggactcaactactacacttcaagctatgctgataatgatcctccatcgcatggccataacaacagctataatactgatgcacatgctaagattactggtgagcaacattatctcatcatgaatatgtgataaatattggtttggatacatgtattgtgtagcttgtttttgctactatgtgctaaccttgtccaattatgctaggtagtcgaaacgggattcccatagggcctcaggtgacctactactttgttatccacagaacaaattcctagtaaatcaattgatcaaaggacatgattgaaaactcaacaaacaacatgtgtgtaggctgcttcgttttggtttcacatctaccctgaagggatctgtgaaatgttgctttatgttaaggagaactatggcaatcctaccatctacatcactgaaaatggtaagttccaacaaacatataggtcatacagtttctcagcatgtgtgcaaaccaatactactgtataacaccttctgattgttggttttttttcaatctagacaatagtgcacataggacttaatagtcttctcctagctatgtaaaaaaagggcattatcctcttctagaagtgaattaacattattgattctttctaaatacatcccaaggtgttgatgaagtcaataataagaccatgccgctcgaggaagccctgaaggatgataccaggatcgaatactatcacaagcaccttctcgccctgctaagtgctatgaggtcagaacatcaattcagacactcagctatcagtagacaacttaaagatggtactaacactgcattattccatatgcctccacagggatggagcaaacgtgaaggggtactttgcatggtctctgcttgacaactttgagtgggcagagggctacacagttcggtttgggataaactttgtggattacgatgacggaatgaagagataccccaagaactcggcccgttggttcaagaagttcctccagaaatcaaacagagatggaaacaaaaggttgaaaagagttgcatacaatgccttttctaattgaacatcgaaatagtatataagttttatgagttaagtacaatagatgaaattggttcgactaaattaataaatctcactctcctcttcttgcatgtttgcatctctctcttgcatgttacacaccttctatcaacatatttctcaaaagtcgaaactataactttatacttttattgattgatttttctttttagaatggtgtgtccataaccttagaatgccattactttgccccaaagcgatgttgttttttttttgtcttgctgagaggatgtgggattactgtatgttgaactcctcatcttatgatctcatccatgcgtggatttagcccaacaaagcccaaaagttctatctgcccacacgccaggttaagctagtttttgacgtgcgattgctgctgtaggggtggaaaaaaaaaagattaggagcttggttggcttggctcggctcgtaagccaaacaagtcaagcccaagcctcctatttagctcgttgttgaaatgagccaagcccgagctggctcacgagccgtttgttttggctcgcaagcctaggccatcatgtatttatatcgattattttatttttcatagagttattatttgttaattaaaaatttatcattaagatttttaaagaattgaatatataaacttatttaaattttatatgttgatgatttgatttttttaataattataaaatataaatgaataggtgttttaacaggaaggcttgcaagctagctcgagccaaaaaacgagccgagccgagcttaagttttagcttgtttctataactaagccgagctcaagtttttgaataagatgaacggccaaatatgtttaaaaaaatcaacggcgttaaatatttagtgacgatggagtattaggaatgtgattctctcttaaaaaaaattaggaatgcgacaggtttatgctcgcgcgtttcgggcggtaggagctttgatatctcttttgagataggtatggccgtgtgatttgtgccaagcaagattgcaataactccataattaatagtgctatcaggttggtagcaagtcacagatgccacgaattagaagcagtgaaaaagatacaggtacctaacttgatggtgttccatgcatcttgacttcttgagaagctagccatacggcctgaacctgaagaagttgctagcggcaagagcagaaccacgaatgtgcttcgtgcacgttatcagttatcacgagcatctaaagttgaatcgaccgctgtatcgagccaaagcaaaagttaaaatttaaatttttgaacttgattttaagatattttaacataatttctttttagcgttggtttttaagtcgttacgaacaaatatataaaagttttacctataaattattttttatttcctaacaagtcatattagtgaatatgggcaaccgatgaggctctaggactctctccgtttcaaaataggtccatttttcacccaaactactcataccaatacaaacaaaagaaactagaatacccctattttatctaatcttaatacaattatttcctactttattactcctaatgcaattatttcctcctttcacaaactctgttacaataattactcaaaatgaatttattttgagataaatgagagaaatcaaaaataaacttattatgggatggaaacagtgtactcccactgactactgatgggtgtgttgatagtgttttgtcagggtggtcaccactctgaaaaaccattatccccaccttgtccacaagtccaaacacatatcctgatatggtattaagcaagtccctatgtacgagaggctatatgttgggcaccgtttgtgttcatcagcccatcactcttttctgtctatgtaggtcatggcggttgcaggtgcaatggtgatgtcaggtggcgtgctccttctcctcttggctttcacctgcgccgcctacaatgacgccggcgagctgccgccgatcagccggagaagcttccccaaggggttcatctttgggacgtcctcgtcgtcatatcaggtcaggcatccaacctcatccttcctacaagaaatcgagaagaatttcataaaactgccaccgaaagtaaattctgcaaggacaacagtcggaacagactgttcttttcgaaggggaaacaaaagtacgaacagaatgtacaaatgaaacacatgaaaaaggaacaggttaagataaattgtgcaactagagtacctcattgatgtaggtaaccagaaaatgatggcactgaaaaatgctgaaatttctctaaagaataagaataatgctcatatttgcatgtagagagaaattccatgatccaatactgtattcagtagtcaatttaactgtttcctgattccttctcatctcatcacgatgtgctctgtttcagatctgaaacctgacaaattgactgctgtttcacacatgatgcagtttgagggtgccgcggcgaagggtggcagaggaccaagcatctgggacaccttcacacatcagtatccaggcatgctgactataaatggccagaaataaaaggtcattacattattttggattgacaattctctaatttggcagacaaaatcaccgacaagagcaacggggatggtgcttgcaatagctaccatctctacaaggtattggcaactagcattgactttagtactccctccattcctaaatgatcttcatatttcacctaagcagcaagaccaaggagcagttactatcccatctatccgtgcatgtcgcttcatcaattttgcatgccgcatgcaccagccaatcagctataatgcattaattccacgcatgcagcagctcccaacttaactctcacagagccaatgcatgcatgtagtgctgcttaatacgaagcaccattatcgtctacccatgatttctgctgcttcctaatgaaatacgaaggtcaaattgaaactttttacttttggtaatgcgaagatcatttaggaatggagggagtaagggttttaattaaatatacactccatgtttgccagtcttcctctgccacaatctcttaaaactttaattctcttctttaaaatgactaatttagtactcatcctgaggcctgagggcctgatcaccaaaaaaaattgcaggaagatgtgcgcattatgaaggagatgggaatggatgcatacaggttttccatctcgtggtcaagaattcttccaagtacatgactatatcttttagaaataaaatgataatacatccgtcccaaaatataagggattttgcccatataaatcccaaatattttgggatggaggtagtagatacaatgcactgtcatagatttactaacagacagcttatttaaagacattttctcttttgttctcaagcacaatattctgcatttctttttcaatctccaaggtgatcccaccagggttaaaatctccctgtcatggcagatggaagtctcagcggtggagtcaacagagaaggcatcaactactacaacaatttgatcaatgaactattatcaaaaggtatgcatgtctagtcttcactatttagtttcaagttcagtcactagatgcaacttgtgacaaccagatttctttattcaagatgcaaaataatcttatacatttgcagaggtccaaccatttgctaccctattccattttgatacacctcaggcactggaagataaatataaaggatttcttagccctaatatcatgtaagtcaacaattcttcagtaccttttgctgaccatgttaaataaacactaacttcaaaatactagggaccgtgctacctacttcagttaaaaatattgtcaacgtcatcatgcatatcaattagaatacccgaaatttcaatgccaacagcttttggagttctctttccgatttttgtcgcgaatattgtttactgctatttttggaaagggagtcaggacgggttttgctttggacaggatttaacccctgtttccactgacaccagcctcaatagtgctcccttgtgatagtcttttcagctactgttacttgcaatgaaaaaagtgctaacgttattgactgtaaagaactgttgcagaaatgactataaggactatgctgaaatatgcttcaaagagtttggtgaccgggtgaaacattggatcaccttcaatgagccttggaacttctgctctatgggctatgcatctggcaccatggcaccaggccggtgttcatcctgggagaagggaaaatgcagagttggagattcaggaagggagccttacactgcatgccatcaccaactacttgctcatgcagaaactgttcggctttataaagagaaatatcagttcactgaagaagctatcaggcagtcgccgttcatccgtgataataatttaaatcgaagatctgcaaagttaagttccataatccaaaattatttattgcttggcattcaatttcagctggggcctggtggtggtggtagagttttttcagtacagacattagcggatcttccattgttatttcttataattatctataatatagtaaaactcggaaaacgaaccccatagtcaatacggataaaagaggaatcctagaattctaacaagaaaagaaaaacatttggccattaatcactatgttaagtacagaggtcaaaataggtaagagagatatttatctgtttattatgcaagaccctctagcctcaagaaaaaaacagaaatcctatagactctcacatgaaaacagaaaatcatgtcttaatctcgatgcaccctgatacaaaggtctggatctgttgattaggtcaaagatatcagatatgttattttattatgtatatactaaaatacaatcaaaggcctttagagttgatatggaaaaaaaaaaagaaaacaatattaaaaagcaaaagcattcaccgcttatctcggcaaaacatcatcaattaagttaatttcacatcaccagttaagttattttcaaatacaaacacatatcaatatccaacaaaacagttgtacgaggaagttggatccaacaaacatgtaaaatttgcaggtaagcattaaagtttatgatagctagctgcaaaatttgtgctggtaacttggatgaaaggctagctagttactttgttaactgcaggactattttatatcctacatatcatgaaacagattcctatcatatacacagaaatgtgcatagagttatattcaaaacttctgcaattttctacacaacaatatgttctaggccttataatttaaacatggatgtaacagatatgcattagtagtcggtatcgttttaaggaacaacgaaaaccctaaccatgcatgcatattgagtgcttattttgtttacaaatcaatggacttggtttcagcttcagcactcacaccacacaatgaataacaagatgcatatcaaatgcaggctttacaaaaggggaggattggaataattttgaactcagagtggtttgttcctttctcccaatccaaatccagcaatgatgctgcaagacgtgttctagacttcatgcttggatggtattctttgtctcacacataatttcatcattatgagagtgaatattctaactatgaaatcccttctaggtttatggatcctctcattagaggagactacccactaagcatgagagaattggttggaaatcgcttgccagagttcagcaaagagcaatctgaaatggtcaagggtgcattcgattttattggactcaactactacgcttcaagctatgctgataatgatcctccatcatatggccataacaacagctataatactgattcccatgctaagattactggtgagcaacattatcatggagtggtgtacctgttttgtgcatatgaaccatggaattccaacatatggcaactgctcgacacaacatattaaaaaaacaaatagaatttggtcagctcacatcatagcctttgaggcattgtcaattgcacactttattttccctcgaaaaacatgccgactttatttgaaaatggcatgttacatgagcatcccagctttcctttcatgcatgaaatgaatgtggagtgcttcaatacagtataatggctatgattagtctggtaatgatatctgtttaatgtgtgtgaagacaaaataaaaaaaaacactatacattttcaaacatgggggtggcaccccggggtgctcaacattatctcatcatgaatatttgataattggtttggatgtgtagcttgtttttgccactgtgctaacatttcgcaactatgctaggtagtcgaaacgggattcccatagggcctcaggtgacctactactttgttatccacagaacaaattactagtaaatcaattgatcaggtgacatgattgaactctataaacaacatgtgtttaggctgcttcgttttggttttacatctaccctgaagggttgcgtgaattgttgcttcatattaaggaaaactatggcaatcctaccatctacatcactgaaaatggtaagttccaactaacatatggatcatacaatttctcactttctcagcatgtgtgcaaaccaatactactataacaccttctgatttgatttttttttcaatctagacaatagtgcacataggagttaggacttaatattcttctcctagctatgtaaaaaaaagggtattatcctcttttagaagtgatttaacattactgattctttctgcatacatctcaaggtgttgatgaaatcaataataagaccatgcgactcaaggaggccctgaaggatgatatcaggattgaatactatcacaagcaccttctcgccctgctaagtgctatgaggtcagaacatcaattcagacactcagctatcagtaaacaacttaagatgctactcggtaacagtgcgttattccatatgccttcacagggatggagcaaatgtgaaggggtacttcgcatggtctctgcttgacaactttgagtggtcagagggctacacagttcggtttgggataaactttgtggattacgataacggaatgaagagataccccaagaactcagcccgttggttcaagaagttcctccggaaatgaaacagagatggaaacaaaaggttgaaaatagttgcgcacactccctttttctcattgaacatcaaaatagtatataagctttatgagttaagtgccataaatgaaattagttcgtaaataaatctcactctcctcttcttgcatgtttgcatctactatctcttaactatatgtacatagctaagcaaaggataaataccgtatgggcatgtatgtttgtatccaagagggatgctctaatgaaagatggacatgagaagtagttcttcgcacttaaggattattacacaacgtatatgaaaaaaaaaatgtactccttgtggtaaaaggagaaatgtgcgttccataatgcctacaacgcactcggaattggctttttatacggcattaatcaagcagtggtatactggtagttcagatctatctgcaagtttgagcgatcagaaagaaatcggcacatgcagacggggtacttaccggatgctcaccctggggggatcgggaggctgccgctatggctgatgaggcgagccggtagcaaggtcgtcgctgctacctagcttgcagtgttgccgccttctccggtggggggaagggcaagagcgcggagggcggctggagtgcggggggcggagtgtgcggtggtagccatccatggattcggagcgtgggggcggaggcggagaggagggtgccggccgacggggcgctagcaatggcgccgccgcgggagcagagatcggcgagccggcgaccaccagatcacggctatgaagccatccagaatcgaacacgtatcgccgtataggtggtttttgatgttttttttttgttggggggggggggtgttaaaagaaaataatgctacaaataaggtgattaaaaataatatgaatcagtttactcaagtttgaaaattttcaataaaatttgttaaaatatgtactctgtataaaaatttatataatctcaatccttatttaggacaaaagttctaactcaacaaagtatgaagtttctgtgatcacacgatgaatgtgttgtcttttatgtgtgctcacttggctgttgtttttttttttttttgcttgaatggaatgaagacgaccatgataattttttttcttgatgatgataggcctgatgttatttgtgcacatcaaaacggatgtgttcatgtgaaaatgggttctagtctgcctaggcacacttagcaccctgtgagtaccccatagcaacaaccagagacatgccgttgcaggggaacatacgtttccaaataatcattagggtaagaccctattaaagtgaaggcatgctgatttatcttagacttggtaggtcagttagaatgttctctgatgtcatagagattagaatttagagatgataagcaattaggagattcgagagtgaatagatgtggaatacatgaagaaaggagtaagatgtagaagaaataggtaagggaagtaaattaaatttgagaagttgtttcaattagcctttgacccccaacatctataaaagaggtggttttgcatctgtttgccattttctatgtcctattagactcacagatcaactagagcataagaaatcccagcctcaagcaagaaaacacgagaaatatctaaaattggacttgggttcgcgaccgaaggtctgacaggccaaacactagcggtccaaccgctcaaaaattagtggtcatatcagcctcaatgtgaaggctctaatcttttctaaacttcacctaaatttgatatagtgttaaatttggctatcaatggttgcaataaactctatatcatggctaattagctggcaagtctgtattgaacaataccacaataaactactattttctacttaaatatatggtgttgttgacttttggtcatggtgttcgatcattcatctcattcaaattaaattttaatataaatatttaataatatagttcatgcttaaattacttactatgataaacaagttaaaaacaaatgatatttacatgtattttttacattagctacctctacacgcagaaacaaaagggttacactagcatgtacacttggacaatcccggctttgagaaagctaccattagaaacaaagagagatcagataaggcctttgtttagttggcaaaaaattttggatttggttatcacatcggatatatgggcacacatttgaagtattaaacgtagtctaataacaacaaattatagattccgcttgaaaactgcgagacgaatttattaagcctaattaatctgtcactagcaaatgtttactgtagcaccacattatcaaatcatggcacaattaggcttaaaagatctgtctcgcaattcacacgtaaaccgtgtaattgattattttttttctatatttaatactccatacatctctactacttaaaaaatccgtagtggtggtcttgattcctgacacagcagacgcatctgacagacacgcgcaatctcaaccatccgattgccatatcgaacggcgtcgatctcctccccatcacgcgatcgctcctctcctccttcccccaagccgcgtcgttcgccctcctctctgcgccgcctcctcgccccgcccccgcgtcgccttctccacgcccgccggccgcctctccagacgctccctcgccgccgccctcgcaaatctcctccgcgcgctctcatccctcccttaaccatcaccggccgctctcatctctcaccaggtcgtccaccagtccgcgacgatctctcccgccggcgtcactagcgacgccttcctcgccgatctcctccgcgccctcgccgcccccgatctccgcctgatcgcccgcctccacgcctcccccaatccgcgccgtcatatcaccgttgcccggagtctcatctagccgtcctcaatgggcaagcacgatggatcagcgtttggttctttttatggggtgtcatcctgcatgtgcagaaaagtaaaggtgaaacacatcaatcctaactgcattttcagtgtttagctctccttcgtggatttagtgttctgatagatggaagtgttgtttcagtttttagctctgtatttcgtgggtttagggttctaatgagtggaattcctcccgttgccacagagcaagcgggcctagatgatggagaaggagaaccggtttggacaggatcaatccaattacaaatgggcatgcaactactactgtgacatcacagggaagtgtatgcatctgtttaggttttctgattacaattttgattttacaaatgtttcagtactttgactcaatgtcctgcaaccaatcttgtattcaatccaatttaataatttacccaattgagtctaggatagtttaacaaatcaatcgggagttcaactatgaattgtttcgctgtttcaggtcttcagacttaactgaagtttcaatgtcgccgccagatcaccattgttttcggtgtttcggatctgactaataatttcttttgctgatcagacatggattgatggcctccacataaaaatgcatacaagtctaggctttatgtggagggctccatggatactaataactccaatgctaacatatcttctgaagaatgaggatgatgattttttgaaaggtaaggtatatttctgtctccttggctttccgagatatgctgtatggcacaatgaaaaacatctgattctttccgtcaatatttaattgacaaatatatgaatttcccctatttgttggactaatatgtgtggtacaatatttacaactgttagataaattcccaggtaacatatgagtgtagctttcataaagctcacttcagattgtttattttcaagatagctgaacgtctgaaccttcaactagactcaagtatgagtctgtagtaggtttcaaatgtgaaggttttactagactaggaagatctaattcctattttccagtattctgctttgattgctatctgtcttccaatgcaacagaaaagtgcctcaagccacaatgtgttttgtatatatatagctacaactttgatttgagacatcggagagtcatcatagtttgctcatttaccacactttataaatgtaaaatgtaaaagagtaaagtgcacatgcggttcttaaacttgtaggggtgttttatctaagtccctaaactctaaaaatgcagatccaaatcccagaatttgtcaaagtgtcgcctaggtctcattttgtcatagcccctctaagatcctatgtggtgttgacgtggtatgccacaagcacagacgtgacatggcatcatcttaactgacaaatgggaccgacttaaaattcattttccttttttcttcttttcttctcatttttctctctcttttttctttttttctcctttctctgtgacccgagcaccctgtgcagcggtggcctacaattgtagatagagaaaggagtataaagggaaaaaaagagaagaatgagaatgagaagaaggaaaagaaaaagaaaaaggaaaaggaaaatttttaagtgagtcccatttatcatttaatattatgtcacgtcacgtccgcgtggcatatgccacatcagcactatcttcaagtaagaaatggacaatattctttttttttgtctaaatacaaataataactagagtgacaatatacattttggttgttttgcagccttgtccagataatcaggaccacatgaagcgaaatggatggtttaagtcgagctaactttagatatttattattttgtgtatttgataggagtaacacatgtactttatagcaaagcttgttcctatatgatgttgtggatacatgttgattgatatttttctaatagctctttatcgttttttttagcttagctatatgttttatgtaccattgtcaaagcatctttgtatcactgttatttggttgtttcatttacaatattaattgtcaccgtagcgttagcacggacacactactagtatatccaaacattcgatttaatgggtgaaaattgtataacatgccggagttccgtgcatcttgtgaggattcagaacttcaagctagctcaagttcaaaatacaaacagagagagaatttcacgctagctttgcggctgtaccagaacctgaacaagttgcctgtggataaactcggcctttttttttctctctgcatgcaagagcaatattgcagtgggcatgtacaggtagtgccgttactctctccgtcctaaaaagacaatctaaaaattggatgagacgttttctagtacaataatatacagattcgttgcactagaaaatatcccatccaatactagattgattttttatgggagggagggacttaggaatatgtaggagtatgtgaaagggattgctaactactccctccgtcaaaaaaaaaaaggcaaaccctagtttccgtatccaacgtttgaccgttcgtcttatttaaaaaaattataaaaaaaattaaaaagataagtcacgcataaagcataaaatattaatcatgttttattatctaataacaatgaaaatactaattataaaaaaatttcatataatacggacagtcaaacgttggcacgttggcacagtaatctagggtttgcctttatttagaactgagggagtacacgcaacctgccagataacgcagcaaaaatgatatttttcgtgcccgtttaacacgagcatctactaacagaagtacaagatcatccatcgctatcatcaattctgcatactacctactccctcggttcaaaaaaaaccaaagcgtttgccatgaatctagaaaaaactatatccagaattatagcctatatggaaggtgtatacccttaagcaaaaattaaattaaccaattttctaaaaaaaatcagagggaattgtgacattcaatataccattgaatataatagcagtcacattatgatagaatcctcacacatctagtctcaccactctgcagtgacataattgctcccgtccacgcaagtccaaaaatgatgggtttctactttctactccttccgtcccataatataagggattttgagtttttcttgcactgtttgaccactcgtcttatttaaaaaatttatgcaaatataaaaaaacgaaaatttatgcttaaagtactttggataataaagcaagtcaaaaaaaataaataataattccaaagtttgttgaataagacgagtgataaagagtgcaaataaaaactcaaaatcatttattttatgggacggagggagcagtagataacgcaagttcctaacttcttatacatggtgacgctatatgctgtcgcttgtgctcagcaatccatcactctttcttttgcagaattgcaggtcaagcttcgttcagatggcggttgccggggcagtggcgatgtccggcggtattctcctcctcctcctcctcctcctc

SEQ ID NO: 43065 - DNA, 2282 bp, Oryza sativa
aaaaacctccgcgtcgctctcgcacgggcggctcgggggcgaaaaccctagctgcccgcgccgccactccgcctcctccacctcgccgcccccggagctcgccggcgggaaagctgccagcgagcagggaaggcggcggcgaggcacatcaactcgacggcctccacctcggcgcgacgaggacaggggaacgacgaagctctccgccgcggtcagaggcggagacggtggggctgcttggagaggcggtggatccggcttctttgaggccggatttggccctccgacgcctggatctggccggagcagctgctccggcgtggcggcgcgaggcagctggccggcctgggcatgttggcggcgtgaggtggctcggcggcgtgcggcctgcctgggcgtgaatacggcgcgagctgcggcggcggctcggcagcggctcggcagttgggaacggcggcggcgtagcctgcccgggcgcggagacggtgcgagcggcggcggctcggcggctaggaacggcggcggcgtggccggcccggagctacgggctgggagcgggcggcagcatggcgctggtgcggctgcccgggcgcagcggcggcgtgccgcggctcggctgtgcggccgcgagcagccccatggcgcggccagtcctcggctgccggggtgccgccgcgatgccctgcggccgggtgggtggcgtggcgtggccaggtggggcgcggcggccgggcaacaggggcgccggagccggaggggtagtagcttcaccggcgtcggcgtaggcctagaaggcagtgcaaagggagctggcagtggtggatcgtcttcctcgttaccggtcggcaccctcgccctttctggagctcctccccttctttgcggggagtttctgggttggattgaggcggcagcttgtcagcgggggaagcttaggttgccgaaactatggcacccagtcccgggttctccttctgccagatctagcaaggaggctggcgggtggtggaacagaggggtcctgggccagctctcagggatggtggttcgttggcggaagccatgtgccaccgatgtttagatggtggattcggattgggcaacggaccacagcggtagggggtttccgagcgaaagcttagcccaattctttgggccaacagtgactacgtcttcgggcgtggtaaccctcctgagggcattgttgaggtatccctcctaaggagctctgggtgaaaacattgtccagttctttggacggatgatgacggcgtctttcggcgtcgtgaccctcgtgagggcttcgttttagagtcttcgtgtcgtcgtggtgttgttggtccagtggcgatcggtctcacatagcgatggccggttcggtgcttggcttccctcactgtagcgtgtgtttgggcggttggcacatggttcagggcgtgtactctggtgcacatccttcctcaacagccagccgtcgatgtaaaacttttcttgtaaccttttcttcttatcttaattatattgaatgacctccttcggtcattccagcaaaaaaaaatctaaacatccaataagcattcagtggtcaattaactgtttcgggtctgaaacctgaagaatcggccgttgcttcacacatgcagtgcgagggtggagcagcagaggggggcagaggaccaagcatctgggacaccttcacatatcagcatccaggcatgtttaactgtaaatgacaagaatgaaaaagcaataaggcattattttgaattgaccattatctaatatggcagataaaatcgctgacaaaagcaacggggatgtggctgacaacacctaccatctctacaaggtattagcaattaccatttttaagtagccgtcctgggcattttttaacaggcattttgtaaggactttcaataaatatgcactccatgtttctgttagtttctttgtttctatcagataaaagatataccacatgtcagtctgcctatggcgcgatcgcttcagagatcaattctaagtttcattggaaggactagttcagtactcacatcctgaaaaattgcaggaagatgtgcacatgatgaaggagatgggaatggatgcatacaggttttccatctcatggtcaagaattcttccaagtgcgtgatacacctaatatatactataatgcactgtcacgcataacaaatatatagcttatctgaagatgttctcatttttcttcgaagtacaatattttgcatatctttttcaatctcccaggtgatccc

SEQ ID NO: 43066 - DNA, 48837 bp, Oryza sativa
aaaaatattgtccacgtcatcatgcatatcaattgaaatacccaatatttcaatgccaaaagcctttggagttcccttccccattttcttgtgaatattgtttactgtgatttgttgaaggacaagatttaacccttgttgcatcgacaccatccacattagtgttcccttcatatagtattttcagctaaaacatcctagtgttatttgccatgaaaaaagtgctaaagttactgactgtgaagaactattgcagaaatgactataaggactatgctgaaatctgcttcaaagagtttggtgaccgagtgaaacattggatcaccttcaatgagccttggatcttctgctctaaggcctatgcatctggcacctatgccccgggccggtgttcaccctgggagatgggaaaatgcagcgttggagattcaggaagggagccttacactgcatgccatcaccaactacttgcccacgcagaaactgttcggttgtacagagagaaatatcagttcactgaagaagttgtcaggcagtcgcagttcatccatgataatgatttacatcgaagatccgcaaagttaagtttcataatccaaaattacttattgcttggcattcactttcagccaggtcctggtggtagagtttgccagtacagacattaacctttactagtagtagttgataaggaaaaaaaggaaagaaattctagaattcacaaaaaaaacaataaaaattggcacttaatcccaatgtgttatgtgccctagttagagaggtcaaaataggtcagagaaaatatttatgtattatacaagaccttctcacataaaaacaaaacatcatgccttaatctcggtcctcctaatacaaaggtctggatctgttggttaggttaaagatatactcctattattttattattttcatgctaaattcaatgaaagactttagagttgataagaaaagcaataaattcataaaaagcaaaacatctcccattaagttatcttcaaattcaaacacatatcagtatccaacatcacaaatgtttctgatagctagctcacaatttctgcgggtaacttgactagctaattactttattaactgcagcgctaatttatatcctgcatattatgaaatggagacatgcatattctagtccagtgatatattcaaagcttctgcaatttactgctacatgataatacgttcaaggccttataatttgaacatgattgttatacatttgttgttaatattatttttagggaacacaaaacctttgaccatgcatgcagattgaatgcttagtagaatcaattctgtttttcaaatcaaaaggaacaacaaaatgcttgacaaatgcaggccttacaaaaggggaagattggaataattgtgaactcacagtggtatgttcccttctccccatccaaaaccaacaaggatgcagcaagacgtgttctagatttcgtgcttggatggtaaattctttgtcacacataatttcttcattaggagactgaaaattctaactatgaaatcctttctaggcttatggatcctctcattagaggggactaccccctaaacatgagagaattggttggaaatcgcttgccaaagttcaccaaagagcaatctgaaatggtcaagggtgcatttgatttcattggacttaattactactcttcaagctatgctgagaatgttcttccatcgtatggtcttaagaacagctacaatactgatttccacgctaggattaccggtgagtcaacatattctgggatcagtcaacttcttttgtgcgtttgaaccatgaaatataaacatatggcaatttttttggaattttggatacatgcattttgtagcttttttttttgctactaggtgctaaccttgcccaattatgctaggtagtcgaaacggtactctcattggtcctcaggtgacctacagctttgttacccacaaaacaaattattagtaaaagtgcaaaacaatgatcaggtgacatgattgaactctataaacaatatgtgtgtaggctgcttcatcttggcttcatatataccctcaagggctccgtgaattgttgctttatatcaaggaaaactacggcaatcctaccatctttattactgaaaatggtaagttcccacaaacatataggtcatacaatttctccgcatttgttcaaaccaacactactataacaccttctgattcttctttctattttcctattttctccccaatctagccagtaagtgcacataggacttgaatattttttcttctcctatctatgtgagagagagagagagagttctcctctagcttctaactaaaagtgtatgaatcttactgatcctttgtactcgtacatctcaaggtgttgatgaagtcaataacaagaccatgccactcaaggaggccctgaatgataatacgaggatagaatattatcacaagcaccttctcgccctgcgaaatgctatgaggtcagaacatcaattcagacactcagctatcagtagacaacttaaagatggtactaacactgcattattccatatgcctccacagggatggagcaaacgtgaaggggtactttgcatggtctctgcttgacaactttgagtgggcggatggctacacactccggtttgggctaaactttgtggattacgatgatgggatgaagagacaccccaagaattcagcccattggttcaagaagttcctccgagaaatgaaacagggatgaaaagagtcgcacgcattgccttcttttttttcattgaacatcgaaattgagtgtcacagatgaaatgagtttgagatgtgcttctttgtttaggctatacaagagtaaacttcacaaaactacacgttttgttgtccaagttacaataaaaccacacaaattattagaagcaacagatgacaagtgattcacattttctctaagaaaaagaaaaagggaattacgccagaaatgcacacggggtactggatggaggctcacctcacctggaacgaggagaggggggattgagttgactgtgttgtggctgatgaaggggacgacgagagtagggactagcaaaggcttggaatctcgcgctgcctcgtcatttcaatcgtctcccattgggccatcgctgctggagctggtgctgccgccttcctccgattgggggttgtaacttgtaaggatgcagagctgaccgatcaagcggatccacgctgcccgcccgagcagaccgaagtttggtcgggtggaatgtagtagccatctgtggccggagcgtggggacggagaggatggcgagagggcggcgctagccatggcgcgcggcggcgacggcggctggatcgtggaggactggagggcggaggctcgagagagctggccttttcctcgtctggtgtaatgggctcaatcggacgaatcttcgatcctgaaaaccggcccacctcaaaagcttttgtaagcccaacaaggggtgtggaataagttcactttgagtcccttaactatagctcaaatttgattcatacccttatccgcaataccggatatgttgaccacccctcaaaaaaaaacttttaaaagtggtgtaatttgactccctgaaacggttttagaggacgatttcgctaacgtggtgcgttgacttggtccaacctactaagtcatcatgtgaaacccacccataaagtgacttctcttcttttcctcccccctctccacccacccatcaaatcagtgccaccccctcatcccccttctgctccatgtcgggccaccgtcggggacgaggaagcgtggacgaggccatcgtcgcgccaccggtgagcctattgccctcctctcggatccaccggtgccccaggaagtggaggcaactgcgagacgttggcccgttatattattattattattattacttgatcagatgattgcatttggaatagtaaagaacatctcattatattattatttttttacttgatcagatgattgcatttggaatagtaaagaacatctcgttatattattatttttttagagaaaaatatcttttacccggtctctacatctaactagatatatatgtagccttcatccaaccagatatatgagccttttaaaattaggaacttagcctatcaaacatgaaacttagccctcaaatagctcaatctgaaattgacttctatggagattttaactcgggaccttgggatgctactcaaatcactgcaaccgttaggctacgtgccttttcacaatagtatatcggatgactaaactgaattggctgatgcgatgcgccgaactttctaactaacctggcctctatatagatattttacctggatcgaagtgattaatgaaatcttccagattcaaaaaacaacaggagtttgatttcttgatgatataatgggagtcaatcacaaggctccgcattcgttgaaaagaaaaatcagagagagagagagagagattttcgtcgataaatcaagtgacttgaactaagctagcccaggagtaagaagacatcggataaaccataacacggcagcataattctgatatattccgaaccaaacattgcctaggataaaccgaccgaatatgtgtcacgatcctgcccgacactaccaacaacaccgtgcaacattagagcaataatccggctaatccctagtaggatacgcgggtgggttacatgccaaaatcccgagcatccgatccgcatcccggcggcatatctctcctcgccgtccgacggctacgtcccctgcctcgcttccaggcagatcgagcacacgcacgtacgtacgcagctagtacgtacgtacgtccatcgatatcatcctgatcgtgtctcactcacacgcgcgcagattgaagcggttcgtgataccctaaggcgccggttttaatttgcccggtctaagatgcgagcccgatgctcgtaatatgccgtgattagtgatagttttgggggtagaaatggattcttcggtttggacactgccaatcgatcgagcacggtgacggttctatctttttttttttggctcgtctgtttgctttgcaaaggttatcttatctctcgatcggtgtcagctaatggtacgtaggacaattgttcatggggaggaagcaagatagtgttttttttttttgtgtgtgtgtgtacacatgtctgtcaaagcaagaatgggaaatatattaatggagaatgattacatggtgcgttacgggcatgttcatataacatggtaggagtatagaagtaagaagatgcatgatgctccgttcaaaaaaaagaagatgcacatgtacatcgagactatcaactaaattaatttattttattttttatgtttgtgtctttgtagctagagaggtctagtacgcgagcaaagatcctgtcttttgttctttgttcaggccatgcatcatcattttgtcgctacgtccacattcagtagtgtgtggtaggacgtacgtacatatacgagactacgactacgtcgtcgatctaacactagaataatataatcgtcacgatggttactaattggttaattaactgcttcggctgtacttctgatgctacgatgtcactttaatttactaccttactttaccgactcattatgcattcttcgtaggtgacgtttcatattatttttacttattttctatttttatctgtctttggccaataataagatgcctaaagcaaagtacccatcttgtttaatttcctttgtttaatactggaaattaataagcaactgtagctctcttttttaatcttaagcaacatagagttttttttaagactcaagttattaatatttattaaggatagagttcatgggaaataatttcagtgcagtgcatcgtccgggtagaaaatcttatagcaaaggaccatccttacataaggtaagggaaaatgaactgcgagaacaaccttgcaaatgaaaccatacatcagttactgctgcgacaataagttctcagttttctagctgagaactaacataactagtttgcaagcggtgccataatataataacataagacatgctttgaattattgatcgttgctcatatttgaaaaacctgggctttgtttgattagaattccatcaaacttgccaaattatacctttgtttagactgttggatatccactcccatcttcttcatttttttttcattttttatcaccatcctacaattaattaggtggtgaggttgatggagatgaagataaagttatgtcacataatataaaaaaaagtttgattaattgatttttaattattatagacttgaaagtgagtttatctgatgttctaaagcaacttctatataaaaagtttttacatgaaatataccgtttaattgtttgaaaaacgtgctaacggaaatcgagaaaaatatatatctttaattagaaaataacaccacctaagaaagaacaggatgtagaagaagatgaaaaactacggaggaaacttcaaatcggacgctcgattttgtaaaaaaaatcggatggaaaatgtttcagttgatcaccggtgaaacattaagttatacatggtgaaaaaaatcagctaatgaaacatttaaaaattatgtgaaacacaacaaagatacacgtggaaaacataatgctatcgcatataaaacattgagtgttatcggacggaaacatatgttttgtcttatcagaatataatcatgtgatatcctattataaagatttagttataattaacacaacggtatgatcagataaataatttatgagaaatatcatttcgaagatgtctaaatgcatgcatggatgaagcgaagagatgatagaagcaggtaattgtatgaattttgtgaaacacagtaaagacacgcattgaaacattgagttttaatgatttcaaacacatgtttttttctttcagcatgatataaatatgtgttaacttgttgtaaatgtttaattacaggagaaaaaaatttaaagtaaggagaaaggaagaagaaaaaaaactaatcagatgcaatcttgcttgcatgcgagtgtcagcaaatggtttttcttctctcattgggcgaccaagcctaagatcttccaaaagtataaaaaataagtactccctccatcataaattatagggcgtcatatttttaagtaaaatcaaactcagtaacttttaactaataattttactaatcatatatatgctaaatattatacatattatatcactagattcatattttaaaatattttatgtgatgctaattttatatttgttgggaatatagcatataataaattaatgattaaagtatattattgaagatcgtttctactctcactttcatctccaatattgatttcacccctactttttagagtttttgtttttgccctcactttttttaaccaaacaaactttttgcccatgttttagatggagaagttaacggtgttaactactacgtaaaaggacatttttaccctctaccatctctttcctttcttcttctttcctgctacggaaaagggtttttccgtgcggtcaaaaaaaatttcgcgtgcagatgaatgatttttgcatgcaggtgacgcccccgcacgtgaaaattggattttttttccatgcttatatcgcccacacggaaaaataaaaaaccgaaaaaaataaaattcacaaattacccaaaccctaaccctagatctgctgctccccgccgccggatccaggcgggggactgtcgccgccgccagatccgggcgaagggcagccgccaccgccggatccttgcgtggggagggcggcgccgctcctggccgccgccgccgacgtcggcggcggccgcatgatgtggggagggtggcgctgttcccggccgcctcctcgtcgtcgtcgtcggcggcggcgccgctcacggctgctgcctcctcctcctcgatgtcggtggtggccaccgcgctacctccgccagcagccgcgacgggcgcctcctcgtgggcgcacggtgacggcgccgctcccggcagccgtctcctcattggcatcgtcatcgacggcggccaccgcgatgcctccggcagcagccgcaccagcctcttgcgcctcggtcgccagcagcccggccgccgcctcatcggcagcggcggcggcgagcgggcgcctcccgcctacgcgcttagagaaagcaaaggagaggagagttgaaaggcaaagagagagagaagtgtttcgctcagagagagagaggagtgaatattaaaaggagaaaggtagagagagtaggtgaaaattttgaagtgtatgggagggaatagcattttgaaaggtgtgtttcagttaagacgttcgcctgcggaaataaactcatttttacgtgcggttcactaaagaggaccgcgatttttccgtacggtcctcttaaatggaccgcatgggaaaatgagccgatttttccgtgcggaccgagttaccgtccgcacgcaattcaaaagggtccctgttcaggaaaatcatttgcatagtagtgtcaccaaacagtgctacctgccatcggcaggccgtaaggcggtgcaacggtggctacagcgtccaggttgtcgtgatgcaggcgccgaggcgcggggccactgtggacagacggcggcgtacgacaagcggcccggccatcggtgctgctcgccgcccctccccttgttctcttttcttcttttcctcctcctttcccgatgtcttcgtctgccatttgtgggcgacggggctcatcgggacggtgtcggcgcggccgtggggaagcatagtgttgccatggaacggcgacacggccttgtgtgggcatggcaggcgggcagcgggccggcgaacttgatgcgacttcttcggcgcgacagacgctgctccccttttttttggttttcttattgtttgctattgatgtatcacagcttggccgccgctcgccgccgcctacgcctgttctgctcgccggcgggaagagctgcgccctagcccgctcgctgccgccgtcgccgccgcctggaaaagttgatttgtgggcgagaaaagaaaaaggaaagtgttagatatttcctagtggtaaagaggtaaaacacaaattcgaatttttttcctttatttctctattttttttactgccataaacccgtcccactaactttcatccaaatcagaggtaaactcctcttttggttaaaaaaaagaggaaaaaacgaaaaacctaaaaagtagggataaaatcaatattaaaaataaaagtgagggctaaaaaaatatatatgttatactcacggaggaaacagaataagatcgacccaaaaatatactcctttttggagtaatttgtaacggagggagcagtatattttccaaaaactaccgtgacctttccccaagtcgacccaaaaggccaaaacccacgggcgcggaggccggccggcggagaccacaacggcacaacccctcgaccgcccggtaaatcccgtggcttacgaagaatatgcgcgcccatcgcctaggcggtaacaatggaggagcggcgcgcgacgtcgccgtcgcggcacagcttttgtcgcgacgcccttggccgccgcgggggggaatctgggggcggcctcgtatatatataccgtagcccgctgaggtcaccgctccaacgccacggcctcaaccgggagtggagactggagaggtggaggtggaggtggaggtgggaagctgccacttggcgccagcgcgccgctgcccacgctcggatcggaggtatggattccccttccccactcgctgcgtgatgaaccgatgaaccgtagtacttgatgatatgcctgatttgcttcggcattgtgccgcttctctgttagctgggagtttgtggcgtgtcgtttaactgaagtagagatgtgatgatgatctgaggtgagcgccattttttttttttggctaactctgtttgttctattcagtgaatatgagctctcttttttgtcccctttttatcattctgcttctatgggtcgcggagcgttcttggttggtgcagtgcaactgcaatgtcagtatgcatgccatagtaatgtgatggtgggatgtaatgctcctctgcttgctcgagctctttcttggttgtctatctatcttggatgatttgatcaatgtactacttattatctgctgatagtacccggggtccatttgcgctagtattgaacttcttcttctcttataatttgctgaaatcgcgagattatcgcttaggtttatcaatcagaacattatcatgtttatgcttcggttcgttcggtactggcacatgtcaaataagcggaaattctgctactttttcggcttaccatgaatggcacccaacatagcgtggttgttttgtcatgttgaactagtacaaatttttgcaccttaatatttgctttccgtgcatatccaattaacctgcccatcaaacttcttttcagatagctattattggggaaaaatattttcccagcttcttttatagtgactagactgtttatacatgcctgcgtaattgcttccttttgatgagctagtacattatagaccttgattttgttttgatggtacgggttggttattggtgtccatataatgaaattgcaacttgcgaccactccatgatagttacctggtcattccttgttggttaataagctattatttcaaatatgaatgttcatcctacttgtcatattatagacatttgtcacaattcaagtgaggaagaaattctgtaattttctatgggctagttgctgcgttaactacaataatggggctgacatcctgaggttatagtgttcgattaccaagttctaatttattaagaggaatgcaagtcaacatgcatgcctagcccatttacttttaatgagtagtgtaacttctgttgcagaagtactaatgacagctttctatataaatttcacaggttgatttatcaaggacaacaattcgtcagaaatggacccaaagagatcaatagatgatcaattttctaagttgcatccaagtttaccagttgatactagaattggcatagtgggagcaggaccaagtggcttatcagcagcctatgcactagctaagctaggttaccgcaatgtaactttgtttgagaaatgccatactgtttcagggatgtgtgagtccattgacattgaaggtgaggaaactactcagcaaaattatacagtcatcattttgtgcacacttttagttatcagcaacattcgtatgtaggacgaatatatgatttgggaggacaagttatagcagcaaacagtgcccctgttataactcaccttgcagaggaactagggtctgatttcgaagagatggatacacacaaactctccctgattgacagccaaacaggaaatattcgagatcttgaagtagctgaggactatgtatccatggtatctctgacgctaaaattacaggtgagttgttctagaataaaatttaaatttgaggtaactggataataagcatctaattatttataatattctctctatttcttgcatgcgtgttattcaataattcttacaggatgaagcaaataagtcaggccgagctggacttcatgctctcagtggattggcatccgacccgacccatgaatttttgaagcaaaatggaataaattcaatgccaaaatctgtagcatatggttacaccgcttcgggctatggttttgttcaagacatgccctatgctttcattcaggagtttactagaacctctatggctggtaaaatccggcgtttcaagcatggttacatgagcatgtgggagagattaagtaaatcattaccatttgaagttttttgtgacacgcaagttctgaatgtcaagcgcaacagttgtggtgcaaatgtaaccatcaagaacaacaatggtgaaaaacaagttttggagttcgacaaaattatactatcaggtgctgttgctttcaagaacagcaaaacatatcgatcctctagtcttactggtgagcatattttaaattcagtttggctggcattgaagctatagtatttcagttgccttattagtatgtatgatcttttgttcagatggagaaagtgaagtggtggaactaaacaatcttgaaagagaactattcagtaaagtacagactatcgactactatactactgttgttaagatcaatggattcgagcacataccaaagggattttactactttggagaattcatggaggatccaacaacaataggacaccctgtggcaatgcaaagattctttgctgacacaaacattttcttgttttggtcttatggaaattcagcagacatcaagggttcatttgtggctaaatgtgtgactgatgtcgtgagttctatgggaggcaatgttcagaaagtaattttgcaacggcggttcaagtatttccctcatgtcagcagtaaaggtatatatgttaataatatttctcctgttgcaaggtcttcttttttctcgtgataacattggtaatttcctgcattgcagacatgaaagatggattctatgagaggttggagtcccagttacaaggttttcagaacacttactatgttggaggtttgctagcatttgagcttaccgaaagaaacgcttcgtactccatcatggctgtttgtaagcactttgccattgatggtgagggagaactgactccttatgtcaaggtgagcaagaaataatggcgtaatatatctcaattattaattccaccttcatcaaatttcttagagaaattgtgcatatatttttccatacttgcagagattattccctttgtcccataatagaaatccatcacctcctagagatcttggtgagcttgaaggtgttgaatttcctgaccttccctcccttgatggatatttgcaatactggggaactcataaagtcactgagaagaatgttatctatacttggatcaatgaagaaggaaagctcatgaatcgaagaacctaccaggagcttcatgggaatgcatcttacgttgcacaaaaacttttaacaagcacaaaacctgttatcaagcctggtgatagagttctgcttattcacctccctggtttggagtttattgatgcattctttgggtgtattagagcaggagttataccagtccctgtattgccccctgatccaatgcaaagtggtggacaagctcttcttaaagtcgagaacatctctaagatgtgcaatgctgtggctattctatccacctcttcgtaccatgctgctgtacgagcaggttatatcaagaacatgtcactttagcaaagagagttcagaaatgctcagcacagtggcctgacatcccatggattcataccgactcatggataaagaactaccggcgaagctcagacagcttcaactcagacactgttttatttaccaaaccccagccaagtgacttgtgctttctacagttcacttcaggttccactggtgatgccaagggggtgatgataactcatgaaggacttatccacaacgtgaagactatgaaaaagcgttatagaagtacttcaaaaactgtccttgtcagttggcttccacagtatcatgacatgggtcttataggaggtcttttcactgctcttgtaagtggaggaacttctgttctattttcaccaatgatatttatcagaaacccccttctgtggttgcaaacgatcaatgactaccatggaacccatagtgcaggtccaaattttgcatttgaactcgtgataagaaggcttgaggctgagaagaacaaagtatatgacctctcatcaatggtcttcctcatgattgcggcagagccagtaaggcaaaaaactgtcagaaggttcatagagttaactcaaccttttggcctttctgaaggtgtcctcgcacctggatatggtctggctgagaactgtgtctatgttacctgtgccttcggtgaatgcaagccagttttcatagactggcaaggaagagtatgttgttggtttgttgagcaagatgatacagacactctcatcagaatgttgatcctgactctctaactgagcaccaagaagatggtgttgaaggtgagatatggattagcagtcctagttctggagtaggttattggggcaattcggaaatgagccagagaacttttttcaatcagcttaagaaccaccccaacaagaagttcacaagaaccggtgatttgggacggaccatcgatggtaacctttttattacaggaaggatcaaagatctcatcattgtcgctggtagaaatatttattctgcggatgtagagaagactgtggaaagttcttctgaggtcctccgaccaggctgttgtgctgtggtcggtatcccagaggaagttctggctcagaaaggcatctcaattccagattcttctgatcaggttggacttgttgtgattgcagaggttagagagggtaaggcagtctctaaagaggttgttaacaacatcaaagcacgtgtggtggaggagcatggtgtagctgttgcatctgtgaagcttatcaagcctagaaccatatgcaagacaacatctgggaagatacgaagatttgaatgcatgaggcagtttgttgacaatactcttagtttggctaagggcaaccatgtatctaagaaaaagggtctttttcggtctctgacaacaggaactggcatggagtcaaagaggtccctcttgaggcaaactgttgacctcaccattagccattggcccaaaagccaagttaaaaactccaatgaaataactgagtttctgacacaaatagtgtcagagcacactggcatttcaaaggataaaatttctctaactgacagtctaccttcgtatggttttgattctattgcagtggtacgagcagcccagaagctctcagattttcttggtgttcctgttggggccattgacatctttacagcaagctgcatttcggagcttgcaagcttcttggagaatttggtgcataagtcacaaacacagttggcaccttggcccaaaagcaaagtgaaaaactccaaggtgattatcgagtttctgacaaagattgtatcagatcaaacagggattccaaaggataaaatttctccgatggatagcctaccttcatatggttttgattcaattgcggtggtccaagcagcacagaaactctccgattttctcggtgtacctgttggagccattgacatatttacagctggttgcatttctgagctagctaccttcttggagaatttggcgcataagtcacagtcacagttggcacctggtgcatcttgctatattgaggatgagactcaagtggatcccatggatgccattagtccagaattcagtgttttgggtacgggcatcctgcaactgctggctcttacttatgtctgttttgtgctgctactcccagcatatcttgctagttcgacatacatgagcattttctctacagtcagtctggtcagatcaccattgctgagctatcttagttctttggttatggcacctattgtgtggatcttttatatctcgctcacttctttatcactgtctatcttggggaagtccttcctacagccaaattatgttctgatccctgatgtttcaatatggtcagttgactttgtgaaatggtgggcactaaacaaagcacaagcattagctgcaaagatgctagctgtgcatctaaagggcacaattttcttaaattattggttcaagatgcaaggagctcggattggttcatctgttgtcatcgacacagtagacataaccgatccatccctgttgacggttgcagatggtgcagttcttgcagaaggcgctcttgttcagggccatgaagtctgtaatgaagtgctgagttttaggcctatctggattggctgtgaggcttcgattggtccttatgcggtgcttcagaagggaactgttgtggaagatggagctgttgttccaccattgcagaagactggggctgggaaatcaacacgtcggactagcagaacttctgtaagcataaaggtaactaaagtatgtagacttcataatctacttcggtgtaataaaactatgatttgttatggtatacaacgatagtttgttccttcctgaccagaaacgtatagttgattatttctagacattgaatatagtaagctacagacttataattacaccataggccatttgaatttccttgtggtctttaacatggatgaagctgccaccaaagaacttccctacctttttacatttagtgaaaatattttttgagattcaggaagggacatatattttatcagggaaccataagcaaatcatttatgtacaagtggtcaagcagaaaaatcatataaattaaacaagatgaagggtttgtttggattgaagtcaatcttttggcaacttcaatagtattgtatagatatttggtccgataccaaatttttcccacactagtgcaaattctactcttaacaaatttggtagtgccgaaatttaccaatgttttggcacttccagtattttggtaagacaaaaaaatggcttcaaaccaaactagcccaaactcttttctgcatggtgcatagtgtctgcgtgtgtgcattttcattcgacagtggggtatatatctaactgccttcaaagttctcgattgcttctgcagaacatgtttgttcatggccatatttatataatgttattcgaatacaaaccgagtattttttctttgcagaaagaagcagccaaagcaaacatgatacttgaacacctcgttagcatctacgcagttggcatcctgggtgctctgtccggtgcaatcgtctacacactatacactcacttgtccggcaaagcggcttcgcctctgcatttctcctttgcatgcattgctggtgcgttccactggttaccagctgccatcactgcctatgctgttattgtccaggagacacccacaagtgcactgtcatttgctctcttcactgccttcgccgacctgagctatggtgtcatcctcagtattctcaccagtataaccagcagagcccttgctgcaaagcctggaaccaagcagaatggcattgcgagtttgatccaccggcgcataaccatctctgctcatgtcaggtttgccaagatgctatctggaacagaagccttctgcgtgtacctgaggcttctcggagcaaagattggcaggcattgctctatccgagccatcaatccggtggcgaatcctgagctgatcagcgtcggtgatggcgtccatctaggtgacttctgcaatattgttccagggttctactccaaggggggattcaccagtgcagagattaaggtccaggagaacaccgtggttggcagtggcagcttgctcctccctggctgtgtcctccaggagaatgtcatcctcggcgcgctctccgtcgcgccggagaacgctgttctccggcgtggcggcgtctacgtcgggtcacagtctccggccatggtgaagaacaccttgcttgacgaggatgaacggatcgaagagatggatcaggcatacaagaagattgttggcaacctcgcggcgaacttggccatcaccaccatgaacgtcaagtcgaggtacttccaccgcatcggcgtgagcggccgcggcgtcctgaggatgtacgaggagataccgtcgtttccccggcacaagatcttcgcctccggcaagtccttcccggtgatcgtccgccacagcaacagcctgagcgccgacgacgacgcgaggctcgacgcccgcggcgccgcggtgcggatcctctcggacaacgacggcgaggcgcctctcctcgacctcacactcaagagcggcaaggcgttctacgcgcgcaccatcgccgacttcgccacctggctggtctgcggcctgccggcgagggaggagcaggtcaagcgctcgccgcacatccgcgacgccgtctggggctctctccggagcaccgactcgtacaccgtgctccactactactccaacatatgccggctgctgcggttcgacgacggcagggagatgtacgccaagttcaagctccgtcctgctgatccagacgtccccgaggactccggcaaggtggtgccgaggggcatcctgccgccggagaccggcgcgatccccagggacgaggatgacacgcgccctctgctcttcctcgccgacgacttccgccggagagtgggctcaccggacggggtgcgctacgtgttccagctgcagctcagggaggtgcccaccgacgccgccgcccgcgacgtcgccctcgactgcacccggccgtgggacgaggccgagttcccttacatcgacgtcggcgaggtcagcatcggccgcaacctcccgacggaggagacggagaagctcgagttcaacccgttcctccggtgccccgaggtggacgtcatcccggcgacgtcgtgcgcgcagagcgcgtccatcgaccacggccgctcgctggtctacgagatatgccagcgcctgcggaacggcgagccgctgcccgcgtcgtggcgagctttcctggagcagtcggacaccaagatcgacctgtcaggatgcccggtcgctgccgccgcgacacccacaaggtctaacgccggcgacgccacgaaggtgacgctggccaggacgtggtaccaggcgctctgggccacgctgtgccagccgctgctgcaaacgctggtgccgtactctgtcctgggcctcgtcatcttcctcccgctcaggggcctcctcgccgtcgccgcggccacccgcttcccgctctactggctcctcccggcgttctgggccgcgtcgggcgtcgccgccatggccacgtgcgcggcggcgaagtgggcgctggtcggcagcagggtcgacggcgacacggtgcacatctggtcgccggccgtgttcctggacacggtctggcaggccgtgcgcgccgccacggcggagtacttcgccgagctgacgcccgggtcggcgccgttcgcggcgtggatgcgggtgatgggcgcctccgtgtcccccggcgacggcgtgtacgtggactccatgggcgcgctgctgaacccggagatggtgcgcctggagcgcggcgccgccgtcgggcgggacgcgctgctgttcggccacgtgtacgagggcgaggccgggaaggtgaagttcggcgccgtgtccgtcggggaggacgggttcgtcggcagccgcgccgtggccatgcccagcgtcacggtggacgacggcggctgcctcgccgcgctcgggctggccatgaagggggagacggtgaagcacagcatgtaagcaggacgatgacgaggaggcatgcatgcatgcatgatcagttgctgtgctgcttttactcttctttttcacttctttgaacttgttttatatacgtacgcgaattaggatcttggtgatcataatatggtagtactcctatgatcaataagtgaccgttggaagaagaaataaatgatcggtataatttgcctgcatatttgtaacgggttagatggaattatacggaatataatgaaacaaataaatcgaccaccatcgtggtcagcatatatatctgaacagcattagcattagcattagcagcagcagcagcatataagcaagatcggcacctgcgtcgctgtctcggtgatggtctttttccctgtttaaacttcaaaattttgtgatgtctttgtctgccatacggaaaaagggatatatggggatcgtttcgagtccatgaccatgttggtgatcgtttccaaaccaaacaaagctttccacactgttggcgaaaaggttgaggatactattatgaattttaaaccgatctcctgctaccgtccaaagcaaagagagaaaaaaaaggaggcaggcaatggcaaacctgtaaatacggagcggtatcgtgcaacgactctgacagcctcaacaacacccagccttcccctgcaccagctggccctgacgtcagcaaccggcagcgccgccgccaaaggatggaatcccaggcccagcaagccacaaccactgcacgtgggccccaccccctcatctctctccctctgcaccggggccccaccgcatcagcgctcgccaccaccgaggcaacgtgtccctttcgcgacactcgagtacgcgagaccgtacggcgtgaggcacctgcgctgcactgcagtactgcacctcccccccccccccccctgcaaaggttggaaggagcagaaaaggaaagaaaagcctcttctactactagtcttcttcacctttttttcctgtgcgtcttcccgttgctgcgcgtacacgattgaggcgcgggcgcgcggctagactctggatggctcatcctcattgggccgtcaagccgtgctgctgcttctgctgctgctgcctcctcgtcgccgccgtgctcgccgtcgccgtctttctggccatgtcgccgcccgccgccgccgccgccgccgcattggtgtcacaaccaggtaggttcaaaaagtgcggggtcttttctgtaacgtgagttcttgacgacgcggctttttgtagcggcggcggcggcattgcaacgggccgagacgacggcgaccatgtacaccgcgaaggagttgcgggagaagcaggacgtgaccaaggtcggtctgagctcaaaaaaaggtggctcttttcatggctttcttgccctgttcgatcgatctcatggtggtgtagggtttcttgatttggggggttgcagggcgcggaggaggacgtgaccacgacgacgacgacgacggggttcggcgcggagtcggagagggaggtgcccaccgggccggacccgatccaccaccacggccgggggcccaggcggcagtcaccgtgagtgcgaatcccccgtcgccgtcgccgggttaacgaatcgggcgtgaacccagaatcccatgagacgcgatggtctatgaaagaaagattgtgctcttcaattcgttttgctgaatctgtgatgcacttggggattttattcagattcatttcttgctgtagggaacacagtagtatgtctgaagaactaggcagctagcttaccaccattatctttgttttttgcataccaaactaaggaaaaaaaatacgattcataagttctccctaagttcttcttcctaaggaatctttgcatgcttccggatagttcctctttactctctcttcttgtattgtgatggatttgagttttgaacagggagcttgttcctgttcaagtattctgtatgttgatgcatgattgattgttcaagttgaggaaagaagcagcaaaactttttgttcctttttctgttcatggaaggatgaaaactgcagctttgttctgttgtgtgcaatgaaaagagttcatgtctagtcttctgatatgtgctggccctttttgaggcctggagcagcagcttggtccaatgtgcatatatctcggctcagaagtgcacaagacttgattcgaaattctacctggttgctgctacttgctggagtagcaagcatgcttgcctgttgtaatgcctttcttgttgtactccactttttaatttggtgcaacaagtcatacaatactatcatgttcaacctttcataatcgtataatgcaactccactgcacaagagaatatggttgtgtgtttatataattcagaaaatgggcattttgtgttagctatgagtgaactgagtatcagtgaggtgtgagggtacgtttcttatgttgtttgatctatgtatgtggttagaaccattttcaggttcccttcaaaattaagattttcagaacaacttatctataaactatgtaatccgtagcttttgatgtactgcgatttgcaatattgcaatgatcaaggtagagagcatctgaagttgatgtagaacgttatatttagttgacacaatgacagtatgaattaccttctgttccatgacattgcaattcatgtcgactacctggtttgatttccagcaatggatccaaaagctcgcattcttgtgatttacttgaaatgattgtagttgacgtattgcagttcaccgtttgctgacggtgtacagcttacacaaatcactgagagagcatgttggaaacaaacacgcagtagaaatgtttaatgatcagagcagaattcaagtatttttagccaaaaatgggggaaataaatgaagcatacaacgaccaagtactcctactagtacagaaataggtacagtttgactcctttaaatgtaggtcctatctgattcgtatctcttaaccacaataccagatatcttaaccccctaaccattaaaacgatgcaatttaatttctatcgacgggtgatacccgtagaccggatatagagagtattagggtacgctggtacaagggtctacgtaatacgacatcaagcagacaaaagacgaagattatactggttcaggccccttgataggtaatagccctaatccagttgatgtgagattatatgatggaaaacacaggttacaaagggaacaatggaactcgatggatccgacgagatcgtagtcgagttggttcgactagatcctcggcgatttggctcctgcaggctccgacttcgtaggctgtgggggttgtattggctctgagattcgatgccttaggtcctctccggggggtcccttttatatcgcagatcaggcggtttcccagtagaactcggagacatcagaccttacacgatacattgacgacccagtcttgtccgagtagaactctttctatccgtaaactccgtgaaggatttccttaatgtatgcagagagtatccatatgcgcgtgggtatgccataccgatatgcgacgtatatcgaagggtagagggtgtacctaacccgtaaccctgacagtagcccccgacttctgcttaaatgaactcgtgtaaccattcgcgacttctcgtgtctaaggctgttgtcgttcccggtgtgaggaccgtagagacaggacgtagtcgagaacaccatgtgaagcccaacggtcacgagtgaatttaactgaagtccaaaaaactgccgcgcgtaacggacccagaaatttccggcggccatctctctcctttccttggaattcgcaccgtcggtagtgcgtctatttaaatggaattttggggatccattttgaatgtccgcctattgtgaaagagaacattcccgcctgcaagcgttctttgtcttctccgctcccacaagaaaccctagctcgtcaacctccaccctttctccggcgatctccgatcggcgatggatctcggcaaatcatcctccaccagcgcgtcgctgaagaagcttcaggaggacggcgcccttcctggtcgtggaaccatggaaagggaagcaggaggtactgaaccccagcccgtcttaggtcgcatggttgcgatcgaggactacgttctctgcggttttctccctccaccttccgaatttcttctcttggttttgaacttctatggtctttctttgctccatctgaaccccgattctatagccttccttagtatttttttacatctttgtgaggcctacattggggtagagccctttctcgatctcttccgcttctactacgagttgcgttggatgtaatccaacagggtatcaggatgcgttggattccgacttcgggatggcctgaagtcgcgttatatccccttccagtgtccctcctctcgcagcaaatggcggacgaggtggttctatcttcagatagaagattcggaccctgtcttcgttgttcctgaggaacaaccagacaagattttgtcttggaccgcaaaaccccctttgaccccttctcttcagttgtttatcgatgtcgtcgtcgatctccgagtgcgaggtttgtcggggtatgaagtcgctgctaacttcattggtagacggatccagccgctccaggctcgggcccacccagcctttgactattctggaccagaggacgcgacccgggtttctcctcgggatatctttctcgcatttatcccgatatgcttgtgtgcgcgttcctcctggctcatcgaaacttggttctcgattcacaggtctgagcagcgaagctatgggacgtcgtgtcagctaggtgatgatcagtggcccgacgacggcgagtgatgtccccgttcccctttgcgaaaagggggcggccgaacgcgatgccgccatcaatgtaagtgtactcagtagtcattccgcgtttttcttccgagatcgctttgtgactttatgaagcgtaggctcttcctctgactgacatcatcgggctgctcgtggaccatcaggtggaggcgtcactgaaagagaaagtcgccaaggaggcatccgatgctgctgcgctgctgctaccacaagtggtggcaatgttcccacaaaggagaggaagttctcctctgtaagcggacatcgtcgcaaggcatctgtcccctcggtaagctatcctgttgtctgatcatacagccagaacaatttcgccttacttcgcatcaaccgttctccaggcctcggacgcgtctcccccgcctccatgacgacaacaacttgtgacacttggcgagaagtaagtggatgaatttaagttttcgcgattttgttcgagcgttgtctgagccatggctgtctcatagggcggcgcgggtgaaggcagtgcaggacgagtccagagggacttccggcgcgtctcccgctgtagcctcgacggatgtcgtgcttgcgcccgggagccgcgaggtgacaccaagcggcccagccagcgatcccgcggctggtcgtggtccaccggctgccgtcctcacctgggaggagctccaggtcgagatggggcgtctcctcaaagctggtgctcgcggcattggtcgcgagatttccgaggcgaggtcggcagcggcgtcggcaaacgagcgtgccgaccggctggcacatgagctggcggaagctcgtgaagacctcaagaagatgagggaattggtggccggcaacgagcgacaacggcagaggctcgagcaccgcatgtcggagctcgggaacaatttgtcggaaatccgtggctcgttgcgggtcacctacactggtctgcaccagctcgtcggggagtgcggcattaagtctaccatcccggcgaatctcgatgatttcttgctgacatcttctctagcggagctggcggcggcgatggaggagattccctccaagcatgcggtcaagatcggagaggagacgtccaacgggatctacaccggggcgtgccacgtccttgcgtgtgtgaggctggcgcatcctgaactcgatctgcgcgagatcttggatcagggggcggctagcgatacgcgtaaggaggtgatggaagaagtcaacgatctgggggaatctgttctcccaggttttgaagagtaggatctcttgtatcccttagacatgctgtgtaaaactttaatagatttcaaccgcctttgtgcgtgcagtcattatcctagctttctcttgcattttgatcttgagtactctttgtcccttgtagagatgttgatgacgaggatgtccagcagcgcgggcagcctgagtcaccggcgatcattccggctctcgcgtttgaaccacatgcgtcgctagacaatatagactagatcctagctacgaggacggagacggcgacgacttctttaggttagtggtccccttgtcccttttttgctcctccgactagatcggccgtgttctcgaaagagaagtgaagcttgactaagttattcccacattgaacagatcttgagggtgctcttgctgggcaagatcgtcgtatccaatattggaagacgaagtttgaagtagcggaactcgagaggacaatgctggcagtaaagaaggagcaagctgtggaaacgctccgaggtcgtgaggtgtggttcaactcgtacttgaagagttgctacacatccatggccaaggtctgtagagagctccgagtaccccgtggggatcccgaagagttggcggccggatatatctcgtggctgaacggggcctgtgctcagcttgaaggcgtcggcaagcgcatcgacgaagccttgaagcaggagtgtcgtcgatcgagccgatatgccggagggcacgtgttggcctgcatacgagaccatcgcccgcgactggacctcgattttctccgtgaaggttttgctcgttctcggaggactccggcggagatagaccacctggcgaagtcgatggtgtcgttggcggagaaggtcttacaatctatggactggcgttggccttcttggtagtctttgtatcctgcgattgtcatcttagggaaaagtgtaatatagccttagacttgtaaaaattgtaaggagtattttgtgaaatggaaaagaaatctatcttaacagatctttcttactctggatatcgtgtgtcagagtgtgttctcagttcacgactttagtcggtcgtttgagtcgcacactctccctagcccccagccttgtcgtcggagaaattttctcggaggataaggctcttggacctttggcctgccttggttgaataagcactgatcctagcccccagccatgaagttggaaagttagtttccgattacacggcttggttaatacgtacggcgagaactcttacacgaccaggtcttacatggtctttcgtctctacaggatctgacaaggccttatcggctctgggcgtccccagccgaagatcccttaggttcctcggaggccttgtcaagacggcgtaaagggacatgaggataggtttcaacgctaggtgtcatctgggtaagggatcatcgggcaagaacactttgattgtaatatggacctaggaataggctttattgatgttgtaaggtgtcttacaggtatggatgatattgactcatacatagaatttacgtagttggtcaatgtttcaacaatttgccaactcgcgaccatcaccatctgcaattttgaatgcgcctggccgcaagacttgtgtgatcatgtaaggtccttcccatttgggtgagagcttgtttcgccctgcttggctttgaacccgtcggaggacgtagtcgccgatcgaaagtatgcgtgctcggatgcgcttctcgtggtaacggcggagggcctgttggtaattggctgctcggacggcaactcgttcgcgatgttcctcgagtagattcacatcgacgtttcgctgctcctcctgatcctcgttggaatacttctgtactcgtgtactctgatgtcgtagctcgctagggagcatggcctcggagccgtacacgaggaagaagggtgtttccttgctagacgttgttggtgtggtgcgtacggcccatagtactgatgggagttcttcgaccaattttttatcatgtgacatgagcctgtcgtagacgtgggttttgatcccttgtagtactatgccgtttgccctttcgacttgtccgttgctttgagggtgagagaccgaggtgaagcatatcttgactcccagcccgatgcagtaatcctggaaatcggcgctgatgaactgagagccgttgtcggttatgatgcggtgcggtagtccgtatctgcagaatatccccttgatgaatttgatggcgttgtcggccttgatttcccccgtgggtactgctttgatccacttagtgaatttgtctatcaccacgaataggaacctgtagccgccctgtcctcgtgggaatggcccgagtatatcttacccccagcacgagaacggccaagtaagagggatagtctggagcgcttgcgcgggtagctttgtgtgcttactgtggaattgacaggcttcacatcgctggaccatgtcgcatgcatctttgagggcggttggcaaaaaaaacccttgtcgaaaagctttcctgaccaatgtccgaccagtggcgtgtgacccacagatgccttcatgtatatcaaggaggaggtgtttgccatcatcggacgagacgcatttgagaagtaccccgtttggcgctttcttgtatagatcgttgccgaccatacagtagatttttgctttacgggttattttctcggcctctatatcgtcctcgggcaactcctcgctgttgataaatttgattagtgggatgcgccagtcatctatggtcttgatatcggcaacgacgtgttctgcctttgtggcctccgagctaatgtcgggggcggctgggctaacttcgccgctaacctcttttactaatggcttcgtcaggatgtctagaaaagtgccgggctcgagcggttctcgtctggacgcacgtcgtgctagttcatctggctcgatgttgtccttgcggtagacgtgtcggacctcgatcccatcgaaccttttctctagcttcctgacttctgcgagatacttggataactcggggttagagcatttataatctttgtgcacgtggttcgcgactagctcggagtcccctttcatgattagtcgcttaaccccaagtgcagctgcagctcttatcccggcgagtagtccctcgtattcggctgtgttattggtcgccctgaagttgaggtggattgcgtgcttgaattgatctccggaaggagacgtcaagataaatcctgctcctgctccttggctgttgagtgcaccatcgaacgccattgtccatgtttcgttgtcgatttggttgtctgatttgttatcgggcatagtccaatcggctactgtcggtgacaagggaccgggggtatcttgactagaggtttggggcagctgcagtcacccacgtggcctgaccccctcgggggggtcgggcccgagggtgatgtggccgcccctccctctgtctccccgaggggtcaggccgctcccgtttcggccccaagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgtgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccgatgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccacttaagaaggggggagctcgggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacttcgccgcccacgagcgatgaagaaggacggcgagacggagagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgctgccaaggtctctggcgctgctaccgccggctccgtgtcgtcgaggcggagggcgcggcgagcggcggccgttacccgccgttcgtctgccattccctcgtcaatgcctccgacccaagaagatgtgcgtagggggccggatgcccgcctcagtatcgagcgccggcgcaatggtcgtcgtgctgcccacgcaacagaaggcgcttcctcgtccggagcgccacttcggttcgggcgcgggggccagccccccgtgcccccgcttggtggtgtcggctgttgagcctttgtggcgagccttcggaacgtccgttggcccccaaggttccggcccaccatcaccgaaaaatatgacggaagcgtcaaccccgccgagtttctccaggtctacacgaccgggatcgaggccgccgggggtgacgacagggtcatggcgaatttcttccccatggccctgaagggacaggcgcggggttggctaatgaacttgccgcccgcgtcggtccactcttgggaggatttgtgccagcagttcaccatgaacttccaaggcacatatccgcgcccagttgaagaagcggacttgcatgcggtacagcgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcagagctttttcagctcgcggaccgtgtggctcgcaaggaggaggcctggacctggaactccaccggttccggtgtggcagcttcggccgcccccggatccgccgctcggtcagggcggcgggacaggaggaggaaaaagaggtcggcccattccgacgacgagggtcacgtcctcgccgtcgagggcgcttcgcgggccacccgaaaggggaggcctgcgagcgacaaaaaggaggccggcgctcccagcagggagcgcccgaccggcaagtggtgcgccgtgcacaacacctccctccatgacctcgcggactgccgcgcggtcaaaagtttggctgagcggacgaggaagtgggaggaggagaggaggcaggaacgccgtgagggcaaggccccggcggctccctccggcaaccggcgaagtgaggccaagcagaaggcccccgccgaggacatcgacgatggcgacgatgacctagggttccaggagcctggggccactatcgccatcgtcgatgggggagcgtgcgctcacgcttctcgtcagagcctcaaggccatgaagcgagagcttctggcagcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggtgcagccctcaacatcctttcccccgcagcctttgacgccatcaaggccccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatgacggcggtccactacacctacctccagatgaagatgccgggccccggtggccccatctctgtccatggcaacctcaaagtcgcgcttgcttgtatggagcagcgcgcggaccacctcgccgccgcgtccaagcccgagggtggcaacgagaggctcagtacctccgtcctagccgccccgaggcagcggatgatcacgtgcgacgaggtcccggtcaaggaggttgccctgggcgacggcccgtccaagaccacacgaatcggtggtcttctggacggcaaataggaagacgcgcttgtctccttcctgtgggcaaacgccgacgtcttcgcctggagaccggcggacatgcccggggtcctcagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgctttcattacccccataggaacttattgttatacgacaatgcctttcgggttaaagaatgcgggtcctacttttcaacgtactactcgaatttctttgggtagccagataggacgcaatgttgaggcctatgttgatgacttggttgtgaagacgcgcaaccaagagaccttactctcagatctagcggaaacttttgaaagtctccgctccgcccgcataaagctgaaccccgataagtgcgtgttcggcgtgcctgtgggcaagcttctcgggttcttggtctctgcccgaggcatcgaggccaaccccgagaagatacgagctatagagcggatgcgcccccccagcaagcttagggatgtgcagtgcgtcaccggctgcatggcgccctaagtcggttcatattgaggctgggagagaaggcactgcccctatttaagctcctcaaacgctccgggccgtttacctggacggaggaggctgagcgggccctcactcagttgaaggcgtacctcagttctcccccagtcctggtcgccccggagccagatgagccgttgctactctaccttgcggcaaccccgcaggtggtcagcgcggcgttggtcgtggagcgcgacgaggacaaccctcactccgcgcatccccaccctgcgtcgactcgacccgggagagagcaggcaggagaggcccccgagccgaacggcggcccgaggcccccgacggcctgagctggccctccgcctgcttgtccgacggtgccaggcgcccccgacccccaggatggccccggggccactgcgggaaggccgcgcctgtcgccctctgaccccgaggtcgtcgacacagaagccgagtgcgccccgcgtggcctctcggacgaagagcgccctggagatgcggcccctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttccaggctcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagcccctgagcccatctccgtccccgaggccagctcgggcccctcgcagctgcctcacaccgcctactgggtgatgcagttcgacggctccctatctcttcagggcgccggtgcgggggtcacgttgacctcgccaagcggagacgtcctcagatacctggtccgcctcgactttcgggcgaccaacaatatggcggagtatgagggactccttgcgggactcagagtggcagctggactggggatccgccgcctcctggtgttaggcgactcccagttggtcgttaaccaggtctgtaaggagtaccgatgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagttcccctagattgattgcttggatcactgaaatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggtgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacagataacggcacccagttcactagttgatgaggacatcaacaccatcgatacatccacgtccccccatgtacagcatgatggtcctattacccgcgctcgtgcacgttaactaaattatcaggtgagttctttcttgagttcatattcctcgtctttataccccggagatgcgtgcactcgtgttttactcaggaacgatggagaggatccaaagggaagaggattcgcgcggggtggattcagactgcagggcagcgccaacttctgacggccgccacgacttcatgcgaactccgatttgggcgtgcaagtacttcacggaaagcttatcaagtctactttcaaatggatccagccacatgtccatatctattctggagcggccgcaattgtcattttactcccgactattttctgtcgatggtgctgcgtcacctcttttggcccaatgggctgtgtatccaagttgggcccattaggggcgcgtcctagggttggagcacgaccctatggtcgttcttccccctctttttatacctctagtcaccgccaagaacaggcgggttttgatgatagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccctagcgggttcgcatcaggtggtatcagagcgtggttcatcggtgagagaatttacccttcccttcgtcattaattttttttcctatagcccagaaaagaccaaaaaaaatagtagattagttttcccgtgatcctatagaccattgtgactttttactagtactgcttagttaaggcttgttgagttttcgattgcatcggttgtgttaatttgctggtcttagtgttaagcgattagagtttcgagttcttgccaccaccgcacatcgccaccttcatcaattttgccgtcatcaccaccgtcaccaccatcgcagtcacccaccaaatcactttctatttgtatttgatctgctgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcggcaaatttaaaatcgccaaattcctcttgcaaaattctgtttttgtggcgagaagcttcgggacctattcgcatagaactttgaaaaaaattctacaagcttcatactttgtccgtttgagataagattttctgtggttggttctagtgtgctcctggttgtgaaaaaaatatcaaaagaaaaaaaaagttgtgtctctctcctcagcactagagagagcaagcaaaaaaaaaaaaggatccagcgagcacaccccaccattccccctttgtcaccaccttccaccaccggttcttgttttcgttgctgtttgggtttgtgttttgtggcgtcctttgtggttaggctcgcgtctctacttcaactagcctaggaccagcactgtacactatacccttgagcgattattcaatttgctttggctaacgtggtttctagttttctcttgagcattgctttcagcccaccaacagctccactacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtgaagtgagagtgagcgtcttgcaaaagctacatcccaatagttgtgtagggtttacattacatcctccattgttttgttgtccttcatttctaaaccatggcaggtctagaggataaagatgaggagggtgcatctcattccccacgcaccaaaggcatcatccaatactttacaaggcaagtgaagcagcacacagaaggacttgatacagatttgcaggtgacaaatgagaagattggacaattggagtccacgcagatctccaccaacactaagcttacagggctggagatagcggtcgcccgcattgacactagccttgctgctcttgtgaggcattttgatgctctcaatgctggaggcaatggtgggggtaatgatgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaaaattcctccttttgatggaaaatatgatcctgatgcgtacctctcttgggagattgctgttgaccaaaaatttgcatgccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcgtagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccggccgtactacttctccatcttccacacccacaaccagtcgagcagcacctcctccatctggtgacaagtcagcgataaaggctgctcagccagcaccgagtgcttcttcaatggcatccacaggccgaatgagagatgttcagtgccaccgttgcaagggctttgggcatgtgcagcgtgactgccctagcaagcgagttttggtagtaaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggcgaaggtaacaaatttggtgcacattaattttgcaattggaaattaccatgatgttgttgaatgtgatgttttgcccatgcaagcttgtaatattctgctaggtagaccatggcaatttgatagggattctatgcatcatggtaggtcaaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccagatgcttacttgctactaaatctgatattaatgagttgattgcatcaccttcagttgcctatgctttggtatgcaaagatgctttgatttcacttcacgatatgtagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaatcgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacagcatttaaaacaaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaaacatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgactcatgcacctctcctccaacttcccgattttaataagacttttgaacttgaatgtgatgctagtgggattggattgggtggtgttttgctacaagaaggaaaacctgttgcatattttagtgaaaagttgactgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcctgttgttgttgcaggaagcgcatggaggcggtttgatgggacattttggcgccaagaagacacatgacatccttgctagtcatttcttttagccacagatgcgaagagatgttggcaggttcgttgctcgctgcgctacatgtcaaaaggctaagtcacgcttacatccacatggtttgtatatgcctcttcctgttcctactgttccttgggaagatatttcaatggactttgtgttaggattgcctaggaccaagagggggcgtgatagcatttttgtggttgtggatagattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccttttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagattttggggttagttccacatttaacgttgcagatttgaagccgtatttgggagaagaagatgagcttgagtcgaggacgactcaaatgcaagaaggggaggatgatgaggacatcaacaccatcgatacatccacgtccccccatgtacagcatgatggtcctattacccgcgctcgtgcatgttaactaaattatcaggtgagttctttcttgagttcatattcctcgtctttataccccggagatgcgtgcactcgtgttttactcaggaacgatggagaggatccaaagggaagagaattcgcgcggggtggattcggactgcagggcagcgccaacttctgacggccgccacgacttcatgcgaactccgatttgggcgtgcaagtacttcacggaaagcttatcaagtctctttcaaatggatccagccacatgtccatatctgttctggagcggccgcaattgtcattttactcccgactattttctgtcgatggtgctgcgtcacctcttttggcccaatgggctgtgtatccaagttgggcccattaggggcgcgtcctagggttggagcatgaccctatggtcgttcttccccctctttttatacctctagtcaccgccaagaacaggcgggttttgatgatagagatagcttcttgctaccagctcgcagcgcgcgtgttggctaaaccgcccgtctgcctgtaatcggaaccccaccatattgagtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgtcttcatctaatcgagttatcccttacctctcatcgaaagatcgggccacaaaccctagcgggttcgcatcactagtgagctcttcggtgactactgcgaagacatgggcatcaagctctgcttcgcctcccccgcccaccccagaagcaatggccaagtggagcgcgccaacgcggaaatcctcaagggcctcaaaaccaaaaccttcaacatcctcaagaagcacggcgactcgtggatcgaggagttgccagcggtgctttgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcgctaacagcagagcctgtggcgctaccatcagcgtcacatccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgcctaatccatggaacatcgaacaccttcatcgcttctacccctagtgggggtcgggtgtcaggtctcgggctcgggccaaccccgcgcccccccgggcgtgcagggttggccgggggctaccacatgcatatccttatcttttttctcttccgtatttcagtaaaagcattttcgatttcctgaggattgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcaaaggaccacaatcgggtcatccataaccctcggtcaccacgctcccggcctggccagtctcgacacgcggatctccctaggcactagccccgacccgcgccacttgaggttgggacctgggcacgaccctcgttcaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggccgtaccctcgaagctgtggacgatgtggtcggcggcgtcccggaccctcgcacgtgcgccatcctcggttccgggagggaactcttccagcgctgcccacggggagaagtcagggtccctggcctggtagcttgccagtgcgagctccaccgccccccgggcgaggtccctcgaggatgacttgatcgcctcctcgagctcctcggggagccgctggagggtcccggccatctctgagaggcgctgggcgatgcccccctggttggcggcgtatttcgcggtccgcccgccccagaggcccgcctgccgcccggcacggtctagacgggaaacggcgtcccgaagcatgccaagccctacctcgcccgccaagcggagggcttcgacctccccggcggacgagtccagcgcgccctgcagctcggtgatggtgtgttcggcggctgcgaggcgggcggctaggtcgccgtcgcccgcggccgccccgccgctgcgcgctctcgcgtctagctccttcgcccgcgcctcgaattcagcggcccgctgatccagtgcggccctctcggcgcgggcgccttccagattgaggcgcgcctgctcctcccaccgctgcgccgcggcctcggcctcctcgagagctcgctcccactcagtgagctcgtcctcgcggaggcggagtgcggactcctcttcggcgcaggcagcctcgtgcgccgccagcgttgcctcccggatggcgacggcggcctcgtgacccgccagttccctctccttcgtgtccagggcgcgggcgcggtcctccagcaccgtggcgcgagcctcaagggcctcttcgcgctgccgggacgcgtcgagcttcttctctagctccgccgcccggctcccgtattggaggcagaggtcgtcccgcgccacgttgaacacggcggtggcgatgagggcagtctcccgctcctcctccacctccctggcgatctccgccaggtccctacgacgggcctcgagctctgaggcgtgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggttctgcgctcagtggggcagcggaaggcagagaggagagccgcctcggtgtgggcgccgcgcggctcggcccgccgatggacgtgccggactcgggggcgttccccgaggctggctcgccccaagcatcgcccgaggggtcgggcccgagcggcgcgcccgcggcctcgtcgtgggcggcctcggaagtcgtcgtcgcctcgggcggagtcgggtcgggggcttggcaggccgcccggcgtacggacggactcctcggcccggcggagtctggcctcctcccaagcggcttcctcagcctggcgagcccggacggcctcctgggcagcttcttcggcttcccggaggcggtctgcggcttctcgccggtcagctccccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgagggggagatgaggtttccccggcatggttcggtcccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcatgtagtcctcgaacccggtgtactcccaggcgccccgggcgcgccgctggagcggcgcgatccggcgacgaaggtaatcgccgtacaccatggcccccgtgagcccctgggatcgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctagaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagattataaagctccagaacatccatgaagaaagaagagaatggcgggaccagccctgccattgtgaaggaaaggaagaatacggaccgccccgggtagtgtggtgccgggcgtccctcacccagtgcgaccacctcccggccggtggcagattccggcatgaatcggcgcggcagcccggcctgcctctcgctcacgatgcgagaaggtggcagcacgctaccgtcgagcggtgcggagccccgtgccatgacgccggcggaggaggggcttgagagcgagtgagtgcggcgaaggtagggcacaggaaacgagaagttagaacgcaagcggcgaaggcaaggggaataatggcgagaggaaggaaacgaatctcttcctcggcgtctttatacccttaccaacgctatgcccggctcctcgcttcccgcgcccactatctcgccccctcgtttctcgcgcccactcctccaataatcccgctcgcccgtttgcggcgcacgaggcggatgtgcggccgtggcagtcgagatggcacatatcgtgcgcgcgttaactacgctcgccgaccgatgcaccatcatcacatctccaggcgaaacgaaccggctcgtcccaattcgcgcgctactcaagtaatgtagcggtcttgaagaaagccgctcattattatcggtcagtttttcccttgccgatgtgcgcgatttgcgaccactggattcctacccgcctgtagagaccggccccacctgtcaccaggcctaaggagtggcgtcatgcccgagcgctttcctcgaggagggcgatcgccctggcataacgccgggggctactgtcggtgacaagggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccaagggctggggtgccccgaccccctgtgggtttggcgccatgtgtgtggattaggtgagcacagcggcgctcacctaaccgcgtttattgcgggttagacgagcgccccacgccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagccggagccgtcgtgctgactcctggagttagcacgtcagtcccggcatattcataccaggcttcatcgcaac

SEQ ID NO: 43067 - DNA, 16834 bp, Oryza sativa
  unsure (1)..(16834): unsure at all n locations
gcgcaagccagttttttcttttttgggaagatagggtgagtccccacccaaaagaagagtaggtagaagtggtgcatgtgggatccccttgagatataaaaggaggaccttgcccacttaagaaggggggagctcgggaaagaggggggagaagacctgagctcgtagaggagagaaagaggaagagggtttctagagtttaaactctcttgctctccagctctttgtaactctttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaacaggcaaaggggggcccgcgcggtctcccggtgaggagccccacgctccgtcagcgacgaagtcggcgagtacctgggacttgatggctgttcgtggcacaaagtggatatcaaactggctgagctcgactacccatttcgcgatgcggccgacaatgtctctgtttttcacaacttcaccaagagggaaggaggagactactgtgactctgtgggcttgaaagtagtggcgtagcttccttgatgtcatgatgaccgcgtaaagcagcttttggatctgtggatatcttgtctttgcgtcgtggagagcttcgctgacgtaatagactcgtcgttgtactttctctctctcgacaacaatgacggtgttaacggaatatggagtggcggcaatatagaggaataattcttcattaggttggggagcaacaagtacaggggggtttgataggtagcgcttgagtgcaacgaatgcctcttcggcttcctgtgtccatacaaatttgtcttgtttcttcagtagagcgaagaaatgttgccctcgttctcccatcctagcaacaaacctgctcagtgctgccatgcatctggttagcttttgtacttccttgagtcttgtggccgacttcatgttctcgattgccttggtcttctcaagatttgcttctattcctctgccagagacaaggaatccgagcagcttgcccgacggtactccgaacgtgcacttctctggattgagcatgaggcgatatcgtcggaggttgtcgaacgtttcccgcagatcgtcaatcaatgagtcgcctgtcttggtcttgacaacgatgttgtcaacgtatgcctcgacattgttgccgagctggtcgctaagtgcgccctggaccatgcgctggaaagtattccctgcgattatcagtccgaacggcatcttaacattgcaaaataccccgaacggcgtgatgaatgttgtcttctcttcgtcctcttttgccatgctgatttggtggtagccagagtaagcgtcgagaaagcttaacagctcacagccggctgttgagtccaccagttgatctattcgaggaagagggaagtgatccttgggacaagccttgttgaggtcggtgaagtcgacgcacattctccatttcccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgtgctcaatcacctccttggggacccccggcatgtcggacggctgccaagcgaacacgtcagcattgtcgcggaggaaggtgatgagcgtgagttcctatttctcgcttagtgttgccccgatcttgacggtcttgtcggggttagcactggagagtggaacgatcttgattgcgccgtccggtttcggcgtcttgtttgtcttgctcactttcttgggtggctcactcgtggcgggtgggctgggcgtttgctcgaccatgtcaaggctccgtttgtcgcattgcaccgccagctttgcgttcccttgaatagtgattgttccattcggtcccggcatcttgagcacttgatacgcgtagtgagatgcggccataaacttcgcaagtgcagttctcccgatgatggcgttgtaagctgtattgaattcagcgacatcaaaggtgatctgctccgttcggaagttgttagcttggccgaaagtcacaggcaacgtaatcttgcccaatggtctggacgagaactggggagtaattccatgaaagggttgatcggtcggtgtcaactcgctttgcggaattcccatcgcgtccaaagtgctgggcgaaaagaaggttgattgagctgccaccatggatgagaacccgcgcgaccttgatgttccgaatagtgggttcgaccacgatcggatatcgtcctgggatgacggcagtcttggggtggtcttcttccgaaaattctatcttctgttcagaccacttcatcttgggtgcagccccctgccatgtcgaacagacttcgcgttccactttcttgtattcttgctttgaggagtatgttgtggaacctccgaagatgtgtgaaacgtggaggtcagagtctggatatgctgagtctgattcctggggagccgcctccgcatccttttcaaccacgcgtactcgcttgcctttttcaaatgcaatgtgcttctcgagcgactttttgaaaacaaggcaatctttcaaagaatgtttgtccgtcttgtgtatggggcaccatgctttctttgcgtcgctaccttgtgggtctgggcgcttgggagggttcgcgtattctgctgcgaggacttccgcttgagctttccttttcccattttgcgatttttcttcttgcttgactcaggtgcatccgtggctggtttcttctctcccccgatctttggcttatcgtttttgcgtcttagcgcatcatctgcatgggcgcatcgctcaacaatctcgaacaatctcggagtagctgtgatgcgtcttgttgccaactcctgggtagtatagcgatctctgacaccggacttgaaggcgcgaattacagaagcgtcggtgatttcggggactgtatttctgcactcgttgaagtgccgaacatattccctcaaggattcacccgagttctgtgtcaacgcgtgtaggtcgtcttcgatcgcgtggcgcttgtaggttccttggaagttggtgacgaactgctgccacaggtctgcccacgaagagattgagtagggcgggagatgtatcagccatgaacgtgcagagccttttaacgcagttggctaataattcaccagtgcgttgtcgtctgctccggcagcgtagagtactgtggagtagacttgaaggaactcttctgggtcggtgctcccatcatacttttctattgctccgggtcggaatctctcaggccatcggacatcacgtagggaacgactgaaaactctacacccagcgctaggggcggtgggttgtcggcgatcgtgtgtccttcgtagatgtctgtctgatgatgaggaagacgaggatgatgacgatgacgatgggccgcttggttccggcgtacgattacgaggatgtcggcctggctctcgagaatcctgtcgtcgtctcccactgttgtctcggcgccggtctccatcatcgtcgtcattatggcgacgtcgttgaccagtatcgcctggcatccgccgttcgcgatcgttgtgatcgtggcggttgtggcggttatcacggtctcggtcttcgtttgaacggtctcctcgatcttcgttatcatgacgccgggaacgtttctcattgtcccgtgtgcgtcgtgcctctcggcggccgttgaggtgatcgcggagatcgccggtgccgcgaggtggaggggtggctcgatgaggtgattccctccgttcagggttttcaccattggcatcgccagttggtggctgctctgggtgcgctgcggcagcggcctcttcgaacgcgttgctgaggttggtcactgattcccgtagtcgttctgtccaatgcgcgagatcgtcattcagaacgagatcgtagggggtttccctcagtatagtgttgacggctctgatgtgttgggccggagtggccacttgattctccgcttctgcattggtgcgcgctgacgtgccgacatcatcgatagccaatacctcccgcggcgcgctcgttgtcgatgatccatagtcttcgaggaggtgcaagactgatggttcgtggggatcgacgtcgattaccccaacaaatcaatctgaagttggcgtcgctcctcgttccttgtctttatccctgatggggatgtgtgactgttagaccttaggagatggcgctttcatggcgctaagaaagaccttgcagcttgagaggtcgtgattctttgtcttgtgaataggacaatagacatcacgggttggagaaatacgctgaattccacgctctttgcaggcgtgaatttcagcgcggacgttgagaaaaacccagcaggcttgcaaagtgtgtttcctggttttgtggataggacaccagaaccttgtcgcttcggaagtcatccttgtcggctcgtggttcttgtcggaatgacaaggtttagccgcattagaatccttctcgagcttgtatgtcgtcgatgttccgttctccgcctcggcgggaggatctttcgacatggggtcgtcttggtttgtagccactgcgttctcgtttccggtcattgatggaccggctgagattagcatcatggtgtaaactgggaagacgatttcaccgacttgagtccacaccagcattgttgaagcagggaatacttggttgaggttggtgttgacgctgttgtcgacgaagctggatgacatagtagtagaaccttgagcaccaagtccccctacctggcgcgccactgtcgacgggtgatacccgtagaccggatatagagagtattagggtacgctggtacaagggtctacgtaatacgacatcaagcagacaaaagacaaagattatactgattcaggccccttgataggtaatagccctaatccagttgatgtgggattatatgatggaaaacacaggttacaaagggaacaatggaactcgatagatccggcgagatcgtagtcgagttggttcgactagatccccggcgatttggctcctgcaggctccgacttcgtaggctgtgggggttgtattggctctgagattcaatgccttaggtcctccccggggggtcccttttatatcgcaggtcaggcggtttcccagtagaactcggagacatcagaccttacacgatacattgacaacccagtcttgtccgagtagaactctttctatccgtaaactccgtgaaggatttccttaatgtatgcagagagtatccgtatgcgcgtgggtatgccataccgatatgcgacgtatatcgaagggtagagggtatacctaacccgtaaccctgacaatttccttagcggttttgagagtgtttttcgctgacgtggcttattgacttggtctaagcaactgagtcattagctggtcagccaaacacggtgcgcgtgttggtcaacatcgctgctgctgccccctgtcatggcgctctagctgcaagatatcggggaccccacccgcctcgtcgcctccctctccgtgcacccgctgctccgtgcgtagactagctggggcgtgcggcagagcaagcgagaatgtgcaaagccgcaaaaaagagcgtagagagagggacgaaagaaagaagagaggaggcaatgacatacagggtgtgtttggataatgggaaatggggggtgggattaggattaggaaatgaatgaagggttaggattaaatgaaagaaggagaatgaatggttaggatttaaagttgtctttttgtgggtgggaaatcatttccatttcccattagccaaacattgccataggccttactcgctgactcagctgcatggaccaagtcaacaaactatatcagcgaaaatcactctcaaaaccgtcggcgacaaactgcaccggttttaatagctcgaggatgaacatatatggtattccgattgaggggtatcaatcaggctggaggcacatttaagggagccattatggacttactccactagcatactacaccttatgagccaaatgggccaagaggccaaaaaagaagcccattacggatagcacgaaagctagggtttacgacctcccaaatcccccccgccgccacgaggtataaaggcgaaccctgacccgccgccgcccgctgctctcgccctctccgcaccagctccccgccgccgccgccgcgagctgatccaatggcgccgacgtcgaagctgtcgcagggcatcaagaaggcgtcgcggtcgcacacgtaccaccgccgcgggctgtgggccatcaaggccaagcacggcggcgccttccccaaggccgagaagcccgccgccgcagccgccgccgccgcgcccaagttctaccccgccgacgacgtcaagccccgccagcccagcacccgcaagcccaaccctaccaagctcaggtctccgagcagcagcaacttgcccgagttctctctgttccggttcattttgctgatgaggtggttcgattgcttgctgaccgctttgcggatgcaggtcgtccatcacgcctgggacagtgctgatcctgctcgccgggaggttcatggggaagcgcgtcgtgttcctcaagcagctcaaatccggcctgcttctcgtcaccggtaagccaacgttgattgtgtgacacaatatagtttaagaatcaaaatctgttagattggtataccacagtatagtttcgtacgcactgaatctgtgatgaatggtcatttgactagttgttatcgtgtaacattgatatatttgtgatgaaaataactggtctccttgattagcttcggtattaatctcttggcagtcatttacagtagcagtgtagattgtgccttcgattagcacggtaatttttgggataaatgtttgctgaaggtttggagatggttataagtaaaaaatgtggggctatggtcattggtatagcactactaggtgaagttaggtttaggcaagtgtcacacatattagcagaaatggtttgaaatgtttggttgaaataatgagtttctctgtaacataccagaccgtataattttatccaaggcagattttttggtctgttgaccttttattgtagttataataatcatatggttcaatttcttagaaaacatttaagatggactggtaattgtctttttaccaacaatcttaatgaaagttattttagaacactctaatactttcattgtagggttaagaatgccatgcaaacagttgctagcatcgtaatagtgctatttcatcgtagctttcatagaaatgtcctttgtgctggattccttttcttcccatggacagcatgtggcgttttcgtgcacacagtgttcatctgcaatagaattgcaatgatgttgaagttacctctgagatatggtgacgttttgcataaatttagcatgcatgtgtattatacagttcaattttcatatgttaattcagcttggtagtttttatctgctctaccccttcattctgttgtatatgcaataagtttgcccaatgtttctttgtatagaaccaagttgtgcaaaacgcaactggcttgatgtgaatttgtattgtcaaggatttatatctttttgagttctatattgcattcagacactcatgatcacaataacgttggacttacaatccatccctttcaggaccttttaagatcaatggagttccgatccgccgtgtgaaccagccctacgtcattgctacgtccacaaaggttgatatctctggtgttaatgtggagaagtttgatgacaagtacttctctagggacaagaagcagaaggcgaagaagaccgagggtgaactttttgagactgagaaggaggtaaatgttttatataatctgaaaacttctgatcattgtatattttgatattgcggtctgttcttattatgcgattcatctattcttttaggcaaccaagaacctgccggagttcaaaaaggaggaccagaaagttgtggatgccgagttgatcaaagctattgaagctgtcccggatctgaaaacttaccttggtgcgcggttttctctcagggacggcgacaagccccacgagatggttttctagattagttggcgctaggctctagttctgaagccactttgcctgttcaacctcagtgcgctcttgaattttgtatctgactggtgaaccattcgtttccattagtatctgtctgtcaaatcttacctgaagtcttatacactttgctgggttcaatttagtgatgttctgcatcatacattcatactatacacataagccattttgccactgaagtcttctgctttgtgtttctgcattctatcaaggcatccaatttaatgtgtctccaaaatattgggacttaaggtgttgctcacttgccttccaaaatactgggacttgaggtgttgctcacttgcaatctggaataattttgggacttgaggtgagaggtgttgctcacttgcaatctggaataattttgggacttgaggtgttgttcaaaagacgggtataggcttttatcttaagaaattgtcattccttttatctctagagtcaatagaagagcttccctattagtacttgtttatagactggacaggcgtctgccccataaaatagagataaaatgattaccagaggctcattcatcgaaaattatagagacaggaaaagaaaaatgaatttctatcaaatcaactgcaagatgttctccatcttgcgaattcctactttgtttgaagtatattactttgcttatctatatctatagattacctaaatctaaatcgatctacgttctgaaatagagttctttatttttatagaattactcctcattaggctgcatacattactcatcctatcttaattaggctctaattcgtagtattttcgcttttattcctttttctagagattctagagaaaatgagacaaagtgaagcgagagagttttgtttctataagaattatgtctccaccatacctaaatagaaaggaaatcaaaaagaaagggagtcgggattctattggatgaatctttaaagaagacgtggcaaagaggaaacaaaggctaaactaagccctttggtttgagaaaaaccgatccttgtttcaccaaggaaaagagagaaattctgtataaattgacaatgctgacttgaattgactaattcagttccgcctattccacattaatgggagtacatttatgtttctgcttcacgaatatgatattttttgggcatttctaataatagcaagccttatttctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtcgaaacggtctttctctacctttgggcaatgagtttcgacgtattgggtatatccgtttttatcgaagctttcatttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataatttggatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatattcccttaaaaaataggctttcttggaaataggaatcatggaataatcctgaattccaatgtttatttctatagtataagaaaaactaattgaatcaaattcatggatttaccacgacctcggcagtgaccccatagataaaaatgcaaaatttctatcttcgagaccattgaaaaaaggcattgaacgagaaaaaatcgtccacaaataatctatcgtatgccttggaagtgatataaggtgctcggaaatggttgaagtaattgaataggaggatcactatgactatagcccttggtagagttactaaagaagaaaatgatttatttgatattatggacgactagttacgaagggaccgttttgtttttgtaggatggtctagcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactcttttgctactatggggcccggaagcacaaggggattttactcgttggtgtcaattaggtggtctgtggacttttgttgctctccatggggcttttgcactaataggtttcatgttatgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcggctatctaattcttatgtcgaataatgaaattatcattttcgaattgtatatacgaattcttaatgctaattatcaatctcgattcatttcaatatcgggacaagaattgaaccaattgaattaattagaatagagcaattacacaacaaaagagaaaagaaggtatttgttggcagtagatgggttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagacccctcgcaaaagggggtcgcagtgaccaggcccgggcgactgtttaccaaaacacaggtctccgcaaagtcgtaagaccatgtatgggggctgatgcctgcccagtgccggaaggtcaaggaagttggtgaactgatgacagggaagccgacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttcagtggtttagtatggaacattgtcttttccaagtaaaaacccctagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacaaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatggaattggatccattccaaatagcgagaattaggattctggatccctctcaatctctctttcaattcgaggatccagagaggtgttttcatagtcatctccgaatatttgccatctctgaatattttcgatttcatttttctatgatatgtctttctatatgaaaattggttatttacgatgtacgatgatccctgttaagcatccatggctgaatggttaaagcgcccaactcataattggtaaatttgcaggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctatgaatagccatcgactacccggaaagggtagaagaatgggccctattctaggacatacaatgcattacagacgtatgatcattacccttcaaccgggttattctattccacttctagatagagaaaaaagctaaaggagaatacttaataatatgacgaaacatttatacaaaacacctatcccgagcacatgcaagggaaccatagataggcaagtgaaatccaatccacgaaataatttgatccatggacggcaccgttgtggtaaaggtcgtaattccagaggaatcattaccgcaggcatagagggggaggtcataagcgcctataccgtaaaatcgattttcgacggaatcaaaaagacatatctggtagaatcgtaacaatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacaacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcggtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggtagatttggattcctttcctatatatccactcatgtggtacttcattatatgattcatataagatctatctgtctagagatcatcatatacatctagaaagccgtatgctttggaagaagcttgtacagtttgggaaggggttttttgagagaaaagaagaatctacttcaaccgatatgcccttaggcacggccatacataacatagaaatcacacgtagaaggggtgggcaattagctagagcagcaggtgctgtagcgaaactgattgcaaaagatggtaaatcggccactttaagattactatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacaatgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaatgaatccttttgtagctcatcatttattggcaaaaatagaaaaggtcaatatgaaggaggagaaagaaacaatagtaacgtggtcccgagcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaagaaatacccagcaagatattgggtatttctagccttcctttcttcaaaaattgctatatgttagcagaaaagccttatccattaagagatggaacttcaagagcagctaggtctagagggaagttgtgagcattacgttcgtgcattacttccataccaagattagcacggttgatgatattagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaatgagagttgttaaaactagcatattggaagattaatcggccaaaataaccatgagcggccacaatattataagtctcttcctcttgaccaaatctataaccctcattagcagattcgttttcagtggtttccctgatcaaactagaggttacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctacttgtcgcgtcccaaaatgactctaaaatacatcctcgaaattatgcctagaataattaaaatccgtgtgaaagcctccaacaattaaaatgtgctaagttaaaagtcaaataaggcttggaggatttttgtatatttcctaaaagcctaaaatacgtaaataaattttagtggaattttcagagcacaaataataattaagaagaaataaacaaagttaaaaaggttttataaaaagaaaaaccctaaaaagtcctttccccccccctccccctcttgggccggctcggcccatctctctccctctctctcctctcccccgcggcccatccggcctctccctgcgcgcgcgccgctgacgggcgggcccgcccgccaccctcgctgacgggtggggcccacccgtcatccccttcctcccgcctctcctgccgcctcgcccgtgccctagcgccgccgccgccgcgaatcccgccgcctcccgccgtccacgcgcgcaataaagtggggggaaatattccccgtgattccctccctctttccccccatttttccctccctctctccctcggattcgtttggaaacctctcccctaacctcgccggcgccatcaatggcgaccggatcttccgcgcccgtttccccctcgtccggcagctccctccccctcccaatcctatataaaccttccccgtgcctccctccaccgtttccgccactcgccgccctctctccccgtcggaatcgagctcgcgccgtcgctcgctctctccgccgtcaccgccgagctccggtccgccgccgtcgtcgccccggaccacctccggcctcggcgtcgccaccttcggcttcaccgcatccccggcgacctcgtccacccctccgattagctcgccgaccgccggagcaccgtcgaccccgtccacccgagccgcgccgccgccttcctccgctccggtcgccgtttccgtcgtcgccgtcgacccggggtgag

SEQ ID NO: 43068 - DNA, 8092 bp, Oryza sativa
ccgccgtgcctatggccgtccgccggcgaccataggggcgcgggcgcgccgcctcccgccgctgcgccggcgtggccgccttcgggcgcaccgtgcggctgccgcgtggggcccggctgtcagccgcccgcaccctcgggtgcggctgacgcgtgggacccacggcgccggccggtgtgagcccgggtgcgcccggtccaccgtggaccgtggggctgccgcgtgggtcccacccccgtggacccggtccgcgcgcccctcccctcggctgacgcaataaatccattttaaattaaaatttaaatgaagaaattcgtaaatattcatttaaagagcatataaacttcaaatggccataacttggccatttgaactcggaattggaccgttcaagtctctaatttttctttaagaagtcaagaacccatttttgtgctttgttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccatgcctatttacatctgttatgaccttattattgttattgttattatttccttgttcaccctagaataaacaaaaccccaactagtggacactctactcatggtaccactagtatgattttaggtagatgcttcgctatttaattaggcaacattaggcggttttacaactctagactttgggatattcatatcacctggacactttggaattgttggagtattgtgaaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgctggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatattacaactcccttgtactcccttgcatttattatgcacttgtgggtgtgtcttgttgagtacggtggttgtactcagtcttgctcaatttttcccaaacccagaagaggagtctctggaagatgaaggttttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaactgtatcaacttttggtgtaccttgtctcctgggacaaggaataatgcacgcacgtaaggaacgcccgttgggttatttccggtcgtgacactactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctggggggagatcgagcttcaagaaattgtgaacggtcttatcaatacacaaatgtataactccccaggaatttcaattgcgcttatatccatcactgtaggacttgggttcaagctttccccagccccttttcatcaatggactcctaacgtctacgaaggagtgtggttcgttcgacaaattcctacctctatatctatctctgaggtgtttgggttttgcaaaactccatagatatgcagaagagaaatgctatccccactccaaccaagacagaacttttaccaaaagtttattgtgatctttttgttcaaataacaattaaggtgaagcagtgtcaggaacaacgaatctctttatgataaacagatccattttgcaagctcgttattacaggtagttcctacaaagaatcggactaatgacgtatacaatgcttgaattatcgacgtagatgctacatagtgggttctcatccttcaaagactacgagtgtaacaggagcatccgttgacaaaaggatcaccctaagatgatcatctcatggctattgggaacgaatcaaatcagatggttctatttctcaacctttctgacttgctcctatagaaccaaggtcgaaaggattgaaaaagtcagtcattcacaaccactaatgaaggattcctcgaaacgttaaggattagtagttctttttcgaaattgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaactaagaaataaccccttatgtgcgaaattatagaagatcccctttaagatcaaacaattccatcgaattgagtatgaatgtatgtgtgatagcatctactataccaggaatataattgaaccccattcttgcaattgctcaggataccctcttttagctgctaggtctatttcttagttcaagatccctcttactaactggaataaaagaattagtagatatattccgcccaaaatgggaatgggcgctagggtaatgaacttataatcatggaatcgactcgatcatcagattataagttcattccataccggaccagaccgtgaacattcttattatgagaaggggtcattcgagcctatggaaataggatactctgtttacatagaaatccccacgtccttacattctatttaggattaggaataggtgtaatcagacctacttttgacatatctatcctatccttatttgggtaccatatgcacctctttgggcttctattgaatcgagaaattggattgtacatctttttgattttgaaacatataaggtgtcctacggataatgcaaatcgaagctatttgatgtctgactcaggcctatatgaccgatcgatcaaaatactccaagactccacctttgtcatatattccatagccaaaatagactaaatatagcctaaacgatcctaaaaatccctcgaaggagataatataataaagaacccaaagcagacggtatcctactacaagggtggtcttaagaatccaaaagaggttactcagaagagatagatgtatcccaacctctattgctctcgcgtaaagcctttttttacgcgataggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagatatgagaaccatgaaaagcaagatcccgaataagaaaacagaaaccgaggaaaccacaagagtgaagactagtgtcaatagaatattactttgtatgggaaaactcttatattcgtcccgaaccgaattttcgctgggttgtttgtaagtaagctaagtaaatagtacatgatggagctcgagaggacataatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattgaaagtctatcagaatcaatcactcatattcgatttctatagaagagggaaatgctttatcgaaggaaataagaaaaaagggtatgttgctactcttttgaaagaaaaaagaataagaattcccgaagtaatgtttaaacccaaggatttcacaaatcaaagataaaggattcccgaacaagtaaacacgatttttaactgtctcaacaatagaattggaccggaataaggaataaaagtgaatttgttcgagatgaggcaaagaaaagagtttagagacgactcaaaaaatttcaaaggattttttttctttcaagtctgtcaatcaaaattagtcaacttgagtcatgagtataaatgaaatttgttttttctgtacagaaattaatgttcgaatctatgtttatctacatctatcccaataagctgtctatcgaatcgttgcaattgatgttcgatctcgaagagaaggaagagatcttcgaaaagtaggtttttatgatccgataaagaatcaaacttgtttaaatgttccagctattctctatttccttgaaaaaggtgctcaacctacaagaacagtttctgatattttaaggaaggcggaattctttaaagaaaaagaaagaactttgagttaattgaagaactaaatgaataaaaaactaggagaggctcactagtatcccttgttgtctaactatttagaaataatttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaatatcctagtttatctgggttgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattagcctgcaaaaataaaggatttgttctcttttgtaattagaacaaacataaacaaattggatagaaaaggagcggaaaaagatccatggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtttttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtagggatccgtagagagtccattttatgaaatatctgagaaagcaaagaaaaaaaaagagagacaggtggtttatttatcaccaaatagagatgagtattatatgatagcagcaggaaattctttgtccttgaatcggggtattcaggaagaacatgttgttccagctagataccatcaagaattcctgactattgcatgggaacagattcatgttagaagtatttttcctttccaatatttttctattgggggttctctcattccttttattgagcataatgatgcgaatcgagctttaatgagttctaatatacagcgccaagcagttccgctttctcggtccgagaagtgcattgttggaactggattggaacgccaaacagctctagattcgagggtttctattatagccgaacgcgagggaaagatcatttctactaatagtcacaagatccttttatcaagtaggagtgcgtctgtaggtggcttttcaagtccgccgtcaaatcccagggctcaaccctggacaggcggtggaaactaccaagctg

SEQ ID NO: 43069 - DNA, 18819 bp, Oryza sativa
aaattaagtggtatcaaagggctaaaactaaggatattttggagggtgattcaaatacaaagtatttgtcatgtggttgctaacggcaaacatagaaaaaccagaatttttcaacttcaagatggggatcaattgataaatggtgatgcaaatctaaaatcgcatattactacttattataaaggcctctttggtcctcctgatgattctgatctccagtttgatgaaaataattttgtggacatcccacaagtatctcaattagagaatgaagctttaatacaataattcactgaaaaggaaattaaagaggctattttccaaatagaacataataaagctccgggtcctgatggatttcctgctgagttttatcaggtcttttgggatgtcattaaggatgatatgttggatcttttcagagattttcataatggtacttttgcctttattctcccttaactttggtactattattcttttgcctaagtgtgctgaggccatgagaattcaacaatataggcctatctgcttacttaatgttagttttaagatctttaccaaagttgctacgaatagaataatgagtgttgctcaaaaggtgattagccctactcaaactgcttttatacctgggagaaatattatggaatgtgttgttattttgcatgaaactatgcatgaattacatcgcaaaaataaaagtgctgtgatttttaagatcgattttgaaaaagcctatgacaaggttaaatggtcttttgtacaacagatgctcagaatgaaaggtttctctcctaaatggtgtgagtggataacttcttttattcaagggggacatgttggtattagagtaaatgatcagaccggtaataattttcaaacttacaaaggtctaaggcaaggagatcctttatctccaattctttttaatatagtaacagatatgcttaccttattaattaagagggataaagatgttggttcattgaatggggtagtccctcacctagtggatgatggtttatctattttacagtatgcagatgataccatcatttttttggaacatgacttacaacaagcgaagaatcttaaattgattttatctgtgtttgaagagttgtctggcttgaaaacaaattttcataagagtgaattattttgttttggtcaggcaaaggaatattatgatgagtattctaacatctttggttgtaagtttggctctctccctgttaaatatcttggtataccaatgcatgttagaaaactgaataatagagattggaaaatgattgagaaaagaattgagaaaaaacttagttggaaaggaaaacatttatctgttgggggtagactggttttgattaactctgtactttcaagtttaactatgtttatgatatctttttttagatactgaaaggggttcttcaaaaaattgattattatagatcactattcttttggcaaggggataaccataaaaaaaagtatagacttactagatgggatatcatttgtcaacctaaggatcagggaggtttaggggttcataacttggaaatacaaaacaagtgtctcttgagtaagtggttgtttaagttgattaacgaggaaggtgtatggtaaaatctattgaagagagtatctctacaatcagtttataacccaagttaataagaaacagggtgattctcatttttggtcaggtctcatgaaggtcaaagatattttcttagatatggattcttggattgtaaataatgggaaacaaataaggttctgggaagataaatggctaggaaacctggcttttaaagacaaatatccatctttatactctattgtccgaaggaaaagttctactattgctaatgttatgagatctgttccactcaatgttttctttaggagatcattagttggtcagaatcttgcaaattggcatgaattgtgtgcttctattgtacatattcaattgaatcaatcctctgatagctttagatggaattatcatcagaatggaatattttctgttaggtcgatgtatctaactttaattaataatggttatattgagagaaacaagattatttggaagcttaagatgccacttaagattaagatttttatgtggtacttgcttaaaggggttgtgctaaccaaggataatttggcaagacgaaattggaatggcagtttaagatgatgttttttaatgaaaaatgagactattcaacatctttttatagagtgtcattatgcaaaatttgtttggagagcagtacagttctctcttggtttataacttcatactaccatatctaatatatttgatggttggctcttgggggtagacaagaagaagagcaaactcatacttgtaggagcttctgccatatattgggctctgtggttgactaggaatgatatggtttttgacaaatcaacatctatctcatatatgcaggtaatttccagggcaacatattggctccgattttaggcacagttgcaaatgtgtgaagatgatcgcgagcttattgaaggttgcatgtcgtaggcttgagacaacggtcatgcaactccttgcaaactatggatagagattcacaaataaacttgaataaatatgctctccttatcttagtttgatcttttattttattgggtgtgtttaattcatttaaactacactcggtgtttggatgttacttttgtaataattggctatagctctgatgagcaaaggccgggatattttattccattatcttaaaaaaaaaatctgcccagcacgctgaacctggacgaatgcatctgccaagctgcaccgttaacgttgcaggtccagaagttgagcacagcacaggagtagtagcagtcactactgtagggagaagttaccactcggtttcaactaggagtagtcgctgccaatggtagtacgaaatgctgacttgtgaagtaggaggagcagctcgacgtacagttcatccgtgtacaagtagcctccctgaagttaacggggcaagagaaaacgccgagacgtggttgccaggttcaatggttggtgcgccaaccgctacttctctcgctctgcaacaacgctgagtcgatcgcaaacagattcgctgtaaaaataaaaaaggggtggtatattactgtaccacactacacagtagtagctccgaaaaatataggaaaatatatttttttcaccggctttataaaaatatacatgtttagaaagaattggtaaaaatataccatcgtcagggagcaaggatacaaacgtttagtaaggccattcacaatgcttccatgtggcatacagcctcaccccaaaaaccgaatattggtggcacgttggcaatccgcgcggcttgctcaagaccgtggagccaactttagccacccgttcctcgttagttttacagggggcccacattcgcgatgcgttgtcctactgctcccaaccccgtctcgcgggaaaatatgtagtacaaaccacatatgtagtggtaacttgaaaactaccgttggatcgagaaatggatgtccgatattcgtccacgttaccatgagttaaaatttaactcccagtaaaagccggcggaggagaagagaaggggacggccgtgtaacgtcccgcctctcctatgccaggccctcttacatttggcagctttcataggtcataggctgcccttatagaccaacacaagtcttttctgcacactttgtcctcactcgtgcacacccaggaagaattttccggtcggtcacccatccaaaattgctccagaccaagcacgcttaaccctagagttgatcggcttccgaaaaagaagttataacttgttgatatgagtattgtattaatgctattaagccctaggctgggatgttacacggccggctggagaagagagaggcataggagcttgatgtcgacgccggttcagagccggcgagctcgacccgtctctggcgccgcctcccggcacagtcgtcgccgccctccgctcaggccgccccggggctcggagccgtcgccaccactcgagcagggcggcggcggccgtttaggtcgccccgttgcccggcgccgtggcctccgctcaacccgtctccggcaccaccagccaccccatcgccaccattcctcaccgtctgtgggagacgtagagaggtgagagaaaagagataagagcaaagaggggagaaagaagagataagaaggacagaggagatgggaaacactgtgggaccctttataaagtagtatgcaagtagtacgcaccgtggagtatgtatccatctagttcttgggtgttcttaggtctaggtggcatgtgacgcacactaaattcttgtggcgcaccgtgaatggtctaaaaatgtgaacttgtggtagcagcaaaccagaagagactagcatgcacgagtactcacgagttcgctcagcgatctcgctctcgagttcgtggtggcgcggatcgttcccgctattcctcgcaaacatcgcgagtttgtgtactcactgtgcgaactcgtcgtgagttcttattctcgctatacgataacgatatatctgtgacaatttctttgaaacatgcgtattcctatgaaaccggtgaaaaggaatatttttaaagaaattttacagttcgcgagagatactaagacgtaccatttttttcggatttgctataattatgtcgacagatttttttcgttgattacagtcggttatctggccgttggatctgtgtttaagatccgtgcttccatactgactttttcctcgcgaagagacctgaaagcatatgctattgctagctaatctctaaagtcatgcaaatccaagtgaaacgtcacctaatttcatgctacatgtatgcatccttttctttaacacaatttataccccgcttacatcccacttacacatataattactatgtaattttgagacttacatatgtaattttaaaacttacattataaatacactaaatttacatatgtaatttagagacttacaatgtaaatacacgccgactatttttaggtgaaaaatatggcgccataaatatagctacaccttttttttatacaaattttacattcgaaaatatagcaactttcgatacctcctaaaaactgtaatatcactcgtatttttctaaaaaaagaaaaattctacgtgctcctacggttctgatctgttaccacgttgtagaacacaaacagttttctgatggaaatcgtcggctggagccaatggaccatgtgatcgacgcagggtgcaccgtacacgtgccagagttgagaacttcagaggcacacgcggagacggcgacgtcatagagcacgcaccgccttcaacgagcggccggtgtttgcctcacgtgcgccgccgtgccggcctcggcgtaagccggccgggagccgcacacgtccgcctcctgttacctgcgacgctacactacacatcctcgtcaagtcacacacgcccacgcgtgcggccgatcattccgagcggctgcgttcattccgatcccagcagctgcgttcgtttccctggattggattgggaaaaacgaaatgatccattcacatgtgattaattaagtgtatattattttttagaaaaatgacataatatttaaataactttcgtatataaaacttttgtaaaaaacagctgtttgaacggaggagagcggctgtgaaccagctggaactaacgcaacaatgtgagctacgttcagatggacggacggacggacgacgcagcggcggggagatctttcgtcatctcagtttggggttttctgctcctttttccgttcgcgtgcggggctggagatcaaactcaactttttctttcgatacagcgactctactctacggtctcctcgattgatcgtttcttctgtccccttcagctgcacattggtatcatttggtcgagattgataacctgcagtataatctgtaactcccatatatcatatattcagtacacctttgcttgtaaagtttccgatttctttgccattttacagattgcattcattattatctcaaaaaaattatatacaatttcatccagtaataactaattgtcgtggaacagggcgtcactgcaataatcacataaccacaacaacgaacaactagtacatcactgtgatatttgcaacaaattttacacatggccagaataaaaaaaacagttgaaaacggcaccactttttttttaaaaaaaaaactatgctcaatcggttgggaatttccattaccgtttggataatcatcggttaactacacctacaactgatacaacactacgatgttttcaacatgaaaagtagtactgccagtaccaattccacgtcaaagaaatgttaatgaccaaatttagagaagaaggaatcgaaacggagttcgagatagagattaattccggcctaacatgacatcggaagcgctgtgacggatggtgtcatcagcatagacgcggtatggtgccccgaggtgacgcgggcaactagatcatggcggagtcggcggttacaccatcagggggagctgcgattctacgacgggccccagtctagatatttgtcctctggcaacggcgccttttgccgacaaaagatgaccacgtcgaacgggctagtgtgggagagaggagatccattcttctctctcaccctctcctcatccaacccaactacgtggatggagctggagcgtgtcaggggtcgagctcctttatgacggtcggccggcaacgtggcgccgatgcggtggctgtgcgtcgaaggctttcgacggtggtggcagcggagtgtgcaggagcttatttcttgggaatgatgaaataattatgggcgaatgctctatcttcggggtagcaacaataacgcatgtgggtgccgctttcctcttggagcgttgttacatattcttgtctctccagttacttttttcaagtgaaaatcatgtccttgctctccgggacaggtagtggtggtgttcttggcgtcgttttttttggaggcgtcgttctgaagatctcttgtttctattttttctctcgcaacaggagctgttgtagacgcgcggtgtggttgtttttcttttctgtctatagtcttccaggactatatacttattcttgtgctatatcaattaatgaaactcacattgtctcgtgggtgtggttcgtttcaaaaaagaggctgtacgtgctgctgtttctagctggcggccttgtttagtttccaaatttttttttcaaaaatatcacatcgtatctttgaacacatgtataaagtattaaatatagataaaaagaaaaaactaattgcacagtttgtatgaaaatcgcgagacgaattttttgagcctaattagtccataattagtcataagtgctatattaacccacatatactaatgacagattaattaggcttaataaattcgtctcgcggtttccaagcaagttatgaaattagttttttcattcgtgtccgaaaaccccttctgatatctgatcaaacgtctaatgtgacacttaaaaattttcttttcacgaactaaacacaccctcggtcgatagtcagttgtgtacccctccataaaaaaaaatcaaactctgggtcacacacaaggtttgattctttttgggacaagccagtatgcagctatgcagtgtctgaacgaaaaccaacggcagcagtagttcaggacttgacgacctgaccagatgacaaacgatgagacgacaaggtgttggcgacttggagctagcagctggaatgctaaaccgaacgtatctgctcaacacgctgaacctggacgaatgtatcggccacaatgcaccccctgcaagtacagagaagtagaagcagtctggagtagtagcactcgctatactgtagctagaagagtactgtacctctcggttgcaagtatgcaactaggagtagtcgaatcgctgccaaatggtagtacgaaattctgacttgtgaaggagtagttccgacttgtcgatcatccgtgtacaagtagcgctccctgaagttaacggggcgagagaagaggagagaagacgccgaggcgtggttggcaggttcaatggacaatggttggtgcgccaaccgctacatctctcgcccagtcgctcggagacaatcagacaataccgaagtcgatgacaaatgtgcgagcgagcattcacaatcagatatgtgcttctttttaataaacaacatagtactgcgtttcgtattatcagaacagcactacaacccttggaggatatagccatgaaaaaaaaaaacaacaacacaccacacgtttatagcgtcttgtaaacggcgtttagaatggttttctaaaccgcgtcttgtatggtaccgaaagtatcgccgctgcccgccctgggacagtattgatctgtactactactacgcttactgttttgatctgttactactacttactttatctatctcaaaatataattatttttagacttcaatatagtctttgagatgttattttgactaataatatttaaaaaaagatgttttaaataaaaagagttatatattatgataattttgttactgataaatctagtaacatcgttcttgcatgatttatcttttttttctattgatagttaaagttaaaaatatttgacttagcactattttaaaaaatatttatattttaagatgaaacacttctttcagatgaaatgcatcggccggagcagcagtgtgatcgatgcaggacttcagggtgcgcggcgccgacagcaccgtacacgtgcaagagaaggttgagaactcgttgagaagcgcacgcggagtgccggagacgacgacatactccagcataataacgagcggccggcgtttgcctcacgtgccagcggaggcccgggaggaccaagaaattaaccttctggcgccgcgcgcacacgtcgttcgtccgtcgcctcctgtcacctgcggcattttacacatcctcgtcagcctcacgcacgcccagtcgcccacgcgtgcggtcgatcgttccgagcagagggcggaacaagtgaacgaacgaacggcgcccgagcattttcgtcggcgtttctggaacggcttctgtttctctccactgtcgcagcggtggagatctttcgtcaactgagtttggagctgtctgctctctctctctctctctctctctcccgttcgcgtgcagagctggagatcaaactcaactttttctttcggtacagcgactctccagtctcctcggtcgatcgtttctcctgttcccttctgatgcgtgtgatcataaacctggtatcatttgattgagattgataataacctgctgtaacttagcgaattaccagagttactccgttttgcttgtacagtttccggtttctttgccatttcgtttacagatagcactcattattatctcaacaaaatatacacaatttcatttagtaactaagggcctgttgggctgcccaggctgcgactgccggcatgaacagtgccacattcactgtgcacagccgcggcgcttgctgaataggccctaaattatcgtggaactgtacgtcagtgtaataattgtttaatcacaacctacaactaaagttgtgtttagatccaaacttcaattcttttccatcacatcacatgtcatacacacacaacttttcagtcacatcatctccaatttcaaccaaaatttaaactttgcgctgaactaaacacagcctagtactccctccgttatatttcatattataagttatttaatttttttcttaatcaaatacttacaacaaattttacccttgttttttttaaaacgatgctcgatcgatcgagaatttccatcaccgttttcataatcatcagtaaccacacctacaactggtacaacacggtgatattttcaacacgaaaagtagttctgtcagtaccagttccacgtcaaagaaaccacggcgattttctaccggtcggagaattccgtccttccgggacaaaatccacgccaaccacaagctcaccacaaagagagatcagagatgccatcggaatattctccgtttccatctcgttctgcattttcgtgggctttgattattattcgtcgaaacttcccaaactcgcgaatttaccacgcgtgtcccgtatgatccctctcctctccatcgtacgttatcagcgactataaatacggcctcgactccggacaccttcttcttcctgctgttcagagcaacggtagctgacagtgacggagttcagcagcttcagcaatggcagcagcagcagctggtggtggtggtggtggtggtggtagcggcaggttgctgagaggagcaaccgcgaaggcttttcatggagacggcagcagccatcatcgtatgatgccatcgtcgtcgtcttcggtggcggcaggcggcggcggcggcgtggctgggccgtgccgcatcccgtccctgaagttcccgtcgctgtgggagtcgaagaggcagggcggcggtgtcggcagccgcgcggcggagcggaaggcggcgttgatcgcgctgggagccgccggcgtgacggcgctggagagggagcgcggcggcggggtggtgttgttgccggaggaggcgaggaggggcgccgacctgctgctgccgctggcgtacgaggtcgcgaggaggctggtgctgaggcagctcgggggcgcgacgcggccgacgcagcagtgctggtccaagatcgccgaggccaccatccaccaggtaattaactgaaactaatcacctcaaaatgcagcaaattttgcgagttctttggaatccgaattagccgaagttttgcggatttaaattactgatggagttcatatgaactgtaaaattttcagggtgttgtcagatgccagtcgttcacgctcatcggtgtggccggatcactcgtcggatcagtgccatgctttctcgaggtaaagcttctacgatcatttcctgctgcaagtgaaaccatgatggactaatcaagattcgagatcgtattaagtgaaagaacattcgaggctgaaagatttcgtgctgaattatgcagggatgtggtgcagttgtgagatcattcttcgtacagtttcgtgccctgacacagacaattgatcaagcagagatcataaagctgctgatcgaggcaataggtacgccccttataatcacttttaaactgcatacaagtaaccatttccatgttaaaccgatttaatttatgcctactaaatcttgacaaatcaaactatgcttcttcttctgcagacatgttcctgatcggcacagctcttctcacgtttggcatgggaatgtacatcatgttctacggctcccggagcattcagaacccaggaatgcaaggcgataattctcacctgggatccttcaacctaaaggtaactgaaatctgtcgatttttgttttgacagatgttcaccagtaaccatgtctggctattgatcaatgctgataaagaaccgtaaatttccatatcgcagaagctgaaagaaggggccaggatccagtcgatcacgcaggcgaagacgaggatcgggcacgccatactcctgctgctccaggcgggcgtcctcgagaagttcaagagcgtgccgctggtcaccgggattgacatggcttgcttcgccggcgccgtgctcgcctcctccgccggcgtcttcctcctgtcgaagctgtcgacgacggctgcacaggcacagcgacaaccacgcaagcgtacagctttcgcatgaacacgtacaggaattgccttatagctccgattcataattcatttattctttcatatcaagattaggaatagcaaaaaaaaatgagttgcaaagtgtgtgtttttatagtattctctctttcttcacttgtaaagagggtacgaagtagtttgtacagagtgtcaataaagcctctcgggggaagaaagaaatctccaattcggatatctttgcaacgcacgaatttcacgacattttcgagatcgtggtgtgtgtcacgagtcatcggcacgtctgtatatctgtagactgtagctgcgacgttcagaaaaaaaaaacggatggatctgtagctgggcgttcaggggaggaaaaaaaaaagaaccggacgacgtggacatgatagtagcggacgcagggagggactcaggcgggagcggggacgacgtggtctcgtcgctctcgccggtgaagccgctgcaggaggggaggccacgtccgttcgcgtgggcgtgacaccgcggctcttcgcggcgcgcggggctccgtcgcgtggacggccggatccgcgggtggaggcgcgctgccggttaggacaccgaagcgccgtgattgtgggcctcgctatgcgcggggttcgtgcgggctttcctttccgagataggaaaaaagtacaccaaaggtccctcaacttgtccggaaaaactagtcaggcccagcgccgctgcgccggcgcgcgcacgcctcctctacgattttttttccttttttttttaccttttttttctcactttgtttctgattttttttatctttagtatattttgagtttgaaagtttttaaatttagagttgaaaatttttaaatctgaacttgaaagttttcaaatctcgagttgaaagttttcaaatctcaaatcgaaagttttcaaaatttttaaatctagacttcaaagttttcgaatctcgattctcgagttgaaagtttcaaatctgagttgaaagatttcaaatctcaagttgaaagttttcaaatctgagttgaaagtttttaaaatttgactttaaaatttaaatcttaaatcgaaagttttcaaatctaacttaaatttttttaatctgttagtaaaaaaatctccaaaatctttcttaactactatcattagtgttaaatatattaattaacatatatagttaagactaaagggaaggggggagtgcacgcgcacgctagccaccccctaacctgacatcgagatacaaaatcgtcccccaaccacaaaaccagttacgtggcatccctcaaattacaaaaccgttcactctaggtccttcggtggttttaacctcggttttacccgacgtggcggttgagtcagcgtgggacccgcgtgggacccacatatcagacagtccatgtaagctttctctttccctcttctctcccttcctcgtctctctctcttctctcttggcatggtgtgcaacgggtggggaggagaccgcgcgttcgcccacgccggccaagtcccagctgcgccgctcgccctcgccggccgagtcccgatcgcgccgctcacactcgccggccgtgtccccgccgtgccgctcaccctcgccggcaccggcccatgggaggggaccgcccaccagaaacaagaagcttggaagagaaatggggaagggcaagatgaatcccccgttgtcgccgccggccgcggtgggtggtggcaatggcgacgctcggggccgaggcgaagaaggtgctcgtgtcgaagggcggcggccaacgacgagcgcgcaggtcgagcgcgccggagcctccaagcacggctgcggcgcacaccatcgccatcgtcgtcgtcgtcaggggcggcgcccttggggacggtgacaatgagctcgccgtcggtgtagttggcggtggccatggcggggagcgtgcatggagggaggcggaatcgccaccggtcgagctcgaacgcgcggcggcgccatcgtcgccgttgaccccggcggagaggttccgcacgactggcgagggcgagcggcacggccgggacgtggccggcgagggcgagcggtgctgccgggacttggccggcgagggcgagcggcgccaccgggactcggccagcttgggcgagcggcgcaatctcctccccactcgtcgcccgccatgccaagagagaagagagagagagagagagacgaggaagggagagaagagggaaagagaaagctgatgtggattgtctgacatgtggggcccacgcaggtcccgcgctgactcagctgtcatgtcggacaaaaccgaggttaaaaccaacgaaggacctagaatgaatagttttgtaagttgaggggtaccacatatcatgttttgtggttgggggacgattttgtatctcgatgacaagttgagggaccttcggtgtactttttccttctgagatattacaacaccaagtgggctgggcctccctgggccacagtacagtggactatggccttggttgacattggattttaggcatggatcgtgcaaaatgaatggaaaaagtacgaattacacccccgaactaccgcgatcgtccgaattacccccttgaaccataaaaccggacattcttcacccccaactaggcaaatcggacgaattacccccctcgaccgaatccgcggtggtttttgtttacgtggcgtacacgtggcagtccagtcagcaatttttttcttaaaaaaattgtgggaccctcctgtcatagtgtcatacctctccttcctctctctatcttcactctttctctctctctcttccacgggcatcgcaagggcgagaggtgggcggcggcgcgagggcagtgaatggcggcgtgcaggggcgggcggcgaccggcggcacggggacgagcggcgctggcggaggctgactagctactgatttcttggcgaggtcggcgccgtcgaggatgagctgcacgccggcgacctcgggggcgagggcggtgaccagggcgactgtggtgggcggggccgtgccgcctcccgctcgcccgccgctctagcctcgcctacccagctgcgcccgccccctcgtgccgccgtccacggccatccccgcgagccccactgcgtgcgacgagcgaggcgggggcgctgcgggcgggcggatctgagggacacccaccgctgctcgccacccagtcgccgctcgctcccgccccctgcgccgcccttcctcgctgccgcctcgctgtagccgccgccgccgccagatgcagacggcgacacgctggcgcacggggatggaggcgcggagcatgggtgtcctccttggccacgacggcgacgccgacgcggaggccgtctcggcggcaccttcctcgatagccacgaccgccgccgtggcggccgacacggcgaagctcccctccatcgtggcggccgactacatctgtatgacaacaattaaacagacacaccataaaataagtatgccaagaagattgttttagagagaaacatcaaaaatgcattcgtagtgattacatgaaggctataccttcagcattggcaacaatgtttcccaggtcacccgcatgacggacttcatcttctggtgcaccgtgcgtcaaattgtttgggttaaaatgtggtcctgcaggacaaagttttgccatgtaatgtgagggtgtgtttggataatgggaaatgtgaggtgggattgagatttggaaatgaatgaagggttaggattaaatgaaagagtgagaatgaatggttaggatttaaagatgtcttttagtggttgggaaatgatttccctgtcccattagctaaacagggcctaagtagacaggccttagggcacccgcaacgcgcttgcctcgccgcagccgcagccaccgccgccgctagatgcagacggcgacgcgctggcgcacagggatggcggccgacacggcgaagctcccctacttcctcgctgccgcctcgcctcatcccctgccgccgccgccgctccgtgtcgccacctgcgccgcccttcctcgctgctgcctcgcctcctccgccgcctgccgctgtggcgccgtgcgcgtttagagagtgagaggagagagatgaagagagagagagaggagagagggggggaataatgttataggggtatgacaggtgggtcccacatttttttaataactaaaatgctgactggactgccacgcgtacaccacgtagaccaaaactaccgtggattggattgaggggggtaattcgtccggtttgcatagtttggggtaaagaatatccggttttatggttcaggggtgtaattcggacgatgcgatagttcgggaggtaattcgtacttttttccaaaatgaatcggaatggacaaacggaacgatatgcattcccctcccaagaaaaagcacacgcgcgcacacaatgaccgaagttgctaattagcattcgaatgatgcatcattgggtgcgttcgaatgggtgaattcatttggctaagttgtttcacgcaaaactagataagttattaactattataaactaaaaaaaattgttttggagttttttcataaaacgtatcatttaacagcttataaaatgtgtccatagaatacgataaagtagcttgccccgttatccgtaatgggaattgtttacaggactgcagctgctgtagcagccgctgacatgtgggaccaggtccacctatcagcctggcttctgcaaatacagtactgcaaaggatcatgtctcgttgcccgatgctgaatcaaacagactgcagtatacgcttccaccgtcccacgaaccaatgaagcatacgctcagtttcaagcttggacacgaaaaatgaagggcctcaaatcactcaaatcacccaattctcaacacttatatgcacactggtcagatgtattctgcatttctgccagcatcaaagccgagttgtattttccccggagaatgtaacgcggaaaaaaaaaagcccaacaattttgcacaaggtaaaaaagaaggagcaaaatattcgcccatgcacgcgcactagcccttggcgtgcgcaacgctcagctcaagccgcaacaccttcgccgcggccgcgccaccgaacagccgcggcgcgcacagcgcgcggagcacgccatccccgcccgcggcgaacgcgaagtcgcccgtgccgcccaccacccgcagcacctccgggtcaccgcactccccgcgccgcctcgtcggccgtggcgccttctcgccgccgccgccgtcccccgccgccgcctggacgcagacgctcccggacatccccgacacgtcgaacgccaggtgcaccgtgtcgaacaccgacatcgccgagccggcggcctcggcagggagcacgaaccccgtcgccgcgcccaccgtcctcgacgcgctctccggccccgccgtcatccggtgccggaacacgaacgcgctcgcctgctgttgtcgctgcggcggcgacacggttccagctgccgctgccgctgccgccgccgccgtcgtcgtatggatgtacacggtgagagtccacggatggtctcgaccgccgccgccgcccttgtggcgccccggcagcggggagacggtggcgaggaggacgacggcgaggacggccgcggcgatcaccacgcagaagatgatcctgcctagcatcgtggccgccgccgtctcatcctatttctggatggtcgccatggcgagcattatgggggttaagtggtgttcggttaaagattattggatttcttaagaggaagacgaagaaagaaagctagtgagacagcgagtggctggctgagagagagtggttgaatttgcatgtgctttacttaatccattgccatggcttagagtcaaacataaactaaaccattgacggaaaggttgatatgatgcagatgatttattaagccaaacaaatggcatattgtgttagtgtggtgggagtgtgaagccatgagcgcgtctggttcttggctcagacagttttagcctttctccttgttctggcctagcttgcttgcattcctgccaaaaagaaagctgtccttccctgaaaaatcaagttcttttttgtttcgtagtagtagaattgctaccttgatcctagatcagtaagagaaagacgtaatgaaacggacagagactcccttgctttattcagtcatgacatggagcttcggccaatcaagcctaagttcgttttctttgttttctggggatagcttttcattttgacatgctatatatatatatatatagagagagagagagaaaaaacatcatttagcagttcgggaaatatgcacataaaaaatgagagaatataagttggaaaatggaactttttttttagaaaaaacaaagctttgtttttttaattttaggacgagagcaatatatacttcatcagtggtatttggttttttatagagaaatagaggtaccgcttaagagcgcttttcgagagttgttcagttttacaaaggttatgtttatgggagcttctccaaagatctctagctccccaggtaatatagattgtcactcaaattctaggaacatgtagctataaaattctgaaaatgaatgttatgccttgattttctttcgaggttaaaaatcaaatagtacatcatttctataatttatgttaaaattaaaagcaatttataaagtaaaattaatgtgggaaataaatttttctttaaaaatcatagttggccataaagtactctttgaaatttctcgtgaattttcagtgctcgagtggtaatttcaataatacaaagttcatttaatcaattatttaaattaaaaaccaaattaaaattccgtccatgtcctttgggccgtttccagcccaagtcttttttcccttcctcgccggcctggctccccttctcccccccccaccccccc

SEQ ID NO: 43070 - DNA, 30011 bp, Oryza sativa
caccccccccccccccccgcgcgcaggcctttcttggcccagcctcctttcagccgaagtccacttcgcctccctcctgccttgagccaccaaaatgtggggtccacctgttagcatcatcctttttcttcggcttgagagccagcaaccgtttcccacatcacgacctctccggtgggcctccccgcttccacactcgcgtctccaggtgcgtggacacagtcttgtaaaatcaaaggtgtttttgattattattttgtgatgaacaattgggcattggagattattggttttgttatttggaatttattcacgaagtggttttgaagatgattggatttcacatgtgatcgcaggattcgtcattttatgtgatcggtcagaccgggctctggtagccggtcagaccgacgtgtaatgcgcggtcagaccggccgacactgtgtcggtttcaattttgggttgtttatttggatatccgaatttattttatgattatgacttctagatggatactatacgtatgtaatactattgtttgctgctgatgagtcaacttggagatagcttggtctcggaatatggtttctttgtttgttccatgtgtaggtgactcgatgtctcaggggagtatttgcggtgatggaccgggagtcggcttggggataagacgacgtccgtggtggtcagagatcatgcgagatacttaggctagagttgatgcacgtggttgatggagattttatatggcatacgatggagttattgtgtgcgtatgggatgcggagtcaaatttagaaggagtccaaatatggtacgattggttatgtaaagtttctttcttgtactagagggtttcctaaggtgtttaggactcctagtatgagtttggttcgtggctttaggctgcctacctcgggtataaatagagagggagcgtgaggcttcccggtatcgcttttgagagcaattgagttgagttttgagttagggtttcgagtttagtcgaaatttttgtaaggagtgctgttggtgcactttgtaaacacagaaagaatcaataaagtcgtcatcaactttaagagttctttgatttgtgtttcaccgggtttcggcggtctaaccggcaactcaccgacggtcagaccggcggcattgcggcggtcagaccggcgggagcatggcggtcagaccggcggcggcgacaggcgcggcaggtgatctcggcggtcagaccggagattcatcaccggtcagaccggcggcatccactcggtcagaccggcagatcaatctcggtcagaccgacttccatcaatttcgagggtaacttttatttccgctaaaagttttcggtttttgggtataccaaccattcaccctccctctggttggcttagttcttatgattcgatcctacaagtctcctccacttgtccacctttagccccaccactctcccgcaaatcatacatcgtcaaagccgcatctcacctatgttgtacctatcgttggctcacctatcgcctctccccgccccaatccagtttctcgagggtataaatagcctcgccatactcctctatcttgttttccacatttcaaaagtttagtgcttttatgctaaagacggagttaaaagaccaaggtttatacctcagttgcgttttacttgtggagtggaggtgaagttccagtaggatcgtcctttttcactgttgctttgttttttctttatgaggactaagtatttattctgtaagtatttacgtttgaatatgtatattaatttgtcattttgtgtatcctagtttgattcctggacatagatttatacacagaatagtatgagaattggtgaaatttttgggcgcgacaatgaactacgtgccaaaagttgggaaacccggcttttccatattttttaaacctaactacgaaccaaccgttcctccgaattttaagctctccaaaacgggacaaaagtctatttcactatacattagagaaaccaccatgatgctatttttggttcagaagtctcacataggctcggatggtctcacatccttccaccaattgaaattcttagcccaaataatgcaccacctaaaattgaattgaaccccagaaccaaaacaaaggtcccaatgattgggaatggtagggaagatgcaagatccatggtccaatcagaccaagcaaaccatcattgagcaatgttcactgcactgtgtgcgagtggatcccatcaagatctcgctcgttcgctcgttccctcctgcaaggcagctggtcacaagtcacagcaaagttatgagcctcgattaatctattataaatctgcaataacaaatcttaccagcaaatcagcaatgcactattcagttgacccaccccgtctgaattctgaagaaaataatgcaaaacaaattcagtggacagagaagagaggagacatatttacgccatgtagataatctattataataattcagtcaataattattgaagtaaattaaatattttaataaattaattaatatataacatagattaaggaatcattgcaacacattaaaagaaagtatttttaagaaaaacttaattttgaagatgtggaagaaataatccacaacaataattcagtggagaagcaaaaagaatcggggcctgaggacctgaccaccgaatttgttatatatttgtcatcaaaatttttctaaaaaattttatagatataaatacagtaaaatcgtagtgcaattatattgtaacttaattgtaatgtaactttcaaataaattttgaaccgttatatttgcttcaagattcatgtaatcgaagaaaaaaaatcacagcgtgcttatagctgaggggattatgtcatgagacatccgcttcatggaaatagtgtgttatcatagaatttttttaaaaaaaattgtattgtaagttacaaacaaactacaatatactccctccgtttcaaaatgtttgacaccgttgactttttatcacatgtttgaccgttcgtcttattcaaaaaatttaagtaattattaattattttcctatcatttgattcattgctaaatatatttttatgtaggcatataattttacatatttcacaaaagtttttgaacaagacgaatggtcaaacatatgctaaaaagtcgacggtgtcaaacattttgaaacggagggagtagttattttacaattacacttaggctgtgtttagttcacactgaagtttgaaagtttgattgaaattggtacgatgtgatagaaaaattgtgtgtgtatgaaatgtttgatgtgatggaaagttgaaagtttagaaaaaaaaactttagaactaaacagggccttacatgctagatttttggaagaaagttttaagacaaagctagcaactgctcgcgcggcggctgcgggcgggagcccacaccgtggcgcgcatcaaactcgcccgctaggatcttgcgtcggcgcgccgttggacacttggacttggaagactcagctagcagctggccgatggagagctggtcgctggctacttggctagctagccaatctctccctcctacttgcaagctgcctcctccgacatggaattttcctgagcgagaagacgaattgaaagggggaagcttgatgacttgatgggcactgggatgggatgttctgccgatcacaatccatcatttacgtcgtgcttgctttgattgtcaaacagtgccagacgatgactctgctgatcgatcgcttttaatttgtgatctccaggctgtatgtattactgtacactacagcgctcatgctctctgtagctctctcgtcttaaagtcagcttcaaatctacaactggataactgcttacagagtaactgagagtactgtgacagcaacaacatcgaactggaaattcaaggcgagattgttagaatttatatcagatatgtatatatacaaaattagatataaattaggacttgagtgttaaagatatagaagtagaattaagactcttaccctaagctctctcttaaatagagtggcgcataccacacataatgtaatcgtatgataatgatagcgtaagaaaaagaaataaatggccagcaacgtaatcagtggaaggtcattgataccttgatagttatagttaccatggatagaggaggagcatccgtaactagtgctctcggatgtacttcctccgtcccaaaaaaaggcaaaccctgagtttccgtgtctaactttgactgtccatcttatatgaaatttttttataattcgtattttcattgttgttagatgataaaatatgattaatattttatgcgtgacttgtctttttaatttttttcatattttttttcaaatcagacagatggtcaaacgttgggcacggaaaccagggtttgtctttttttgggacggagggagtaggtttcgtagtaactttgtgcatcgttgttgtcataatatttgaatcttctatggtatttttcctgtgtttggttgtggacggtagttttggtgccaattttatacttcctccgtttcgaaatgtttgacgccattgacttttttaaacatgtttgaccgttcgtcttattcaaaaaatttaagtaattattaattattttcctatcatttgattcattgttaaatatatttctatgtaggcatataattttacatatttcacaaaagtttttgaataagacgaacggtcaaacatgtgctaaaaagtcaacggtgtcaaacatttcgaaatggagggattatgtcagttttgccttttttttttctttcaccatcttcttctttgttcctcttctctccctctaccgcgcacatgctactcgtgttctccagttgcgctatgtgagctcgtccatccgcacacacttgctccatccatctaccctcactcagcagtcaacagtcagcagtggagtgctacgcggcatgcgacaccggaagagaagggatctacatgagatggtttggattttgactggttttgatcctgaatttaaatctccatataaaagaatttcatattagattatttgatgatttaagttcctaattttaaaaagctgtatatatctgaatagatatagaaatcgggtaaaaaaataaccttctctataaaaaaaaaccgcaccagaccaaactaccaaagacaatacacatgcatgcataagggcatcttagtattttcaaaatggttctctctcagcaaatagatagaaaataataaaataataatcgctgcagtttcacctccaacaaattatcgagttttgaggatgtccaaaaacaaagcataatttttacagtacccactaataaagacagtaatattttaaatattacttcctccatcttataatataacgagtatcaaatgaattactatatagtacagcgaatatatgcctttacgttgttattatattgtgaactcgtactatattatgaacggaggaagtatgtagcaaattttgcttactattacctcaattaggagtctacatgcatgatgcatgatgccctccctcgtgtgtgtggatgtgcactcctgtactactccttggtggtgtaagtacagagtgtacatacgtatcggttttatttaaatggatttgctagaaactttcgtaagtttttttcctccaaaattcccatctttttgatcattggatcgcctcaagatttgtgcatgaagagaaaattttgttagaaagaaattttcacacgcgtcatgcataagatcctattactatctaatcaaagcattgttgaatggaagttttaataagttacagcgtagttacggtacagatacagtatagttacaatacaattacaatataattataattcaattatacaatagttatatttgaaagtttctgaaaaaaaaattgtgacaattttttagcttgtgcttcaatcccgaaatcaattggactttttttttactgtgtgtttcaaaaaaagaaacacacaaacaattgacttctccttttaccctcaccgagtagtacgccgcatgtgatccacaccaactatgtggggactgagagtctgaaacacactgtcgctcttatctcttttcctacacagactagcatgcatgcatgtataccaatctcttgttccttttttttctcgatccgcacacacacacacacacgaaagatagcacagtgagaatcgtatcgtgtagtaggtgttcagaatttcagatcaagctagccatgctcaattatatatggtcgtgaatcacgcttgctctctcctaaacaacattttttttccatgcacgattcgtttatatatacccatattaatttgctgggtgtatacttacatgtatatcaatcattggtaggcctgacaaaaatacagaaaacgccgggctttcgagttaggaaatattcctatatagtatatcagacgctaatgagagggctgtgttcttaaaaaaaagttctcggaaagaaatgagagggctgacaagtgacaaacatcccaacgggaattgcctgcagtattgctggtgcagtagcagtgactgacatgtgagcaatactgcagagtacctgcactccaaacatccgtatatttgtgcaagaaaaagagaatggcgcaccaactgccacaccaaaggattcacatcaaattaacgatttacttgtggggcataataacaattaataagatagtacacaagttattttttaactgtgtcttgaaaaatggcaagcatataaagcacgtttttcaacgccctcaacaggatatgagtgggtgagaatatatagtatgtacagtaaaaaggtactgttaaggacttttgatcaattgaaaaataactcattttcggatagccaacatttgtcacacgatggcattgctcaagtctttaatacatattgatataaactcctgacagatataagacatgcgcatgaaaacaagcaaaatggatggttagataaaagtttcactaaattgttacagttgttgataaatattctttcagtgggtaatatataaattgccggaaacaacataccaaacgaagaagattatatgtccctttggtcttgaaatacataaaattcatacttatcagaatgattgcatactttacttgggtgagtatacagatttggatcaatgttcagtgtgcaaggcatctcagtataagtgtgaagatgatgatggtggaactaaaaaaaatgtaccaagtgaagaagattatatgcccccttggtcttcaaatacagaaaattcacacttatcgaaatgattccatattgtatcgggtgagtatgcatatttggatcaatgtgatggtggaactaatggtacagtgaaagaagaaaaaaatgcctcagaaggtggtgtgatattttcaattgtctctcgtttggaacgtttgtttgcaaacaagaaacatgctcaactaatatgttggcaccacaaagggcgtaaaagggatggaatggaataataagacacccaactgagggatcttaatggagaaagatagataggaagtatataaaacatttgtgtatgacaagaggaatgtccggattgtactcaacacagagagcatgaatccatttggtgacatgagacgtcgccataacgcatagccagatattgttattatctacaacattcctctttgacactgtttgaactgcaaatacatcattaattcatgatgccatttctaatttaagggcctaaataacttgagaacaatattaatgtgtacttcgagccactgatagaggatcttggaatactacgaaaggatggtgtaaggatgtgggatgtgcacaaacgaaagcacttcacctgtcgggttgttttgttcatgataaatcaatactgctccgctcttagtaacacgttcggtcagacggtgaaggacatgaaagcatgtttaagatgtatgacccagacaggagacaagtgattaaatcactaccggaagaccgtttatatgcgtgatcgaatgttccttggacagggtcactattacgagagatttctacgagacgatgaaagacggatcacgtccaaagttcattgcatgctggcagtgagatctgggagaatgtaaaggatatcaacattgtattcgataagtgaatggaagcgtacgtgcatctacatcaagcggtgagacatctctttcgaaaaggaattgaaatccgtctttcgggacttaccgtactagaaaaacttagatatacgtcatgcaatcgacgtcatccgcgtgacatagagaaaaatgtgtgcgaaagcttgatcggagcattgttgaacacggtatgcgtacacggtacacgtgaagaaatatgtgcgcgaaagctctaatctctctagcacggccggatgaatcaaccacgtacgcggtactcctcgtcctcgcgatccgagtccgacgacgacgaagccgccacgtccgcccgcccgcccgcgcgcggcgccaaggcaaaagaaagcacgccgcaatggcgcccatgcaagcaaagcatgtgcgcgcgcgcgcgacccacacgcacgcttctcacgtacatatcgatcgcaaatatcttgtgcaccttaaacaatattcaaatcgatcagcctctcgttcagtcgttcgatcgctcgcctcctcctctataaatagcgggccagtttgctcgtacaactcacacacactcatatccactactactactagctaccgagcactgagcactgcactctgctgctctagaactgaagctttgcattggttggttagtgagagattaattattccaagatgttgggcgggatcatcggcggcctgacgggcaacaagaacgcccgcctcaagggctccctcgtcctcatgcgcaagaacgccctcgacatcaacgacttcggcgccaccgtcatcgacggcatctccgagttcctcggccgcggcgtcacctgccagctcgtcagctcctccctcgtcgaccccagtaagctcacacacacacacacacacacactcgctgactcacatggctcgagctagctaacgccggtggcgtctgcagacaatgggaacagggggagggtggggacggaggcgagcctggagcagtggctgacgagcctgccgtcgctgacgacgggagagtccaagttcggggtgacgttcgagtgggaggtggagaagatgggcatacccggcgccatcatcgtcaagaacaaccacgccgccgagttcttcctcaagaccatcaccctcgacaacgtccccggccacggcgccgtcgtcttcgtcgccaactcctggatctaccccgcctccaagtatcgctacaaccgcgtcttcttctccaacgacgtaattaactaattgatcaatcaatcaaccaaattataatgctattcgtaatctaatcaaacgtctagtagcttaattaattaattgactggttatattgtttttttctgctagacttcactgccgagcaagatgccggcggcgctgaagccgtaccgcgacgacgagctccgcaacctgcgcggcgacgaccagcagggcccgtaccaggagcacgaccgcgtctaccgctacgacgtctacaacgacctcggcgagcccgactccggcaaccctcgccctgtcctcggcggctcccccgaccgcccctaccctcgccgcggccgcaccggccgcaaacccaccaaaactggtacactacccacgaattttcgtacctggagtagtacgatactgttgaaagatattccctgcgtttcaaattaaaaatcattttgattttttttcttaaaatttaaccaaattaatagaaaataaagcaaaattaacaacatcaaattagtttcattaaataaaaaattaaatttattttgattatatgtttattttatattagaactttttttaattttttctataaactttatcaaacttaaaaaaaatttaactacaaaaatcaaaacgacttatataatataaaacagatgtactaaattttatattagaaaatatcgcactactatattgttgaatactaaaaaatcattcgctgacatgtgggacatgtaactttgtagaccccaccgcggagagcaggctgtcattgctggagaacatctacgtgccacgcgacgagcggttcgggcacctgaagatggccgacttcctgggctactccatcaaggcgctcgtcgacggcatcgtgccggcgatccgcacctacgtcgacctcacacccggcgagttcgactccttcaaggacatcctcaagctctacgagggcggcctcaagctgcccagcatcccggcgctggaggagctccgcaagcgcttccctctccagctcgtcaaggacctcatccccgccggcggcgactacctcctcaagctccccatgccgcacgtcatccgggaggacaagaaggcgtggatgaccgacgacgagttcgcccgcgagatcctcgccggcgtcaaccccatggtcatcgcccgcctcaccgagttcccgccgcggagccgcctcgacccggccaggtacggcgaccagacgagcaccatcacggcggcgcacgtcgagcgcgggctcgaggggctcaccgtgcagcaggcgatcgacggcaaccttctctacgtggtggaccaccacgatcatttcatgccctacttgttggatatcaatagcctcgacgacaacttcatctacgccacgcggacgctgctgttcctgcgcggcgacggcacgctggcgccgctcgccatcgagctgagcttgccgcacctgcaggacgacgggctgatcaccgccaggagcaccgtgtacacgccggcggcgcgcggcggcaccggcgccggcgccgtggagtggtgggtgtggcagctcgccaaggcgtacgtcaacgtgaacgactactgctggcaccagctgatcagccactggctcaacacgcacgccgtgatggagcccttcgtcatcgccaccaaccggcagctcagcgtggcgcacccggtgcacaagctgctgctgccgcactaccgcgacaccatgaccatcaacgcgctggcgcggcagacgctcatcaacggcggcggcatcttcgagatgaccgtgttcccgcggaagcacgcgctcgccatgtcgtcggcgttctacaaggactggagcttcgccgaccaggcgctccccgacgaccttgtcaagcgcggcgtcgcggtgccggacccggcgagcccgtacaaggtgcggctgctcatcgaggactacccgtacgccaacgacgggctggccgtctggcacgccatcgagcagtgggccaccgagtacctcgccatctactaccccaacgacggcgtgctccagggcgacgccgagctgcaggcgtggtggaaggaggtccgcgaggtcgggcatggcgacatcaaggacgcgacgtggtggccggagatgaagacggtggcggagctggtcaaggcgtgcgccaccatcatctggatcgggtccgcgctgcacgccgccgtcaacttcgggcagtacccgtacgccgggtacctcccgaaccgtccgtcggtgagccggcggccgatgccggagccgggaacgaaggagtacgacgagctggcgcgcgatccggagaaggtgttcgtccggacaatcaccaagcagatgcaggccatcgtggggatctcgctgctggagatcctgtccaagcactcctccgacgaggtgtacctcggacagcgcgacacgccggagtggacgtcggacgccaaggcgctggaggcgttcaagcggttcggcgcgcggctgacggagatcgagagccgcgtcgtcgccatgaacaaggacccccaccgcaagaaccgtgtcgggccgaccaatttcccctacacgctgctctacccaaacacctccgacctcaagggcgacgctgccggcctctccgccaggggcatccccaacagcatctccatctgatctccatctcatcagatgaggctgctccacggaggcgccagcgtggacaagagtagttttacggtggtctttaccggtagtattttactttcaataattgccatgacacctacacccggaggtgtcatggaggatgaattcgttgtgtaatttccctttcagttcctaataaagaataaggaagcatatggttgtgtagcattttcaagcaaatcctccatatatctaccatgttttgaattgaaaggactgaattaccgaaaatcctttgatgaacattatctgaagacttaataagttggattaatgtctaacaaaccattaagtgatttaaattgtctgtaaactgatggcaacaatatgaacaaagagcaaaccactagtgaatgtgaatcaagccaatagaactcatctcaggtcataactgaatgatgtgaactgtcagtaaactgaggctattcttgatgcctttctcctattttcttatactaaacattttaatcaggcaaaatagcattttctaagtttggttagcctcctaaaccgacgaaagggagcaatccgagggaagtggggcccaccgtttcttccccgccccaacctcgcaacggtctcaacacttttctcgcttcccgccattttctcgtcgcctcacactcccctcccctccacacatacacacccaacgctctcccacacctctcgcagttctctcttcttccccccctcatctccgccgcctcgccgcgaacgggacgccggccaagagctcgaagctgatgagagatagcgacggcgaaggggccggcggcggcctcccgcgctcgcacccgtcgaacctgccgctgccggcgccgcactccgacccaaacctccagttctccgggacggacgatgacttctccaaccgtcacagcagctcgtcggcgacgggcggcgcgagccccgggtactactccgactacccgtccagcttcagcggcgagtgctcgccgtacaacatgtcgccctggaaccagaccatggcgtcgccgtggtcgcaccacagcgacgcgtccatggccgggctcggcggcgcgcccgccatggcgcccgggaccagcctcatcggctcgctggtgagggaggaagggcacatctactcgctcgccgccaagaccgacaccctgtacaccggctccgacagcaagaacatccgcgtgtggcgcaagcagaaggattccggcgggttcaagtcgtcgagcggcctcgtcaaggccatcgtcatctccggcgagcgcatcttcaccgggcaccaggacggcaagatcagggtgtggaaggtgtcgcccaagaacggcctgcacaagcgcgtcggcagcctgccccggctgcgcgacttcctccgcggctcgctcaacccgtccaactacgtcgaggtccgcaagaaccggacggcgctctggatccgccacagcgacgccgtgtcgtgcctgagcccgacggactcggcgcagggcctgctctactccggctcgtgggaccggaccttcaaggtgtggcggatcaacgactccaagtgcctcgagtccgtggtggcgcacgacgacaacgtgaacgccatcgtggcagcgttcgacgggctggtgttcaccgggtcggcggacgggacggtgaaggtgtggaagagggagctgcaggggaaagggaccaagcacgtcgcggtgcagacgctgctgaagcaggagcacgcggtgaacgcgctcgccgtgagcgccgtcgcgccggtgctctactgcggctcctccgacgggctcgtcaacttctgggaaggggagcgccacctggtccacggcggcgtgctgcgcgggcacaagaaggccgtgttctgcctcgccgccgcgggctccctcctcctcagcggctccgccgacaacaccatctacgtgtggcggcgcgacggcggcgtccactcctgcctctccgtgctcaccggccacaccgagccgatcaggtgcctcgccatcgtcgaggacaacaaggacaacgccgccgtgcccgtcgacgccgtggacagcagcttcgcgtcgggctcgtccacgcggtggattgtgtacagcggcagcctcgacaagtcgatcaaggtgtggcgcgtcgccgaggacgcgcctgacgcgctgctccgtggccccggtggcggcgacgcgccgcagatgttcgaccggtaccccggcgacccattcggcgccagcagctcgtcgttccgctagaacacgcgcccgatcaaccaatgcaccattttgatcagttccaagaagaaattttcaccttacaattgggcagatcaacgtcatgaacctctctgatggctaacggtttgagcgaattgaaggaaattgctgggttttgtttgttacacgtcctatatatactgtgatgaagacaagtatgaaatgaatagcatcaacatcatttctggccatgaacatctgaagctgcaacggcaagtggtagaaatgaagagcgtatataggtaagtttgctttcagaaagtggccggggggaatttttgatacatgctcatatatctgatgtgtactagttgaagccgcgacttggtattcatcttaaggatcgattgaaatcaagattaattgggaaccaataaaaggggataatttcaaactgtttttataggttgacgttagaggattgttaattaccctctttgaagattagcaccaaaaaagttcatcgggtgcttattcatatgtagtattcccagtttattgtgatgttcaatgcaaaacttatgctcagttatgtttcgatttggtttatcctttttatacatacttcacacttctacttgtaacttcatgatggagaatgcatgattccctaatgaacagtctgtcagatttaacaacaaagttcggttcaaaagaaaaaaaaagatttgacaaaaaagaaaaatgggcgatcaaatttggcccataagaaggggccatctctactgttgaatcatcacttcacagcccagcccattctagatacactaatggaccgtccaactctccagaggaccacaaataggaaaatcgaactctgaagcagtccagctctagctcagatcttgtgacagtctgcatgcagaacagtacagcaaaattttgttttctgaaagaaaaaacggaacagtacagtacagcatcgtagctggaagcctggaatcacatgcttatgccctccctgcatccgatattccgatcgatctgtccaaaccccaaacctgcaggtgcatgaccggagccaagggattagatggccgttgttatatccagccggcacctgccactgacacaaataagtgcaaggctataattaccaatgcacaactaaccactcccttaataatacaatcatcattcgatcagctagcataagatcagagagcctgaaaaacatcgtcatatctgaggatgacactgacgctgcaccaaaccccgaacaaacaaacaaattaatcatcatgcacgcagggaacggaaaagaggcagcagtagctacaccgacttactcccttggtttaaaaataaactaacttttaaaaatgaatccgaacaaacatttatttatgagcctcactgaggtgctctcaagttataataaaaattaatttaaacatcttatttaatcaaagggtttagatttatttatactacaaccctagttagtggtagtagaaatatggaggggcattattgttagaaaaaatagatgcgaagggtataatcatcatttagcagtgaataaacttttttttttgccttttttgatgaaatatgagcgatactagtgtaatagactatcaatgatcgatttagctgtgaaaaaacttaaatgacaaagtaacttctaattataaaagtaaattactaatttatctcaatttacccttaataatactggtagtataatttatgaatttatctagaattattttcaaaagttattttttttttctggaatagagtgtgtattaccgttttcttttcactcgtctctctcgtgtcgttgtatcgatcggcaaaaaaaaaaacttgtggcgccaactcctcccggtcctggtcccggtccgacctattcgcgcgcaggcgagtcgccggctggctcacgtgcagagttgcagacatgcagccgcgcgccaaccaccgcgacggatttgccttcaattttgcagcttctctccccgacgataatagagacagtctctctccagggatttgcatatatccaagctagtagtgtaatactaagagtactagctagcttcagatgatgacaattcgcccgtttctccctgcttgtttgtacgtagccgatcgagctagtgcttaattaattacctagggacattctgttctctcagatagttctgagcaacattccaaaatacttttttaaatgggacatgagatcgaattaaccaaatccgatggatgttgccctgcagctagctagccattcctttgtcccatgctgcacctgatcgaatagtggagtaagtagtactgctgctaattaatcagctatagctcctgcgctaaatccagggcctgattgattaaacaaaccgaagaccgcccaaaccgtcgccattggatagatcacatgaatgcagtggctttatctagctcaactaataatcgcacaaacaagctcgaaaaaaaccagcatcatcggcattgtaagctaggagaaatgataaatccaattaagcagtaatggcgtgacccaaccaagatggagatggttggagctgttggtctgaatggggctaagcaatatggcagaggttgaatgctggaactgtttctctcttggtgtaaatggcggttggcaacatgcaattactagcaggagctccaaccccggcctctcaaaggcaacaggccacgagcaagaacatggtcctgcaaggaggaggcacagtccgtgcaacaccttgtgctttgattttaactagcagtctagtacactgtatgtactagtattacttttatcagatttattttggggaatcacagatatgcagctagcttaatctggagcatatttacagttacagacttacagcagcagcaacactggttttctgaaactctgtataggagcacagcatatctgaaatcccaattataatgttcttataatgttcagctcgtcacagcggccacatgcccacatattttggcacctttccccttctctccaaccaccatgcattggtctctactatccagtgccaacgcatccgatcaggccactgtcctggtctgatgcaaccatgcaggtatatatgccatgaggcagcctgttcttcatcagtttctagttcaatttgacaaatttatggtaccatatttgtatacacgtagtaatcgatcgtgacctcgtgagtatattgtcacctgcaaacgcaaggcagccatgcccctaaccgtagtgtcagtgacagtgtgatctcacaatcagtctgcgtcacattcacgagtagggtcgttagctcgtcttcaatgcgccgtatcagctacgtagcattgagcagctgacctttcgttgtgatctcatcgacccattcattcactcatcctaccgacatatgcttgcattgtactttctccatttcataatataattttttctagcattgacaacattaatatatatgttccccgcaaaaaaaaacatccatatatatgttaatgaatctaaattatgaaacggagggagagagtatatttgtttcgtgtaatttcgcagtttcatgttcatcatggcgcccgtgcattgctggttgggaaaaggcagaagaaaagaaaggaaggaagcaggagaggagaccggtgctaaagcagaggaattgcacacgaaagtttcataatcaggttgcctgaatctaaaagcaaagtaaaaaaaaaagatagtacataaatcgttcaaaatcaaacatgatagtatatcactacagttaactgctgaattgtgggtcaaaaaacaaacattagtcaggcgctgacgagtacctaacacaaaaaggatatctgaaaccgatgcaaaattcattcctgcaatcggctgcagcagtagtactgatcatggtttgttggtgaaagattgttcttttctgctgcaaagacgaaggaagatgaccattcttgcatccctgttccttttgtcgcctccgacctttcattcccacttttcacaaagtttttcttgtgtgttgacgcaagaaagagcatcgatgctttcctcttttcttttctttttcccttttctattttttcctagccttttcttcgctgtccaaatccaaagcgtagaccaggccaagtaggtctcccctccaaacaactttccaatttaatccccaaatggaagcaaaagcaaagcaatggaaatgtgatgatccgctccgctcccatggcggcatggagacatggagtggttagctcacacacctcatcacagattcacagtatccataatccatagcgttagaccgttagttaattagtagatagtagaagagtaattaaaagtggaaacaaatgatgaggagagatttggttagaccagggaggaggaggaggacgaaggagacgtagctttccatacatgtcatagccagcaataactcggagcagatgagaaggggagagagagagagagagggtgaacttggagtgggattctgaggccaatttattcgcgccctaaatacgcctacccaccctcccaattgcactactgctactatacggcgagagcggcgggtgtatgtagctttgcttcctcctcctcctcccgattcccgaatcgccgcggctcagagaagaaggcggcggcggcggcggagatgtcgtccgccgtgcgcggcggcgcgacgaggggccaggcgtggtaagattccctttcttttgtggtggttttgtttataccaccggaaattgcgttggtttcgctgggttttttttaattttttggggttttcttggtggggatgggtggcaggttctgcacgacggggttgccgagcgacgtggtgttcgaggtgcaggacatgagcttccacctccacaaggtagggtttcgtttcttcttgcgatgattgtgtgagttgtgtctgtgtgtgtgcgcgctctgttttttcttgtggtggaattcggtgaccgcccgcattgtgctcgacgaaattcccctgagggtttcgaatggcgcagttcccgctcatgtcgaagagccggaagatccaccgcatggtgatggagcacgaggcagagcaaccggcgggccagcggcggcgaaggaggaggaggaggagggggagtgagggaagcaatgctggagaggaaggtgatgagcagacggagatagaggaagcagaggaggaggaggaagacgaggaagaggaggaggaggggcaggcgttctgcattgcgttcccggacttccccggcgggccgggcacgttcgagacggcggcgaagttctgctacggcgtccgcgtcgagctcaccgcctggaacgtcgcgccgctgcggtgcgcggcggagtacctggagatgacggaggagcacgcggaggacaacctcgcggcgcgcgcggaggccttcctggagcaggccgtgctccggcaccccggcgaggccaccaaggcgctcaagtcctgcgaggagctgctgccgcacgccgaggagctcggcattgtcggccgctgcgtggaggccatcgccgcgcgctcgtcggccgcgtcgcgctcctggttcgacgacctcgccgtcctcgggctgcacatgtacaagcgggtgatggcggccatggccgcgcgcgccgacgtgaggacggaggccagggagagctgcctcgtgtcgtacgccaggggcaccatccccggcctgtcgaggtcgatgcggcggcggctcgcgtcggcgccggtgtcgtcggaggtggagcagagggacctcctggaggcggtggtcgccagcctccccgccgacaagtgctcggggcgcgtcgtcaccgccaagttcctgttcgcgctgctgcggacggcgcacatcctgcgcgcgtcggacgcggcgtgcgcggcgctcgagcggaaggccgcgacgcagctggagcacgccacgctggaggacgtgctcatcccgagctactccggcgccacggagacgctctacgacgtggactgcgtcgagcgcgtggtcaggcacttcctcgccgaggaggaggaccacggcgaggccgaggcgtcgacctcggcggccgctgcgatcaccgaggaggcgccggcgccggcagccacgacgctgtcgcggccgtccgccgtggccatggtgcacgtcggcaagctggtcgacagctacctcgccgagatcgcgtccgacgccaacctgaagcccgccaagttctgcgagctcgcgctggcgttgccggaccacgcccgcgtctacgacgacggcgtgtaccgcgccgtggacatctacctcaaggcgcacccgcggctggcggcggaggagagggacagggtgtgcggcgtggtggactgcaggaagctgacggtggaggcgtgcacgcacgcggcgcagaacgagcgcctcccgctgcgcgcggtgctgcaggtgctcttcttcgagcagctgcagcttcgccgcgccatcaccggcacgctgctgtcatccgccggcgccggggccacgcagacgcggctccacctccaccgctaccagcagccacggccggcggcgatggcggcccggcactccgccgacgccggcggcggccgcggcgaggcggcgtggcggtcgacggcgacgcaggacagccaggtgctgcggctggacatggacagcatgaggaaccgggtgcaggacctggagcgggagtgctccagcatgaggagggccatcaagaagatcgatggccgcagcgccgcggcgtcgccgcgccacagcgacgccggagacgacgacgccgcgtcggccgacgggtcgtcgaggccggcgaactggcggtcgcggtacggctgcaagttcagcacgcaggtgtgcgactcgcacgcgcgcaacgtcgtggcgtcgagagcgtcacggatgggaatgagcccataggcgaatcgtctgaattctgaacaaaaaatcgatgctcgagatgaaaatgatttgagaaatcatccaacgttgccaatcgaagatccagccagaaatcgccccatctgtatgatttcgcacgcttacgttgcatcgttcgtgtgcacgaacgccactgccattcgacacggaacataagggatccgtgtgtgttgtatgtatgtacgaaatgccattttgtagcctgtcatctgttacgtttcatgtgtgcttgtcgacttgctgtttgtacaaaagcagtcgcgtagatttgagttgtcagggtgtacaatacacgtgcaggtgttgccggcctcagaaagcacaagctacaaagttggatttacccttcgatccgtacatgaaatggatcttgtgccgtaaatagatccagtagaaatgtacagattgttgataacttgatatcgtcgtttttttttcctctggtgttctgaagatgaaggaacaaatgactctccaccctgagaagcatgcaaactgagagctgagcaaaatgggttggagcatggtccatggatggaattgcttcattaacatgccttctgtgttagctgtgtcactctgcatggtggcattatctctaccattcgattggactaactaaattgtaaactgaatcttttggtcatcgtaaagcctgaaatgtagcagaaagtaggcactctcgatctactttgcctgcacagtccacttctctacaatattcttgtactacaagtatttggtatagtgctatacttataacttatctggcatttctggcttattttgcaccgccactgatcgtgctccaaatgcatctgccgggttggcagatgtcccaactcccaaacacactccagcaacttttattttcctctcgagtgcccaaacctttgtgactgccttttcagtgctctgccgcaatctacttttgttgaaatgcactcttcagatataaaaacatgtaaacaatagtctgttggtgctatgtggcataatatatcacgacagatgggagacataccggtaaacaacgatgctttacccaacactcatgagccctaaacagataatgttagaatacagattgactttaaacggcatcatggattcatggctgtctgcgtttgttgtcggagaagcagcagaagaagttcagcgcatgattttgttcgttatgtggcttcaaaattcgaatccatggcctgctgccggactgttggcaatgccaagcccatgggccatggctattgggctaagaagctagcttagaacttttcttttcacttgcttcggtccatcccttgtgaggcaaaaagtaatggcttgtgtagttcaattcctgttggaatcgagagagaaaatttccacattccaaaggaggcttcagttgtgtaattcaacgaagtaggggatgtgctcctgcatattccagttatcctgtatattctgaactccaaatacggggtacttggagttccctccaggccactaataatacttcctccgtttcacaatgtaagactttttaacactacccatatttatatgaatattaatgaatctagacacatatgaatatttagatttattcacatctttattcacatctttatgaatatggataattcttaaaagtcttacattgtaaaacagagggagtacgagggcgaagacgaagctgtacgtgctgctgtttcagtttgtgtgtgcaactatgcatttttttttgtctgacgaaaccaacggcagcaggaggagttcagaactttgatgacctgacctactccctccattctacaataaacctcgtactagaatgttagaatgtgacacacgctaatagagtactctctctatttcacaatataagtcattttagcatttcttacatttatattgactagcaaaagtgcccgtgcgttgcaccgggtgattacggagtgtgtacactgacaaaaagtgttgtttggtttagacaactaatctgctaaaaaaattgtttgtttttggataaactagctgggtggcccacgcaattgcgcggctagcaccgatacagaattatctatttttaatatgattttatttataatttattcaatagatatttcattgtcttaagacattgaaagaccaaatcatatcatcccccatatttctaattttgtaacttttataaaaatcacatcagtgctaccccttacttttttgtcatcctttctttatttgtttgctcgatctaccatggcttatattcattctccttttaaaattggatattttagttttttgagtttattgtcttattgggttttatttttttatttttagaagtcccattaaaagctgccaatatacttctctacggcccatccgctgcttcctctctttattgtcattgggattttaaaaatcgaacataattatcgtttgagttcaatttttactttctagagtcccaccaaaccgtctgtactcctctacggctcgcccgcttattcccactctttattatatttgagattttaaaattgaatgtgattatcattgaggtttgtttttttttacttttttagaaatcccgccaccgtcgtgaccgtgctgcttaacggcatgtccgtcgtcactccttttaattgtcattaggattctatttggggttttgttaatagtttttagatgttccatcagctgtcaccactctactcctttacagcccggttacttcttcgatatttattgtcatttatcattgttgtgttctagatgattttttttgaaatttccatatttttcatcccgatagattttatttataaattatattcctagttgtttttattctattttcagaatttattttattaattatttggaattttaattaatctcgttatgtgttccagatggtgtattctttaaatagtctttattttttattatgaattttagttatttttaaattgcattccaagttgaactcttcttttatttccttatttctaatttcagattttattttatttttttattttaaattttaattaatctcgtattgggttcttatatatggacttgtatgaaatgagggcactatattatttttctgctgctgcagcctaagcgtgctggcctggtatctccaccctatatatgtgcggcaatgtatgttggtttagaatcataactctctatactgtacaattctgcaattgatttttctaaacggacatggactcctagtgcggattgtatgatctataattagattgatatgattatcttttgtacagtaaatctagaccattattcttttagtaatttcaaatttgtattcctactcgaactctcttttttcttttttttctaatttcagcaatttatttatttattattctgaattttaattaatcacgtattgggttcttatatggactcctctttcaatattgcttatttttaattccgaatttcagttatttttcagattgtatttctatttggactctttttttctttttctccgattaatgcgggaatttctagcctccacagtgaacgtggtgccttcttttcgagctgtcttaataatataaaagataatctgctatatatttgcggaatatatatgatgtttagtttggatgatttgtagcatgagagaaaatggatggacgaacaatgcgactgtctttgcctaaaaggcgacggatggaaatttgtatgatgaacggaacggagtgtggacagtaaccaaaaagtatattagataattaggatttagtttttcatgatatgagcccttcaaaaaaaatatattcttagaaattaaaagttgtaaatcaaaaaagaaaaaaaatgcccattagccctgacttttctggctcaagtgagcgaaccatgagtccatgatggcaaccactcggagcaacaacgatgacatcacaacacggccatgagcaatgtactcatgtcatccatgtctccggtgagccctggcaacagtggagacccatgtccgaagcgaagccgaccgtgttgcacgacgcactggtcaaagcgacagatgtgagggcgacttagtggagcgacgacgacgaagcttccgtgtggagttagctggtgccacggtgtaagagagggaggtgggagaccagcttgtggggaagacgggagccagacacgctggtgcggacgacacgtgcggcgtggcggtggcggtggcgactgaggtaggcgctctaatggcgatggcactgctcgtgatgtcgtgcgtggcgcgcctcgacgacaaggacatgggggctggaggcggcgtggaggaggcgtgggtggcgagcaggtggcggccgtcgcgcaccgatgaggtcaggcacctcatggtgcacgagagcatgcatgacgtggtcggaaatctctcggtttttcttcttctctcctcagcagacggcttgacgccctccatctccatccctccccatatggcggtgtcactccccgtggcccccttcccccgagctggcgacaccctttccccgagccggcggctcagccgtggtgcctacactctccctctccctctacttgcgaccctgcgccaaggctgcctagtgagcagcggtccgcgacgggtcggggagcagtagtccgtgagctaatcctctacgtcggcggctcttcttccacgagcagcggcgattcttcgcccctcgcctcctccctcgccatggggccgcgggaggactcgaccctagcgggcggtgtcaggcggcggcgccctcccttccggcgggagttgtggctgcggacaggggtgatacccttccctccaccggatccagcgggaagggaggtggtagcggcccgccggcgtcccaacggcggcgacggtgccatcccctcagccggatccagtgggaccggagccgttggcggttcggtggtaccctccccttcgatctagctgcatgggaattttcggataaaaattgtgtgtatatgcttcagttttccctgcctccgattctatttgtgatgaacttccgactgggattttttttttgagcggggattatgtgatggaattccgactgggattttttttgttgccgggggggggggggcggaaaattagcgacggacaaggtgacaatcggaaagttatgaatttttaattagttaagatcggtgtcggttttaaataaccgacaccattaattaattataggacacctgtaatacattataggtaccgttttcttgaaaaaccgagccgaatcttatccatccatccacagcggtgatataaggctggtttctaaaaaaaccaagccgagccggcagggcgcaccgaggagataaggccgagaaggtactggatttttctcgctctcattttactctctctctctctctcctctctcgctctcctctctctcagagctgaggcggcgggcggcgggtggagacggtgcagcccatcggcggcgatggccgcaccctcccctccgcggcagcggcgtgtggcaggaggagcggcagccgcctagagacgccctccctctgctagatccggtgggaggaagggcggcggcagcctgacagtgccaccacggcctcggggcagcagtgtccaaggttgataagtctctctctcggtctcatactctcattgttcctctctctctcgcgtctctctctcgcctctctctcacgaagcggctcactatggtgggcgacggtgacggcgccctcctctccgccagatccggcggttggggaggcaacggcgtcgacggcggcgtcggcgggcttcggctcccacgggcgacggcggcgggctctccaccgccagatccggtggcctctccgtccgcctcccctcgcctgcctctgcctctcctccattcggcgagcagcggtggccgacggtgtcctactgcttccgcctccggtgagcacccgtgccgacttgcatcctcttttttctctccctccatctcgttcaaccttaaccctatcttcgtttctagatctggaagaagctgatctagccgatggcgacgcgactacatgatttggtggtttttatgatgtttgattcaatgatgtaaaaatctgatgaacatttgatacatgaacttgttgttgatcatatgatgtgtagttttctctttttttttcttttttttttgattttgggaaccggcaccgaatgccttctctgtagtagtgggtttttttttgcgattttgtccatcgctaaccaaatcggattgggatacgattgacggatgaaaatacggacgaatcggagggtgacgaccggaaaaatacgaatatttatattagttatagatgttaatgaatctagatatatatatatatatatatatctatatagattcattaacattaatatgaatgtaggaaatgttataatgacttacattgtgaaacggaggaaataaaaaaaaatctgaacatatagtacgaggttgatttattttgaaacggagggagtagatgacaaacgatgagagaagacatggtgttggagctagcagctgggattctgggagtgtgtcgccggatctctttaaccatcggctgatcctgatggaatgaggaggcaaggaggcaatggccgccgtcggctcacgttggctccggcttgggcggcagccagttcgaagagatcttccggtcgatcatctccggctttggctgatggatccacggaagaacgtgatttgcaagctcggctccggctggctcgtgaggtcgaggtggcggcagcttcggcatcgaggccgaaaccggtgcatgtagcagcagctggaggtgtttctcttctggatgatgttggtgagtcgtctggttcccgtttttctgttttgcagaccttgcatgccgatgatacgtggccacatgtgtcttcgctggagagtgcttcgaagccttggagcgggccgctttcattaccaaggaagtctccccctcgaacgttaggtacggctatttctttggcgctgcaagggaaggtatcattggtttttctttccactgtttcttcttcttctccggcgagattccaatctcgtccggcgaatgttttgattcaaaaagttgcttcgtcttcggtgatgtcttctgactcgggttctcacccgacggtgactagtttggaatgttttccaaaacttccggtgatgtcaaattttgaatcgatcacaaacagtccaaagggccttgcttttccaaagcccaacataccatacaggcccacggctggcttggtttctctcttcgcaaaaactggtacgatacggcgcaaagttagggtgaatgatcaatctgtaaggtcgctacccttctcgtacgccgccgtcgctcgtctgccgatggagagaaacaaccgtcagggtcgtcctgctgtggggggctatggaaaattttctgctcgagggtttcaccctggttttggcggcggaaatcatcagggtggaaggggtcgcggacgtggaagaggttggttcgatggccgcggcggccgccaggatttttttcaaggtggaaggtggtttggaagtgccggtaatggacatggatggaacaacgggttcggtttgaatgcaggacctagtggtgggaattttgccggtagtcacgttggctttaaccctaatttagggtttcaacccttcggtaccgctagtgggcatggtgctgttgcagggcaggagatcttcaaaccgcttgctgggtttccgccggtgggtgctcctgttgccgctggtcctgttgcacaggttgggcatggtcctgtgactgacggtcctacaatacaaggtggagcttctactgcctttccgcccgctggtggagctgctgttgttggcgcctttccggtggctggtgggggtgttgcgactgatgccgcttttcctgtgcttggtggagcagggccacctgcagctgggacttcagctggaccgttgttgccttctggcggtggtgcaacaggaagtgcttcagtacaggcgactggtgggagtgctgtgtctgttgatgcgaaagggcaacccattggtgcttcagctaaggggaaggatgatgtgattgtttcagcggagggagcaatattggtgcttcatctgctgctgtgaaggctggtagtggagctattattgctttggccgatggaaaaggtgatagtacggccggtcctgttgcttctggtacaggaggtaatgtgctttctcttttgcatggtaacttgcatagtttggaacaacaaggggaggtaaacaaaggaaaggcaaaggttgaggtcaaagggtaaggcaaaccttattgttatagatgttatactaaagggcatacaatgcaggaatgttcttctaggttttactgtgagatttgtgaaagtgaggatcatgttgcttctcgttgcccaattttttggtcatatgttaaacctgttgctcagttacgtggttatactagagatggtttgggtttcttccatatacctctttcagctggaatgagggttaagcatgagcctaaagcggctttggttaaggtcactaaaggacagatgtctgtgagttctattatttctgagttggagaggttaatacctggtagatggaagtgggtggtgcatgataatggtgatgggacttttcatactatttttccttctgcagctgaattaagtcgtatggtcgaatggggcaatgtacacactaaagttggtgaggct

SEQ ID NO: 43071 - DNA, 932 bp, Oryza sativa
aatttggagtgaattttgagggttttttatcgaagtggatttttcagcctttgcttttagatcgctaagaacgaacatacatacgtacatatatatatatatatatatatatatatatatatatataggggggcgggcgcgcgcgcgggcgcgctgtctctctccctgtctaatgagccagagagagtgacagggactcacgcgcacacactcacgctttcacacacacacacacacagagtctgaacggaaccggagcgtgtgtgtgtgagagtgtgagtgtgtgtgtgtgagagcgtgacatagagacagagacgtatatatacatggagagagagatagagagagagagagatggagagggagatatgtatgtgtgtgtatgtgtatgtgtgagtgagggatacacacacacacacacacacgcgcaaacaaagagtgagagtgtgagtgagagagaatgtgggagagtgacgggggcgcgcggtctgagggacacatatatagatatatatatatatatatatatatatatatatatatatatatatatatatatatatatatatatatatatatatatatatatatgccactcatatggggcgccagggtgcccgggcaccatggtatctcatgcacacaatcactcacatttttcaaaatttttaaattgtgagtatatacctaattataataatttgattcatacatatacttatcagcaaaacaactcaaatttctctttctttcacaatccatgattacatacctatctaattatatgtatggatgctatagacctagaatcaaactctaacaaaaacaagttcaaattcagttcaaacttgctttaaattagttagtaaagtagttaatgttaatacctaagtaattgaaaaagtttcatactcttttgaattgggtatata

SEQ ID NO: 43072 - DNA, 20737 bp, Oryza sativa
aacatttcgaaacggagggagtaatagagaccatgcgagatcaaaattttgcacagctaatgctggtcatatatttatgccatcatctacgatatgtttccatgtgattgtggccgtctggacctttcgcctggccatcgatcgacatgatgtgcatggtcagctagtcactccgcgaccatactgtatgctcgggaagagctggagcactgaaaacaccaaattgcatggacaactgcaggtgacaataagcgatgtgatggcatgcatgttgagtgagacattccaccgctgattctgatgtttattctcagatgatccagtaggaatgacaatggcgtccatccactactcctccctccgttccaaaataagcgcagacatgaatttttgtgtctgactgttcgtcttatttaatttttttttaaaaaacctaaaaagcatcagtcacacataaaatactatttatattttataatctaataacaataaaaatattaattataaaaaaaattaaataaaatggatggtcaaagttgaacacggaaactcatggcaacgtttattttggaacagacagagaactactcttgcatcagctctcatatggggtcaaattcaaagaaatgtttgaaaaactgacgtttaattaccaaccggtaattatctagcaagttttgataattgtgaccgaggtttctttgttacaaaggctccgttccattctgattaagatatagtctgtctcaatttttgtaaggcatgtttttcaaactgataaacggtgtattttataggaaaactttctatacagaagttgcttaaaatatcaaatgaattcattttataagtttatactaattaaaatttaatcaatcatacgctgatgactttatcattttacatgtccttatttaatcctcatcttcatcactttgcaaacaccacatacttaattaactgttgaatctgttgatgagtggtctgaattcaggatcatcactatcagagttatcagagagggagatctgcaatgagcagtacgctgtagtactacatgccatgagttaattatgagtcgcatctaacgggagctggaccttaaactaaaagcccttaatttttacgcaaaaaagggggaaaaggcacattatttggataatgactagctggatgtagccagctgtggtacctgctgctactattttgcattgcaccaccagatcggctcgggtttgcatagctggaacaggaactctgccgttgcatttccagaaaagaaagaaagaaagattgggtataatcatcttcgccgaataaatagttctgaattttgaacatcagatatggtatgccaacttgcagcgatgacatcttgtatatagtgaaagcaacaaggttttttcacaaggataaagagtttggataaacaatagtcgttaaatcaaaatggtacattcattaataaaaaacataaatgaactaaacatatgggaattttgggagatcaatttctagtgcctcctcttatatattgagggcaaagacaatgaagaaaaaaaaaagaagctgccattgatttctctaataaacatataatataacttaagtaaatttatagttgggtagaccagtcgatatttttaaataaattaacttatgtcaaaacactcataaaagctaagctaaactaaaaaaacatatataaaatttcttaaatgggatcaacagttgcgtaaagagcgactatgtggctagttatttcgtgcaaaacgaaggataacagacaatctcaatggacatcatcgaactgattatctacaccacataaggccatacacaagaaatgctctttatgtttttccctcttccagatgctagctagccagcagcataccatttcagcaatcacatcttgatttcttgttctcttcctcgacaaaaactgtcgacacgcaacacagttactactttcatgcagatgcaggtaactatctgtgacaatcgcgttgctcgtacagctgcgccccatggccgcagcaaaaccccgagaattccatagtagaaaaaaggacaccagccaacgcgtgcagatgagatgatgatggaaaacgaaacgattctcccgtctctgaagtctgaactgatgacggagagacatcggcaattgcataagaatattagtggtagcagctagccgatccaatctttgtcaaatcctgcattgcacgactgtccatgaaccaaccattttcacttttaacctcgcttttttatcttctaccttatcctgcacctcttatccctgagcgtaattgatctgattgagtacttacagtatctgacaggctaatttttatcagcaaagaattagtctaagcatcaattgttattctgattctgaaacaagcactgaacactctctgaatttacagtcagtcaaggggcaagttggatccggcacatgacgaaaacaagctgagaatttgcgtgtccctccggtgtcggtacatccggatgcagcgacatgctggcagtagattctgtgctgtgtgtgattgatgctgcatcgctgaacaggaggaacatttcacattttcttaatgcgtgtgcttaagacttggacgctggaacaggtcgacggattggcagtttgattagggtgattggtgatggatccgataaacaagtgtcgttgtgctggtgtaatagtataatctggtcgtttgactacggggttggctagcctggcactgcagcctgcaggagtgcagggtgcttgcaaaaatgtctctggcgtctggtacagtgtactgatcatcttaccagtgtttgggggattgagatttctgcacttggaatctcatcttgcttgtcaatgttctgctaatcaagccaataaaatcgagtgaaaattttcctgtctagttaaaaatatattcccttcgttataaaatatagcaatataagatttgacaggacacgttttagtattataaatctaaacattcgtctgtctagattagcaatattaggatgtctcccatcatgttctaaattgttatattttggtacgtagtaatactgaatatcttttttttttcattggacgattgaaagcatgcagattctaggacacaaaatgaagcactaaggccattcccaacccaatgactaggatggtgtccatagcattaaataagttgccacctaggataaaaactatgtggcaagtgaataaatgagaaaagagaagaaaaccatgtcttgcatgagacttgatttctacacaacatccaagacatcatgtgagataagtagcattaaatttaagtatgaaatagtagtgtttgcattggaagagtagtgtctagtactagtttcttgatgatgtgaagtttatggaaactatatctagtgtcttgggttgggaatagcctaacagtctgtcagtttttatatcggtgtagtaaatcgattgatctactatcctgtcagagagtaatgggtgaagccagggtggcgtgcgtgtgaatatgtgatgaacgatgatgaactgggggctgaatctgaaacacaattcattttgccgtgctgagcacaagctcagctatccgctatgctgaatgaatgaatgaatgaatgaatgaatgatcagttcatccattagtcgccacgcatgcatgccatggtcagcctgaatccctgaagtgctcctcttaagtgtatatggcttagctcagcgacgtcttcaatggctagcttgggcgcatctcgcattcactccatgtaggaccaagccatggatgcgtcgagctcggatgattggagattaatttgagaggagtggttgggtacgtggacctgtggcgccattggtgcgtgggtcagtgggggagatgggaggaggtggaagaagaagaaacgctgcgatccgcacggacgcaacaaaaactgtcccagttatcattcatttcctgcagctgcaggggccactgccaatgatcaccatgtatgggctacctccatgattccatggggggttttcacgaaaccgctaggtgttagtttatgaaaaccggtcaatattagtcggttttcgtacggcgttgactaaaagccatcggtttttactagtttttttcggatttcggtaaaccaatgagatatgatttttaattcgaaatcgaaaaagttaaaccctgaatctccatctccttgttcaagttcatcttaattttttttttgttcttttttcctctcctattctcctctacaagatccgaaaccatttctctcatctatacagaagtatatccattccgatctagtatgtctgaataatggtgtatggacgagctaggcttgatgggcgttgcgagaggactggctggctggctggctgcatgtcgccagctgtacaaagcgccatgaaagcgtcgtcgcgtcggagcgagatcttgagcgacggtcagtcctgtactaacgtcaggactggggctgtacagctctgacattgtgtgtgtgaccatagttacgacatccctctcgagtaaaaacgcccatgcatagcatatagtaggactgtatgggagctttcaaccaggaagaatcctatgtcaaaacagtacggtacacgcgcatttaaacacatcttaataaccctgctaatcaaagtttcttgcgctacgcttattaatcaaggtccattcttaccagcatttgtcgcctcatgcaaaaaatgcgaagcgagatctcggcgtcggcgcggaggatccacggccaacatgcggagaaaatggcgcgaagttgcccagctttggctgctcctcatcctccgccgattttgtgacgttggacccatttgtcacagtttcagctcaggctctatcctcttaaaagctatagcccagctaaataatttcagctccgtaaaatgaagcagacaggtgaagctgggattaatcagcttcacttcagaactaactcttggtattaaatttagaaattgaagctttgctaaatagatcatgtatgcctctccctctcccgtccctacaatcatcatctcctttagacctttgctgctgatttgtttgctgccccctttgagagctaaggattctactgctaagcttcgacgccatttcctccgcttccaaaagctctggttagattaagcgccgctttcgcacgatcatgatcagcagcatcagcacgtgattcaattgctttcgccataaccattaactcgtgctgctgcaccaccaataggtacagtgtatcgctgattagctaggaggaattttttatggtacggcttaatgcaccgaagcagctagcaggagctagcaggactggacttttgttttttcacgcaaaaaatgatggttaaaaaaacaaaaggaaaaaaaactctaaattaattccaaagttaagcttatgcgccattctttttctgattatgatatatattttatctcagtttctgttagcatggtgttttatttgctaaatgatgcatttcgtacgaaaacattatatattaagttattttaaaaccttagataaatatatttttaaaatttataataattttaacttattaatcatgcgttaatggttttttaagagcaagtttaatagtataacccacaactagctccaatttatctatagctaatctaatagccaattcatacaataattgcttactatactattaatatatgttcccatctgtcatacacacactgtgtcttggagtccgtactacagctggctacagatctgtagtccgctcctcttctctctcattttttatctcattaaaatatgtttataacctgctattgtacctgctcttatactacctccatcacaaaattagttcattttttcacccgtcacacacatataccaatacaaaagtaaaaaagactaaaaacatctactttatctacttccgatacaattattctctatttttataaactttgatgcgatgatcactctaaaaataatcttattttgggataaataaaatgagctaaaaataaacttattttgaaacgaaggaatgtcctaaaacggcactgacaagtgggccccaccacggcatcgcgccacgcaagcagggatgtgcacacaactcaccgcgcactggtagcaaaatagactcgtagcaccctaggatgcgtgcacggtgtcacacacatttacgcgcgcgtactacaactactatagccccgctcccttgcaagctgtcctcaacaacctccaggttggcacgatcgcctcctcctcctcctctcgacactacccgacgcgacgcgtcctcctccccctcgcgtatatatacgcgcgaccgcacgccgcgctccacgcccaaccccgaccacgagtccccgaccgcggcgcgcgctcggctcggctcacccaccgccgcgccgcgtccgacgacgacgacgagcattcaaactgtgagatgggggcgtgcaactcctgcgaggcgacggcggtggcggcggtgaacgggaggtcggcgtcgggggaggcgacggcggcgagggtggtgctggcggacggcgcgctgcggcggttcccgggtggcaccagggcgtcgcaggcggtgaaggcggcgggcggaggcggcggcgggtcgtcgtggttcctgtgcagcgccgacgggctggagctcggggccgcggtggcggcggtgggcggcggcgacgacgaggagctccagcccgggcagctttacttcgtgctccccgccgctatgcggcggcggccgctccaggcggaggagatggcggcgctcgctgtccgcgccagcgccgcgctggtgggcgaccacgacgggcccctcgtgttcccggaggccgccgcctccgccgccgatccccgcgccgccgggaaggggtgccgccggtcgaggacgaggcggcacagccgtggccgcgacttcgtgcccgatctcggcgccattgccgagtagcacttgaacccgccgtctcgaagagaaatcgatcgagctaaactagcccagccagctcgccgcggcgggaagaagaaaaaaaaaacattagattagttacgtgtaaactgatcgattgatcggaggagccattgaccaaattaagttaatttagctaggaggagaggagtgtagcttagctgtcatgctgtagcctgtagctgtaggtaagcacgcaccaagtgtatatacactacgtgtacatgcacaaccacgtatgtacatgtggctcgccacggtggttgagaaagccaaaaaaaaaaaaaaatctgcacttgattttcccgacccaacaatccgacgcctcaagcctggatccctgactcgtggggcccacatcgtcagtgtcagcattcagcaagacccaattaacaggataactactgtgctgatcgcgtcggcatgtgatgtgagtcacccttggacgatcgagacggtgatacgatcatcaatctgtatctatctagcgtgtggtttggatttgttaatgactcggaaatggagacatagccgacgacgaggagaggcggaggcggcccgacacggggagacctttttctcggccgcgcgcgcgcgcgcgcccactgggatggggatgggatccgcggttgatggatgggtggttcgccgcgccgcgcgcgcgcgacgagcggcaacttgcagcttattttgcgaggcagctaaatgatcgatcgagctcggtgcttcggttgatcgatccgatcgggtgggcgcgcctaactcattccccaactgggccaagggagatacgcgttctgtacttctgtggcgtacgtgtgtacatgttaaggctagctgttaagggtcacgattctaacttacaaatctaactgtaagaaattagagtttgaagaagacatatgaagaatatagctctacttttctaattcattttgttaaagcattttagcttgaagtagcttggagctttaacaaacagaccatccaacctttccttcgttggttcccacgcgcatacttcataagcttgtgtgttttacgaaatttttctatagaaaagttggtttaaaatatcatactaatccaatttttttagaaaaaaagtcaatactttgttaaatatgtgttaatccactactttgttttcgtgcatagagaatgagttatcaactactacaaacgaacgcaacctagtcatatatagaaaaattaatcaaacaaaaagcaaatatttacaggtaaaacttttatatttatgtaatttgtggtttaaatacaaaaccttaactgcaaaatttaaatttctactagttgataagcttacggacagacaatgacatgccattaacatctttcaatataaatcctgtaatgctaaataaaaagcaaaaaagatattgctaggacaggactcagtatgtcagtcaacttcagccttagacttgtccaataaacgactgaagatgttgactaaatgtgttatacatctgatgagacttgactcaatttgttaggactctacaacatccgaattctttagaattcttagcaaattagataagccaacgaatctgatcgagtcaagtgggttaacctgcatgttggtgctgcagagataaaactgagataagtgcagtgcatatatgccttcgttctttgctgagctttatatattcgaacgagattacgtagctagtgttctcaaaatagattacatagctagacttgtgtttgcttcttacgcatgcccttttttttactccgtcacgtcctgatcgccacgcaggcgtatcacatatatccattggcggaagcgagtttcagcgcggggttttgtcggaatacattctattcccaaatcttttttcgtggacttgacggttcgaatcgatctcgaaccttgacgccacagtagcacacagaattgtggtcggcacttggcagggaaaatttcgcaaaataataaaataaaatccaatgatgtagctactgttaagctctaatgaactcactttgctaagctaaaaaagcctcgtctttcactcaggcttatgcttagcggtcaaaatttaatttttctttttttaaaccccgcggggtgtatttgtattaaagtagagggaaaaactgtacaatagcccagggggctaggagattacaataagaaaggaaaaagaaagcaggtggagggaggtgcagctacaaaggaggggtgcagctgatgagtctaatttacgtaatgtcggttatgcttccatggttgtgggtcgttagacattggatgccctttgccccgcttacacgctagagccagatctcgtcgatcgctttctcaacgattccctgcgtcgctgtctctatgttcttgaaaaccatgttatttctctctttccagatttcccaggatagtaggataaggatcgatttggcacccttccttttctccttaggcattgtactaacggtttgtgtccaccggtcctcaaggattgtcgttttagaccagttctgtggtcttagctgaggcatgccgagccttgttgctatggcatcccagattttccttgtgatcgggcattcataaaagaggtggtgtgccgtctcgaggtttctgaagcagagctgacagaagtagttatttggccactccctctgctgaagtcgatcggccgtccaaattctgttttggaggagtagccaggcaaagaatttgcacttcgatggtgcccaacatttccatatcatatttgctgataccgacggtatgccccctaggaactacatttggtaagctgattttgttgtgtagactccacttgttgtccatttccatcgtatgttgtcttcaatgtcttgggttagtgtgatgcctgaggtccagattatctcgaagaccttgaagaaatcggtgacgaggacagttgtcaagttgtatcggatgtcatcgatccacttgttatcttgtagggcttctgcgaccgtccttttcttttttctagcgtggtggaagagattgggtgccattgctttcaaggtggagctgcaagcccatggggattcccagaagagcgccttcctaccatctccgattgtcactgacgtggatgctgcaaagagctcgttgtcctgttcatcacagggtgttggcatgccgatccatggcttgtcgggggaggtccattcataccatagccatcgcaggcgaagcgcccttcccatcttggtgagattcgagacccccagaccgtcatactttaggggcctgcaaacgcgctgtcagttcactttacactttccgccattgacttcatcgccaccgtcccagaggaattttcttcttactttgtcaatttcttgaatgatttgctttggtattttcagagctgtcatggcatagattggcatggagcttggtactgatagtactaactctcttcttcctcctgccgagaggagctttttcttccaactggctaatcgtgccttgattttgtcaattaggtattggcgatggacctttcggagcctgcttatcatgagtggcatccctaggtatcgcattgggaatgtcccgcgggggccagtaaagttgtgtagcatttcatcaaggtcaatttcaccacagctgattgggatcactgagcttttgtgaaggttaaccagaagtccagtagcactcccgaagttattcaagatcgaaatcaggctgtccacatcttgtcgtgatggtttgatgaagattgccgtgtcatcagcatatagggagcatctgaagcgtgcactgcggtccgctaggtcactgaggaggccctcatcagttgcaatcttgagtagtctatgtagggggtccatcgcaagaataaaaaggtatggggataggggatccccttgccttagccctctatggtgatcaattctttctccctcaatcccatttagtgcaaccctggaagaggaggttgagaggattaaagccacccagtctcgccatctagtactgaaccccattttttcaagcagcgttaggaggtactcccatgagaccgagtcgaaggccttggcaatatcgagcttgaagaatagggtgggctgcttggacctgtgcatcttcttagccaggttggagacatagaggaaattgtcctggatgcaccttgttatgatgaacgcactctgagcttgtgatatcactttgttaatttgtctggataggcggattgccaaaatctttgcaaggagcttcgctaaggagtgaattaagctgattggtctatagtcgcccatagtgcaagcatcattctttttggggatgaggatgagtgtcgctctgtttatactcccgaaatttcctcccgataaggagtggaatttgtcaagcaattccatgatgtctgacttgataacctcccagcaacatctgaagaaggtgcctgtgaagccgtctggcccaggtgccttctcagcaagcatccgtttgatagcttcccaaacatcctcctcggtgaagggggagtcaagatcttctggcgtcacctggggtaggtgaagctcctcccagtttagggtgcaagagcgagggagtcgctggcccatcagagaggagaagtgttcgtgtagggcacgctctttggcttcatgagtttctgggatgacgttgccacggtggagtttgtgaatgaagttcttccgatggcacgcattgactttcaagtggaaaaacttagtgtttgcatcaccctctttcagccatgttagtgtggatcgctgtcttctccttgccttctctacagcagcaagaccaagaatctgtagctttagatcttttctgagggagatctccaagggcgacaatgctctgttttcttgtgcaatgtccaaacggaggattagctcatttacgagatggaattggatgcgactgtcacttaggatgcgattgctccaggaccgtagagccttggctgtagctttcagcttggaactcaagcgcttgacagggtgagaagcgctaactggctgggaccaagccgtctggacggtgtcaaggaagcccggcggtcttggccaaaagttttcaaatctgaaagttggttttcgcagcagctggtgtgttggtgagagcaacagggggcagtggtcagagttggaggaagagagagcttgtaggttgtggttagagaagagcatatcgccatctgggttacaaaaaatccgatccaacttctcgagggttggggcatctctctcgttactccaagtgaatcgtctattttgcagtcttaattcacggagttcacatctatttatcgcagccttgaaccgccccatcaatcgacgatcaaggttgaggttattcttgtctcttgcctcataaatcaggttgaagtcccccataatcagccagggggtctgtcctgatggtgccacttcgcacatttcctggaggaagttttccttatcagcgtcatccgtcggtccatagacgttggtgaggaggaatgccgtgtttgaggaccgttgggtgagacggactgagagggagaaatttctgatgttgatatcactgtgctggaggatatcatccatcccaaaaggtagctgctcctccacggctcccatcagcaggaaggtagctgaaattattcagtcttggacccccaatttccgaacacattctttggtccatgattgccaattttgtatgttggaggcacatgatggatatgcggttggtggttgccacttcgcggattgcttctctttttgccgggtagtttagaccccgcacattccaacacatgatatgttcactaatcattgcacaacgagacaaccattctaaaaaggcagcgtcttataatctcagcatttgaaccaatacattgccacagcagtagccaaatactagttactatcctgagcctcacacagactagaggaatgcactgcttatttcttattagcccgggggcttaaggcccgagccggctaatagagcaactactaggggggagcaaagggtgtgaagcacccctgacagcccagcgctaatctcttacaacacggacagtgactgactaatatggggatggtcgcgctcctgcatggtgatggtgagacgcacgcctaagccgtgccggtggtgatgccatcctgtccggcgaagtccgacggaatggaagctgggtcgtcgaggcgggtgaggcagcggaggccggcgatgacatgtggcggcagtggcttgtcgaaagccttgacgaacgccgcaatcgcctcgtcgttgaggtcctcctctttgtcaatgaaccccatctccttgaggaggcggccttcggtgtgcttggagacgggcaccgagaaggggcgtgctgcctgtctcgcactgtgcctagagggcaccatcttcaccttggagcggccacggcgtgctggagcggggggcggcggctgagggagaagcggctcgggtagaggctcgaacaggcgaggtggcgcaggtgcgcctggaggggcgatgtgggccaggccgtcgccctcgtccaggtagcccaccacgtcgggcaccacctccttgctggcttgggccgccatctcctcctgtgccgccagctcctcctgggcctcaaacccggactgggcctccagcagaggatgggccgtaggggcgctgagtgggattggaggaagcttctgggtagcttcctctaccccaatcgccacctccatcgtcatcgggtcaatgctgcccaggcgcatgccatccatcgccgcagtagtctctgccaacatctgtgagcaaagttgcagcgagaggtcagagagcacagagagggttagggttagtggtgtagctgtcagtgtcgtcggtcccccccctcgagaagcgcgaccaggcccaccgccttgtcgtttgtgccgctgcggcgacggtggcgtgaagtcctggcttgcggcgatggagatctccggcgggaacaacgacggcttgctgagcggcggcggctcgtcgaacacgagcggcagccacgatcccggccggcaggtgggctcccgtcatcgtccccgtccaccgcgtcggcagcgcatccacggcggcggcgggaagggtggggggtgcggctcctgtggcgagccccatcaggttccccctgccctgacgacctgctctggcccaggagagccgcacgccaagatcggcgtcgtggggcgcaaccagctctgtcgtcgtcgtccccgtcgtcgttcctgcgtggagcgaccatccggcaaccctcggccgcctccagcgttttcaactttaaatttggagttaattttgagggttttttatctaagtttatttttcagcctttgcttttatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataattaggtatatactcacaatttaaaaattttgaaaaatttgagtgattttgtgcattagataccatggtgcccgggcaccatggtgccccatatgagtgtcatatatatatatatatatatatatatatatatatatatatatatatatatatatatatataaaagttttatttataaattatttttcgtttggcttcttccggataggtctctaggtttacgtgggatttttctggagggagacaccacaaattgcaacattagtactgttggattggatggatacttgtttggcatcgatcaggttggccacttggccacagtgacatgaaaaaggtgtactaatgacggacaaggacgtgacgtggacgcctggggggtcgtcattaactcgaggttaaagctcggaatagcatcgttgggtgacgaggcgatggacctctccgcgctgttcatgatatatttcaccgtcgctgactagtggccccccccccacccacagtctcgttccccttcgcctccggtctccatcccacccgcccgtgtgggggaccgtgtgcagtgcgacccattgggttcggactcgggctcgacatgattttggccggctgcggcgtcgatcgtccatcatcgcccatgccgtcgcgcggtatttgcgagatttgcccctcaacatgtggtaggatttgctccccggaatccggctaaaacctcccattaattgtcgagccatacgtgacgttgttcaagtgatgattcgtagttactctgaaaataatcaatttctgaaaataaatctggatgagtatctatctaattttacgtgtggaagttagtttttttttaatgaacgaaggaagtacattacagtttagtccgagccatctctttggttggcctgcttggcatttgcccgtacgtgctgctacggtgtaaacgtaaacgtgaaggaatggaggttgcgagtgagtggtcccccgttcgggattgttgccggcggcgggcgcgccacgaggatcggtgcgtgaaatcgggagcggtctcgtcacttgttcctgcttgatcaattcaacaaaaggggagagagaggctgcagtgcagacggggcagggcttggctggcgtcgtcctcggccagctgcttgcgacctggaacccaattcaccggcagtggagcagcatatcaacctcctgtacgccttcctgcaaccggtttccttgcccccacccccaccctggccgtttctactgctcctggactccccctccctagctcccaggtcccctgcactttatacctctgcatttttcacagcaccagatgcaatccggatgcttaattagctaacagcaggtttatttttaccatgctggtttgttgttagacttctactgctacatgaatatatacacgttagatcaggggtccttttcggcctagcatgcagagatgatgaactgcggaacgcacgctgcatgcatactgtaacgcgcgccgtccaagcttagcttggccatgcacagggtacggtgttagtggtggacagcgttgcagatgttgacctcatctatctcaccactccgccgagagagcgatgcctcgacgggaggatgacatgattcaggtggctagctagcgagtactctagttgaatactactactaccctgcttgcatctgcatggatcggcaagagtataccctgtttaattttccgagattattttacggtggaaaaaccaaaaatttattttcaaaagttagtcttttcgagcagagggagtactcctaaacatctttagggaagacgtaatgtgatcgagaaagatactggtatactactataactgaatgggaaggtgtaaggtgaaaggtgaaagggagtatccaacatcgtcgaacaaacgtgttcactcagaatgtacgactactactttggctagctagtgtgtcgcatgccaagcgtacacgtcccaggtatggcggacgcaccacattgtcaatcagttcagacttgtgagtcaacatcagaggtactacttaacatgtgatgtgaaattgtgaacaatggtaagtttcacacacacgcggggtgggtgcaactgtgcaaatgtgctcagattatgcatttgtcgattctgacaggggacggtcgatcagtcacagttttctgaatggtgctattacgggtatgcttgggtttgacttgaagttgggccggaaatgtgagtttattggaccctatcacatactcctatacaatctctacgaaagcgcatgcatgttcacaaccattgccaatttgccatactataatgtactacagcatagtctctccgttcttaaaaaggaaaaaaaaactaatttctatgaatgaatatatgattatccagattttcatcctaaaaacttattcttttttatatgaagagcatagtatacactattacaacactagcttgagaatagactaatcatatcatgacggaaacctgaatggtttgttgtttatttctactgttgatgaggttagggtacgagaaacaagaaaacaattagcatataattattttatttttaattattataaacttgaaaatatatttatctaatattttaaagcaactttcatatacaaagatttcatgcaaaatacactatttagtagtttgaaaaaacatgccaatgaaaacaaagttaaaatatatcttaattaattggaaaagaacatgtttaatcatcaggcgtgcgatgcatacttgatccaacggctaaggaagtactacatccgtctcaaaataagtgcagctgtggaaatccgtgtccaacgtttgaccatccgtcttatttgaaaaatttatgaaaaattttaaaaaaattagtcacacataaaatactattcatgttttatcatctaataacaataaaaatagtaatcataaaaatttttcaaataagacgaacggtcaaacgttggaaatgaatagtgcaaaacgaatcttagctatgaatctagacatgcacttgttcacgtagatagctagaattgattttttttggacgtagggtgtacgctacagacagtggacgactttttgttgattagaacaagatttggttagacttataaacttctgacatgtaattttatgtaagaaatgaatttgtaaaatctaataagttatgatattgtgataatactttttatacaaatttaaggaaaatatccggcggaaacgtgaaaattaacctatgaaaattagatctaaaaattttatacatttataaaaaaaattatgtataaacatgatatggacgtgactccggctcgggcgtccgatgggaggagattaaaatcgggcgctgacgtcagctcccgatttacgtgcaaaactactttaaactattttttttctcttaaattacttatccaaatcatgatccgattgctccatttgaattcgtttcaaaacaagaccacacatggatatattccgacaaaaaaattagcttattattgaattatttttaaatgttgcacgatgttccaccaggtatatcggagttgtttcactaagtagatcgaaaatgtttcacacgtttaaatcgggtgttgtttcaccttatataaaacaatgtttcagcaaataacaaagaatgtttcaattcactgcaacattagatccatacatagtgaaacattgtgagtacactaggtgaaacatttttggtgaaataaaaaataaaatgaattcccttaatagagggttttcaaaatatgtgggtgatttgttgcaatggaatatttcagttcactgcatcattagatccatacatagtgaaacattgtgagtgcactagatgaaatatttttttaaaacaaaaaataaactaaattctcttaatagagggttttcaaaatatgtgggtgatttgttgcaggtaggggcagggactgtggtgggcccagcggcatgcacgggcggccgtgcggggggcggggccgggggcggggggagcgtccgatttttgctcccccacccggtcgaccgatccctatcattatgggcatgatattaccaccaaatcacaagtccgacttcatcgaagaggaaaaaaagagataaatttcaggcatgttcggttttcagctcctccatcctgctgcaaaaacgatcataaccatgttgggccgtcagacctaaccttagcttcatacccctagttcatatagctaggccatgtaaggtccatggttattcttagcccaagccaggatgcacgtgggccacaaaatttgatggcccagcatggatcgacgcccggtggcccatgttgcgcggtcgcgtcgccgccctccccccttctcccagacccagcgtggcggcgccgccggccgcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatggtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctagggttgacactctactgatgattatctcgataattcctgtcagatgaaacagttagcaaatttgaaatggtgtaggtgtataaaaaatgctaccaaatttacttatttacattgtgaatttattggacaactccaaatgtacacttgaacttcctcgtaagtgatctggaggtaatccagatgaaaaattatgaaaaaaaactctctgttaccatcttacatgtgtgttccacgattttccactttaacatttccatgatattttttaacacctttaagatgttctgatactccctaaccctttctattctgttcttgaatgcactgaagttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatggtgagaatcgcgttgctgtaatttccttttatgacctggtttggtagagatggttttacatgcttttggtaacatactagcattatcaaaagcattgatatcttatccctatgatgtagctaatcccccttgaaaaatgtgttatttaggtggatgttattgttacaactgctggtggtatagaggaggatctcatcaaatgtcttgctcccacttatagaggagaattttctttacctggaacactgttgcggtcaaagggattgaatcggattggaaatcttttggttcccaatgataactattgcaagtttgagaactggatcatgccactttttg

SEQ ID NO: 43073 - DNA, 25103 bp, Oryza sativa
  unsure (1)..(25103): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaacacttcagtttcagctgaaggacaacttgagagagcaatgggatgggcttgtgctggtccaaatacttctggagcaggcagttcaaccacaaaggcttcaggaatcccatctgaatttcatgatcatctgttaaaaaggaggaaattgctttgggtcatccaagaacaggcatctgatcttgctaacatctgcacatctgttttggagtttgaaggatcgagagacggaatttaccttattcctgaggataaatcttccggacaatctactgacagaggcaggacatggcagcaaactttcttgaatctcctgacacgtctagatgcagcatatcgttctttcacatgtaagtgactactttttcgcacttctattgtatgtatgtttagatcaaggacccccaaacttgttcttgtgtcaaaactgcccaagatagcttgccaccatgagatgcaggcatatacaggcttcaatgaatcatcctactgcttttcttttttcggttactgttttcagtgttattctgtataagacatcagtaaatgagtgtaggccaccaaagtattgacagaatttggatgccgtgcacctgtcttagttcatcctgctttatgatacgattttctcgtgttattgtaacagttttatttctgcttgctgcaagcaggtgcagaacaagagtggaaactcagtcagttcaacatggaaagtgctgggaaaagcttgtattcagtaaccaatcagctctctgtagtctcttcgagagcaaaatctgctttaggtctgccatctactcatgactttgttgctttgtgtttcttttggttaaataaatattctttttgttcctcatagagtgttctgtctatattttcccagttaatctacaggatactcttgtgtccatgtatgaacgagcttctgaagtcactgcatcattatctgggttcaaacatgtttcacaggatcgcactgctttgacttctgaatgtggttcgttactagaggaggtacgtgattattaaatataacctttccacgcacaaaaatcttgttggaatctactgtgagtgcataggagttgctacttatgaagtcagccgtttgttttcagctgtgcaactttgtaaatgattgtgaacactttggtggttagactttagtttacgagctatatataatttagctattttacacataaatctgggaaattagatattttatctctggttttgtcaatttatgcacttatgtccctttttagttgttcatggtgatcaaatccaaatttttatctgtagttgttgatttctgggaattctttttgcaggttttggcaatagcagaggggttgcatgatgtatatatcgtgggaaaggaagctgctgttatgcacaattcaattatgtccaatctttcaaaggtttttttcactgttacgctttgttctattgcatttcctttcctagatcaatatgaacacttggtcccgcaatttgaatatttggtcctggatactcagtggcagcattggacctgcaccttttatgtgcatatgctgttcagacttccactgagaatcccattgtaatattaaggctggtatattgatatgtgttacttgtacattcccagatggccagaactgaggaatgcttgacaccattagtgtattcggattactagaaattgtttttttttcttctgaggaaaaacttttcttttgatgtttgacaggcaaacacaattttacttccactcgaagcctcattgtctgctgatttagctgttatgtctgaagcaatctcaaaggaaagagagaagaataataccagcatgcctcttattcatggaaaggcattataccaatcttacattattagaatacgggatgcttacaaaaatttagaacctctggtgcccccacttgctgacgatgcgaaggagttgcactccttgatgactaagcttggacgcctttctagtattcatgcagggagccttcataaggtacttaactaagacccagttactctgagttgccgttaattatttagagaaatcttttttaattatttgcatttcaatagcaatactccctccattccataatataaggcacaaccactttttttagatgttccgtaatataaggcatgcatgcatatagaccattaactatgacctcttctccattaaattattacttttttaaatcctccactctcatgttctctaattctattggatgtatgtattgtatttattaggatgatccaaactacaagatgataataattattttcttggtctttgggttaggggtgtgtcggtgacatgggaccgggagtattatgacttagagacttgaggcagacacgatcacccacgtggcctaaccccctcgggggggggggggggggcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacgacagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagctttttctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtcgaaggatctgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcttccgccaccaagacctctggcgctgctaccaccggctccgtgtcgtcaaggcggagggcgcggcgagcggcggctgttgctcgccattcggccaccactccttcgtcagcgcctccgacccaggaagatctgcgtggggggccggatgcccgcatcgatatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgatgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacctgcatgcagtccagcgaagggatgatgagtcacttcgctcatacattcagcggttctgtcaagtccgcaacaccataccatgcatccctgcacacgcggtgatttacgcgttcagggggggggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaaggaggccgacgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccctggcggttccttccggcaatcggcgaagtgaggccaagcagaaggcccccgccgaggacattgatgacggcgatgatgacctaggtttccaagagcctggggccaccattgccactgtcgatgggggagcgtgtgctcacgtttctcgcaggagcctcaaggccatgaagcgagagcttctggccgcggcccctactcatgaggcgacacgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcgttgatggaggagcagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtacatggcgacctcaaagtcgcgcttgcttgtatggagcagtgcgcggaccacctcgccgccgcgtccaagcccgagggtggcgacgagaggcttggcacatccgcccccgccgccccgaggcagcggatagtcacatgcgacgaggtcctggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgacttcaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactaaaccccgataagtgcgtgttcggtgtacctgcgggcaagcttctcgggtttttggtctctgcccgaggcatcgaggccaaccccgagaagatacaagctatagagcggatgcgcccccccagcaagcttagggatgtgcaatgcgtcactggttgcatggccgccctaagtcggttcatatcgaggctgggagagaaggcgctacccttatttaagctcctcaaacgctccgggccgtttacttggacggaggaagctgaacgtaccctcactcagttgaaggcgtatctcagctctcccccagttctggtcgccccggagccaaatgaacccttgctactctatttagcggcgaccccgcaagtggttagtgcggcattggttgtggagcgcgatgaggacaatcctcattccgcgcacccccaccctgtgctggcttggcccgggagagagcagggaggagaggcccccgagccgaacggtggcctaaggcccccgacgaccggagcaggccctctgcccgcttgtcagacggtgccaggtgtccccgacccccaggatggcccgagggccactgcgggaaggccgcacctatcgccctctgaccccgaggctaaccctgtgccggttcggccggggagagagcagggagaagaggcccccgagccgaacggtggcctaaggcccctgacgaccggagttggccctttgcccgcttgtccaacgacgccaggagcccccgacccccaggacggccccgaggccactgtgggaaggccgcccctgtcgtcctccgaccccgaggtcgtcggcacagaagacaagtacgccccgcgaggccgcttggatgaagagtgccccagggacgtggcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagttcgatttacactttcaaccatgccacgctatcaagagccaggccctcgccgactttgtggcagagtggaccccggctcccgagcccgtctcagtccccgaagccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgggcgaccaataatatggcagagtacgagggactccttgtgggactcagggtggcagctggactggggatccgccgcctcctggtgttaggcgactcccagctggtcgttaaccaagtctgtaaaggagtaccggtgctttgacccgcagatggacgcttacgtgcgccaagtacggcgtatggagcgtcattttgacgggatagagcttcggcacgtgcccagacgggataacacggttgccgacgaactcacggctcgcttcctcgcgagcccagaccccaccgggcgcctttgaagaaaggcttgcccagccgtcggcgcgacccgaccccttaggggagacgggcgcgcatgacaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatcaaggcaaatgcggatcccactccgcctcacgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatatcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcacctcacctgcccaccccagaagcaacggccaagtggagcgcgccaatgcggaaatcctcagaggccttaaaaccaagaccttcaacatcctcaagaagaacgacgattcgtggatcgaggagttgccagcggtgctctgggcgaaccgaaccacgccaagccgagcaaccggggaaacgcctttcttcctcgtctacggcgcggaagtggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgtatattcttatttctcttatatctgtatttcaataaaagtattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagaccatcctcgtctcatacacaacaaatagaattgacacaaaaaatttttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgacgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgctccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacagcgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcacaggcggcttcgtgcaccgctagtgtgacctcccgaatagcaacggcggcctcgcgatccgccaggtccctctccacggcgcaggcacactcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgtttgcgacggccaaggcctgcagaaggggttctgcgctcagtggaccagcggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgcgagctgcttcggaagtcgtcatcgcctcggcctggcgaagtctagcctcctcccgagcggcttcctcggtctggcgagcccgggcggcctcccgagcggcctcctcggcttcccgaaggtgatccgcggcttctcgctggtcagattcccgcctccgggcctctgcggtcgccgggtcctcggcctcggactggccggacttggaatggcgggagggacgcgacgggatctcgctgaaacagaagaaagatcagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggggccatttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccctgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgactccctggtgggtcctcatacagtcctcggacccggtgtactcccaggcgccccgggcgcgccgctggagtggcgcgatccggcgacgaagatagtcaccgaacaccatggcccctgtgagcccttgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtgcggtgaagaaccaccggaacagccgaagggatgggcgcaccccgatgaacatctcgcacaggtgcgcgaagatggccaatgtcattaccgcgttgggggtgaggtgcgccatctggagattgtaaaactccagaacatccatgaagaaagaagaaaatggcggaaccagccctgccatagcaaaagggaggaagaagacggaccgccccgagtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcaaaggtagggcacaggaaacaaggagttagggcacaagcggcgaagacaaggggaataatggcgagaggaaggaagcaaatctcttcctcggcgactttatacccttgccaacgctaagcccggctcctcgtttcttgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccagctcgtcccgattcgcgtgttactcgagtaatgtggcagtcttgaagagactgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtattatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggctgcgcggtctcccggtgaggagccccacgctccgtcagggtggttatgccttatattttggaatggagggagtaatatattttcagatgcttgatctgatttgagtattttagtcaattttcacatttctttgtgacaacagcaattaactttgtggatttacggagcttccttgcttggggacagagccttgaggatatgggtcatagtaccctttgaaatccttaccactttctggaatacatgtccacctgtaggatatttaatttggaaaagattgaaatttttataatactctaaacgaaataataacgataatttcgatgtaaaatatgattcaaataattcaaagatatattgattatcagattgaactgcatgatacttgagaatttcgtcaactcaagattcaaacactgttgctttttcttggctatgctgaactgctgcagaatcaaccatggaatgaattttatgtttttctattccctccatcccaaaatatgattttcgcggggattaaggtgagggatgacagtaaatgggggatggttgtgattggttgagatgaggaagtagctggagaaattaaatgagagatgattgtgatcggttaaatgagggagtatgtagagaagttgctatattctgagacaaaatttgaacgatacaaggtgctatattttgggacagagggagtacttgattctttgtttaggattaaaattccaatttaacaaaatgtctccagaagttcattcatcttctcttttccgcaggctctagaagttcttggtgaaagtgaaactgtgaagtcacaggatatgccttcaacacatgcagatattttgcagagtgattcatcaattgagaaggataaaggttcttctgggagcagggaaggtggatctcaggatttagtaacgaccactgatctttctttacaagatgaatgctggatttctcctcccgaacactcatatacaagcagttctggatataccacagagttaacccagattacttcttctgagaacatagagaatatggatcccttattggttgacaggcctgtgatagaagctcctggtgctaatgatcaggaaagaggggctgattcggaatcagattcaagtagcaataagcagttgttcataaacaatgttacattgacgaatgttaatagtgttgatgaggttgaaatctcattgtcaaaggagaggaaatctgaaaatgagaatacaaatttgccattcaaacagattagaggacaagaatgtgataacagtgatcctaaatcctatccagattctgtgactcgattgacaagaggtaaaatgaacaatagtaggtagttagatatatggtgctagatgttgctatttatttttctaaattattttgtacttcatagtaggctgccgtaaaacttcctttaagtaatatatcatgtttcaaacacttcctttgagatttacagcattgccgttttgatctaattgtgtctgtcagcaccatgttaacaccgtacagattatcctccaagaagggagaattgcatatactgcagaacttgattatcaatcttttttgcctagtatgtaatctaagtatctattagattttcatgagaagatcaatgcaagaaattaatttaatgtttcacactaaaatcttcacaaattgaaactgaatattgtaatcattttaagactatgttttcatagtgctttgtctctgaacctctcgtgaagtgttaggattccgaagccaagacaaactttgtagctaatgctcgcttgttctttttgatggccacaggtaaaaatccttttgctttgtccatactgaagcaagtggagcataagttacatggatgggatatagatggcaccaggtgggcaattaagcatcttagtaatcacccaaaaatgtcctcgtgttctccagtttattgatctactgttccttctaggtccttgaaggtttctgagcaagttgaccatcttctcaagcaagcgacaagcattgacaatttgtgcaatatgtatgaggggtggacaccttggatatgattcaaagatacatgtgaacatgtctttctacgatttgttttttccaggtatcaactgaaaatataagatccccctataggtttgtttagtaccttgtgatagaaggggttgtccaaacagtaattaattttcagatggaacatattgctgtggtcatcattatttggcatttcttaaaacctagataagtcagtgccagctaactggccaaaaagaatgtcatttaaaagggaactgcttaactgccagtatattagcatattcaactacattcatttacaaaaattatgtaccagactaacggttcatacttgtagaagagtgaaacacgctggaggtccctaaacatgtgccattgtcttacttaggtcactatacttttggtatgatgttagccttttcatactccatagtatattaccgtcatgaattcagatcaatgatttagttagtcaaaacaagagagaaaagaattccaacagcttctcattgtttgcagggcaagctgaagttgagatctgaatgggcataagttattacaatatccaccttttatttgcctagttaagtgtataatacctttcctctgagttgatatctccaattcctacgttagttcagtgacaattttaacacatgtataactttctgtcagtatactagtcaactttctgccaaccattttcctggatcactgtcaatagtctggtacgtctccccacgtttatacatattactgctttccctgctttgggacttttttttttaattcgacattattgattttaagtttttgtgatataactttgatcgctacttttatatacttataacaatactctctcttttacttgacattttgacttctcgtagtcaccactcaccaatatacagctgtaatcattctcttttgcaatttttaatttttaatgtatatatttcatacatctattctgtacattttttgctatcttgatgatcaacatttggaaagtttgatggcatgtattctattctaggtgacaagtaaaaaggaacagatggagtaagtacttttagaaaaatctagtagagtagtttccatattatccaatatgggtattatagtttccattaataccacctccatttttaaacatatgacactgttggcttttggacatacgaccatccatcttatcaaaaggatatgtatcacttatttttttgtgacttgtttttatcattaaagatactttaagcatgactacatttttgcataaaattttttaataagacaaatggtcaaatgtatgtccaaaaatcaatagcttcgtatatttaaaaatggagagtattaatggtcaagtttttactacatggacatgaaattttaaaaaaaaaggaaggaaatgctcattttgtttgtttttttacacgtgcatatgtggatacatgcactatcaccaacgtaatgatgcacgtttaaattcaaatcttctgttcattatcatgtcgtgcacaaatcatgaagcacgttggactgataggatagtgcatatgcagagattcatttctctttcacataactataaccttctgttaatacaaatcagtttattccttttaatattttcgttttttttttgttgcaagctttaatgaccatttgtcgatcttcattttctaacgtacttagaagtaacagtaaagcataagtgatttacccaaaaaatttctgtttcatttccagagtttggacaagacaatccatagtgaaaacaagattgccacagcacgtcgagcaaaagcaggcttactgccacaaagaggtttggtttgcacctgctctttactttttcttcaaaacaaggctgaggctagctgtttaaacatttcaaataagagtgttcatatttggtctagctttacagggtcaccattcactccatatcctagcagcaagatatgaactgttaagtatgggtagctatggatggatccagacacagcaaggatctgaagtactttcagcgttttcatgtacaatgttctcagctatacagcaatgtattgcagaattcaggcatcgatattttgggatatggactggttttagcaatggtatgaacaaaaataccctagctaagagtttgcagttcacgtggacagccatggctttgcactcccagtggactgaagacttcatgatctttaacagtaagccgtcttaagaacatgaagagttttagcaagcacgttttaaaagcacaaccaagaaatctggttcgagtatagtgtacataatattttgcatgtacttgtgattttagaagattcctaccatgaccatgttgcattgatgtaaagataggtgttcgacatgcaattctggaagtgggattctaattctaaagtgggcaagtatcacagtatttttttcctctatgcacacctcaaatatagctatattttcgcgtgaaaaagggtctggcgatattcaaaagcaaaattggaaatttatagcttgtagaatacatgaactcttgctttctttccttgtgttttattcagatacagattggtctgaaatcttcaagtatatatatagccttacagcgtgacacgttgatgatgtgccccgtgctgttaacattgtaattttttttataaaaaagaaaatcttatcatcgttcataattcctcccgttttattgctattatttgagatggagattgatcactttatctgaactcgagtacgaactggtgggcagtgtttgtgctgttgctgactagtggtcatggaaaagatagggctcgggtggcctctgtgcacgctggcagggcagcaataccctggccgcgtcctctccataaaacattcagataaactcaactcctttttccccagctgttattttcaccatgtttaatttttacctttgcattttgtatggcccaagaggccaagaagcctgtgccttaggtaaatctccagtaaatgtagcgtagtttttttaatagacaaaaatgcaccttctcatgtggataatatatttttgacccccaaaaattgtaccaatgagcatacttttattcctgttatttctttaattttcttgggagaaatgtgagatgtcgctttcggagattaggtgattttttttatatacacttgctcccagtgttaggtgatggatgacaaagcgtttgtgacttgtgatctgtaagttgagtggtcaagccgctgtttcctttgcgatttggtaccctgcgtcctgattagtggtagctaatcgcagcaattatataagcaaaccatatctctaagcgcacaggatcattgtttggttcgatacattttctccagtgaagaatcttgcctgcttttgggttggtggcgatcttgaaagctaacacgcacgtaaaataaactatgctaaatggcagggcacccggttaattatttcttttcctgcctctgggaccaacatccccggatactttcagccatttgatctagtgtcattagatatgggaatataatctcgttatgcgaattttctcccttattttgctgaaacctattttgcttaaattgcaccacccattgcaatttacacaattaaaatcaagatattctttttatccgaatgtaaccgcatccataaaaaaaaaaggtactctgctatccaaaagaaaacgttgtgttgcaaaagaatagaaaaaacagaagcagaaaaaaaaacataaaaataagtaatgctagtggcaaataagaagaacgcgaaaacaaacgaccaatttacatgtctaaaatctcaaaaaaaaattggttaaagattttttaaaaaataaaccaagggttggaattttttttctttttatttaaaaaaagaagaaaataaaaataaaaggaaaaggaaaagattaagcagaggttggtgatgctgatgcgtccggtgtggtgggtgctggggctgatcactgcagataaaaacgccacgcgaatccactacctcccaaaccccgagacccccccgcctccaccaccacccgccgctcgccgctcgcccaccatggccatggcgacggcgctccgcaagctctcctccgacgccctccgccgccagccgctctcccgcatcaccccgctctactacatggttccgctcttcttcctccattttttctttaatttttttttgtttatatcgttgccctcttgagaaatggtgcttaatccgttccatggattggtttgggttcgtgcgctctcgcaggcgtccctgccggcgacggaggagagatccggagtcaccgtacgtgctctctctctctctctctctcttgactatgtgttccgttgctcgttggtgtctgtggtttgttcattcgttttttttttattattattttgtttgtgtgttggatgcagtggccgaagcagctgaacgcgccgctggaggaggtggatcccgagatcgccgacatcatcgagcacgagaaggcccgccaatggaaggtaaccagcaaccaccaaaaaaaaagtgcgtggattgttcagtgtttggtccaccgacgcattgctgaattgtggcaatctgtttggtgcagggtctggagctcatcccgtcggagaacttcacctcggtgtcagtgatgcaggcggtgggatccgtcatgaccaacaagtacagcgaggggtaccccggcgcgagatactacggtggaaacgagtacggttgattgcgttctatcggttgcctttgttcagattatttgggtgttaaaaatgtttaatctgaaagagaaatcagtgcctgatgggagtgaatgatgtgaatttctggtggctctgggttttccttgcgtgcagatacattgatatggccgagtcattgtgccagaaacgtgctttggaggccttccgcttggacccagcgaaatggggaggtaaatcattttcactctttatcttgccttgtcatgtttttatatgaactccagctttcatgcgcatcaatagcctttagtcctcttttgtttcctgctttgggcgatgtaaatgaaaaaaaaaaaggataggggcaaaaaggttcctttggataagacacagtttttatggttccatagttcacaaaaaaaaaaaaagggattttgatcagaaaatttcttctaggttcttaatttacttagcttcctcactagtacaatgaaaagattacatcgtttataaaccactcggttcttcagtaacctgaatacaaatggtacacgagtggtcctattcatttatatttttcgaattgtttgctttcattattaaccgctttgtacttaaatttatctagaatacttattctcaaaattttagttttctttctccaaaaaggtggcattctaacttgacaaccaatttctacctctgcagtgaatgtgcaacctctatcagggtcacctgccaacttccatgtttacactgccctattgaaaccacatgagagaatcatggctttggatcttcctcatggtggacatctttctcacggctaccaggtacatgggtctggacttcttcattgcctccttactactagttgtttcagttggcatgcaagcataatgcttccttccttgttgtctttctttgtcctcacaagtttttcaattctctcatcgttactatataccaatgagtttcttccccctcaattcttagttatgttcagatataatgctcttggtactctcatcctcccatggcttagttgttcaacttcttgatggttgcagactgatactaagaagatttcagcagtttcgatattctttgagacaatgccctacagattggatgaaagcactggcttgattgattatgatcaggtgcaatgtcctccttatctgttttgttttaatgccatttaacttattgaattctctatcattcttttataggtatgagttttcattggacaaaacgtgttctttttgcatctagcagattccacagctgaaaatatggtttcaagtagcattatctaggatatttttcattgcctcatatctctttcaattgtgaaattatttcaagatgaatttctgctgacatgcttgatttgctacttctgcacagatggagaaaagtgccgttctttttaggccaaagttgatcgttgcgggtgcaagtgcatatgcgcgtctttatgactatgaccgcatgcggaaggtgaattttactgctcaatagtgcatgctgaatcttcaccttctgtaatcagtcaaataattcacttgttatgcaatctgcaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggtatatacttgagcagaacaatagcaagatagtagcgtagggtgttggtactgtttcttctccatcctgtgactctgtgagcttcaaaaaaataaaaatgcctaatgaccctctaccgtctaggttatgtatgactttgaggacaagatcaatgctgctgtcttcccaggtctgcaaggtggaccacataatcataccattactggcttagctgttgcgcttaagcaggtctgtagcacttctgatccctgatgttttatattttatagatcacattgtttgcctttgtcttggactctaaaaggactttctaacttccaggcaactactccggagtacagagcttatcaagagcaagttatgagtaactgtgcaaaatttgcacaggtatgtgttcaaattttgctaggtttttttttttatctacaatatggcttgatctttctttatttcacaacacttaataatgattttgttcttcacttagttcacctcagcatgttacgaattgcaaattattggtttttcaacatgatgaattgtgctttaacatttgaaccacttccttatctggtggcaatttatcacttccagagcttgacagcaaaaggctacgaacttgtctctggtgggactgacaaccatttagtgttggtaaatctcaagagcaaggtaagacaaacatgtgggacgctttgggtgttttgagatattttagttctatctttcagtttctcttatgagtgctcaccaataaactttcagctgcttccttttaaaaaatatcgattgatgtctatttaacctcaagcttgctgtttctgtatataaatgatagctaaatgtgctttgcagataaacttgtttttttttttcaaatttttatgccatatggggacaattatcatcctcttcaaatttcatgtttagggcatagatggttcaagagtggagaaggttttagaaaacgtgcacattgcagcaaacaagaacacagttcctggtgatgtttcagctatggtaccaggaggcatcaggatgggtaaaatctgcccctatgtggttttttttttaatttacttaaaatagatttgcaaaatctcaatatcagctccatgatcatgcaggaaccccagcactgacctcaagaggatttgttgaggaggactttgctaaggttgctgatttcttcgatgcagcagtgaacttggctttgaaggttaaggctgcagcaggtctgtcaaattcctagttttttttttgtttgaaaatgttgagaatacaaaacaattgttgcatgcattgaggtgccctcatatgatacttcaccctaggatcatcgtattcatcattttgtttttcccctt

SEQ ID NO: 43074 - DNA, 6797 bp, Oryza sativa
ttgacgctttttcatggccaacacaaaatcacctaacgatttgcggtgtatgtaatcaacagagtcgccaaaatcgatagatcaaaatcggctagtgaaaccgatttcgagattaattcactttcgcggaatcaagcgactaatttacaagcaaattagtaaagaggataactatcgcacttacgtgatgatgaacgactagtttccgagcaaactagcaaaggataacctcctcgctttcgtggagaagcacgaccgtttttcagcgcaaaacggcaaagattaaccaaattctagggttgacagaactcagccatgaaaacaaaatagaataacaagaatgtaaagaagaggaaaatagtagattgaaattgtttggggggttctcaaactgatctaataccccactatatataggggcacctaaccaccggatgtgtaaatcctacattcatggaaactcttaattaacaaatcagctgctaccaaaaatgtatattccatagctgactttaccgcatagtcgcataatccagtccgcacacacgattctgccttggttgcagagccaagcagcagtgtacgtaagtgcatcaatttccatcgcttgtccagcacagcagctctcaacaaactgaaatacatatttcctcgctgcactccatcatgccatcaacccatcaactgatccatacatatcccaatgccagattaaatactatgatcacccaatgttttgcaagcatgatctagccgatgcaccgaagatccataagccaaattataccacaaacactaaaaaggttaaaaaaaataattaaaaaccgggtaatagtgtcctcgtcgcagaaggagcgagtccccttcatcatcggcagcatggcctccggtgccgccatggcagcggcagcgagaacgtcagcggacgcagtcgcgtcgtcgtgacgatgacatgggctacgcgcgccgggcagaaactgactcctgcactgcacatcgtggttgtgatgaggaggtaggggatctcacacatgagctagctccttcgtgatctcggcgatggacacgcttcgtctttcccggcgcccccacgatcgagccagagatgcaggagtacgttggcctgcatggcccctgaaagggggcttttaacttaggcctgatatgcgtgtgactcctgaaagcccactttggcctgatagcagagtataatcaggagttgggtacccacgggccacggacactttcacagtcctactcggtccttgactccttatatatgttttacggaattgctaaatggccttcaaccaaaaaaaatcgagaggatttcttacagcttttaaaccaccccatttgcttgaacattcgtgcgtccaacttcttctccagctccagcgatcgttacctgacgagttaggatatagggtttagggtggggtgaattaggggatggtgagttcagattggagtactaattagttagtaatgattttggcaatcatttttcctgacttcgcccctcatttgtttggaggagacgtagggttcatccattgttaacaacctgtcaatgtagcgtcaccattgacaacttgctaagagagcaccaacgtgaaaggatcttattgttgaggcttcaaccgatgggaactagtggtggactagctctatggaattgtgtgcgtatgaaaaaaaaatataatctggaggtttctcacagtcaccggaacatgatggagggaggagtgggcgggggaatgaatgtggtgagcaatgagaatccaaggataaatatgcaaacaatgtgagggtttttataaaaaaattcctatgcggaatttgtgtgcttcaatctaggctgcaagatctcttatcggcaagattatggaacaactttgtttggattgctaccattcttagcgatataatctataaataaaatcccttcatttgggaggaattttaccatccagcaagctgaagcggtaccaaatctaggtcattggctagtccaaatcgaacggttcatagaactcgatactgccaggtaccaatttaggctttgggatggtaccgtagaataaaagagacgtagaagggcaggttcatattttcacgttgcaaattttgctggttcaatctaaggttgatggaggataaggcaaaatcccgagcgccgccgccactctcatcgtggaatcgctgcattaccgtcgcctcgtccccgcacgagctatgccctcccctgtcctgctacttggttgtgcctccaccttcattggctgcccacgtccaccgttgtccactcggggcttgccgcctctaggggagacctcctccctgccagcgagccggaggccgtgatgggtggcagtctcgccatatcccctcactgtcgtccaagtccaaatccttgcctcgtctagatctcccgacctcctcctcctcctccctcctcccctccgctatacagcgcaggcggcgaccgtgggagtaggagacagcgacaggccttctccgcccatcttcaatttgtttccaatcttgcccctagtaattcaatggttggatttcatttagtacctgatagtactagtacctcgaggtactatctgctggacagtaacaaacctcttcatttggactgccaccacttaccagcactccaggagcaacagtcattcttttcccaaacagacccctactactcgttatttctgcttcatatctaatcagatccgggatcgcatgcctcatgtcagctttgtttcggtgtggcacatatcaagctatcactgcgtgatcctgcctaagtgcttcatcgcactctcgatccatgatcatatcaagacatgacgctactgcaaaaaataattttaatgaacactcccttttgttttttacaagcgcactaaaaaagacacgcctaagcaaatgtacttgcgtgaccgatcaagtcccgtccataaaaatcgtttttcacatactgacttcttattagggttgtttgcaaaaatgtgttagttttcaagcgggccccttaatagcttgtgaaaaagcgatgatttatcttcgtctcgagtccccgcatgcattgaccgcacgtaggatgttcctctcctccttaccctcctttttctctcctcatccttcctcctctccaccctccacttttcccttctctcagctctgtccctcactgcacgtgcgatggagggggcgattagatccgatgagcggtggtggaggcgatggcatatctgcctgcgcggtgaagaaggtgggcggatccgatgcacatgatggtggaggaggcggcatatccgacatgtgcggcctcgtgatgacggatccagctacgacgcccttgtgatagccggatccagtggcggcggccttaggataggcggatccgccatcgtcggtcattggagccacggatccacatgcagtgtatgcggggagtcaaggcaacaacaacctcgactttggccgtgggatgacagccacaaggacgacggtggcgacttcacgatgaccgattttctggatttgtttttcaattatttttttgaaaatgtctttgcattcagtgtcctaacttaggtacttgcaaaaaaaaaagaggttttcacaagcagcgtcattaggagggccacctacgaaactatgttttcgtgtgtagttatgatgcccgcgtatgaaaataccgatttttacaaacactagttagatgggtatgtacgatccatctgcccgtgaaaatgagttttggccgtctgcgaagaaaaactgaaaagaaaagagcatcaatataatcgacaagtaccacttgtttccgtagtatgatttgcaaaggatattatattaaaggtggacgtgatatttctttccaaactaaaaggttcatatacgtatacgtgattaattggacgggtctgtccggatcgataagcggctcatgatgactcacccactgtcctttttatagtgcaacaagtgtaataaggccaagcgaatgcgaatctctcgtgcttctcctgttcttaaggacgatggcaccatactccatgcatgcacatagcaagttgctagctagcgatcatcttatatatgtacgcggtgattattgttgttacaaagctccaagtctttggatccacccatgcgtgattgtctatactcccaacgtacgtgtttaaatatatataatggtgttaattttattatgtcaaacttttgaaacttggtaataagtggttgtagcttctattgaagtaaagaccagatattatccattatcttaaaaaataacttttgaaactttgactattaattcttgaaatgtttagttgaaacataaatcgtatggtaggtttttctttacaagtactttcacaattctataattttgttagatattatcattatattgtataaaaaatagaatagtggccaaagttatataccaaacaccgaaaaaaaaatcaacaatgttgtatgttttaaatagagaggtactactacttcgtcctccctaaaatacaacgtgtcctagttttgatcaggaaatatatatatcaacatttaaaatttttgactaataattgaatcgttagatttgtctttgaaaatattctcacatgatattaattttgtagttattcatataacatagtatgaaaataaatcaaagagatcaatgttagagaccgtaaagaaaactaactaatgtcataacttttattttagaaactgggggagtacttgataacaccgtatcatggcgctcgtgtgccacgatttttagtttaatagtgcaaggtaccaattaattgcagttgcactaattggcaggagttctgtatatatttaattaacaagtggagataaaaattttgaaccgatgtatctctttccaaaaaaaaaaaaactatgatcgatgcaaacttgtgtcaataataaaagtggtggccctccaagcatttggacgttgagactagtttatatctcgtcatgtgaggctcctgctagttaaaagttagtaaaattgtgaggacaatattgtgtccttcaatttacaggtttatgcagagtgcacatatatatatacccaccatgcattgaccatttcgttctgtatatatctatctctctgccgcctcaaagtcgatatgatgtgtgctgtgtgcagtaattcagtatctgcagagaagcattgcaaaatatatatagtgtgctaagtatttctaaagatatggttattaggagaccttttagaacataaaaattaaaatggatgttattactttgtcagcaagagatatctacttctaatttataaattgggtactctccttagatataatttgtctgaaaaataatactccttccatccacaaaagttagacatatttcacatttgagttttttcaaataattaagttgattttatttgtagtctttatgtatttaaaacttaaatgaaaatataaattaaatgcttgagaacctaagaagtcatctaaatactcgatcattggttgtatgcttacattcactcctggattttgtaacattcaagatgattttttttgtcttgatgataaaaagtagaatgtgtaacttttgtgatggagggatagtaatcaagggcctcatgatgatgagatcaagtagcaatgaacaacattagtttacctcgttgctggtgtgcacgtggatcgattcgtagtttacacggtcccctacagtttggttaatcattgtttgtttttaatttactaaaccaacagtttactaggatgctgctcgtcgcttcccaatattaatctgttgtcgtctgaattcatgcgatctgggacaaagataacattaagagaaattttatggtactcttgtcgagagtaccaaaatttttaaatgccagctagctaatacttcctccgtactcgtaaaaaaaatcgttttggattgcgacacggtctccaaagcacaactttaattttttgtttctatagaaatatttattgaaaagtgatatatgtatacttttatgaaagtatttttcaagacaaatctattcatatactccctccttccaaaaatataagtcttacttctttttgcaccaagaccaagaagcaattaattaattcaccatgtgacaaaactaataaacatgcaaccaataagcattaaatggcttcttggatttctatcaacaatttaatttagcacataataactacaaataggacttagacttttagaaaaaccaaagaatgaaatagatcttagacttttggaatgagggagtaatttttacattttcaacctcaacaacttaaaagttattcatgatttatattcccaaggtttgatttaaacattgtcctaaacgactttctttacgagtatggagggagtacatatttatcttcaaaatagctcaaatattaaacatttgtttgaagcaatatagtcttcaaagtacaaatgctaagtccgcatgtttctcttacttctctcaccgtctatgagcgagtactaatattgtataatttaatagacatccgaatattaagatctttattaatggacattataaaaataaggttttacttacaaacatcataaaacttagtaatttactggacagtagacactacgataataaaataatatatatatatatatatatacactcaggccagtgagaagccgtatatatgttactccctccgttttaaaatgtttgacgccgttgactttttaacacatgtttgaccgtt

SEQ ID NO: 43075 - DNA, 9210 bp, Oryza sativa
  unsure (1)..(9210): unsure at all n locations
nnnnnnnnnnnnnnnnnnnnnnnnnnnnnnnnnnnnnnnnnnngaatcgaaaccatttccatgatcatttcatcatcatcaattcacaagtggagtcacaaagttgccacgctttgcaggagaatcacttcgcatttcaacgtcatggacctgattactaacagacaggctatggttctctctccctctgttgctttaattttgttgttgtcgctgccacgaggaatatatataaaacagccatcatgattcatcgactgatcttccactgcttttttttttcacggtcaccggcgaagaaggctggatcgccaatctcaaaagaaagtgacgcgaatagcatctgatcgggcgctgctgctgctgatgctgcttttgtttgttttttgtgctcaactaaaaagattttgtgtcgcgttcagttctccacataatatcgcatctgatctttttgttctgctggtgctaagcatataatactcgccttaggcgagtgagtcccctcttctggcatgctatggcaaacgaaacatacagaaagacagaaagagatgatcaatttgtcagggatatgattttttttttggatcttctgaagttctgagatgatgatccatggctgttgagaggaatgacgtccggtctgaagatcgccgtccccaggcggtggcttcggaccaggcttcattccccatgactcatggaacccacacgtgtgtactgatcctgtgagcttcagcttcgtatgaattatgatcagcaaccaaccaagattgcagggaaggcaggtaggcaggtaggcagatgtccattcaattctgttgagatttctgaaggttttcatgtttgggattttgcagaatcgcagtgccactaggcactggctgcttgttttggatgaactttgctagcttggattggatgcacaggttggtactacctacctacttgctgttgctggcatggcatgctgatgctggcatgctgcacctacttgcttttcgtgcttcgctcgaacataaggcaacaaaagattaggtgcagatttcaggacaggatcaacaagaatgaaaagttcatatagcaaataggatttccagtttgaatgaaatgcgaaactgaatagtgacattacaaggacaaaacaccggaaaaaatattctggtcttctaagtactgatgaattattctggtcttctgaatactgatgaatcgtatgtagtagtagcctatagcgtcaaccctagacaagcaagtaatgcattcagtccaaactgtcaacgtcagactaactagaatgaaaagccgctcaaaccagcttgttgcgatcaagtaccagcctcgcaccttccttattacaatctccggttttttagcatacggtaccatctaattttaaaaattgtttattttattgtgacttattttagaactacaatctaaacctaaacttttacatatttatactaaattttaaataaaacgaatgatcaaatgttttaatggcgttatggccggggttgatgtcaatttcgaaattatagatttaagctacattcagtatcaggtgaagaaacaaatgtgttaacatgaatacaggacatgacatttcctacaaaaattcgtcgtacaatttccagaaggctgttcttacagaggttctggtgactgtatttacatctaatcaagctgtttggtccaatcaaagggttcccagtccttcatgaaattagcaacagcttgtttctgattatccatcgattcatgccttcggcgcctgtgcatgtcctcttcccgcaactggagcatccctctgatgacattcaacccaaaacctgcactgaatttgctctcatcgtctatgacatgggcaaatccacggtcgagcccgaactctacatgaaagtaggcaaagttctctgggatgacttggtgcaggtttccctttgttggaataagtttcttcatgtcatgctgggtccattcttcttccgcttcatcaattgcctgaagtaaataggttggattttgttagaacctgaagcacataagaaataaattgttctcaatcatggacaaagcaacagacaaccgaccttcttgaagtacatgggagcattgtttgaaacttcggaggggatagggatgcattcaatcatgcagtgcctgcgttgtttggccaagcttataacagtctccatgaaaacaatatccttgtcctgctgcgcgaacattttcaggaggcacttcttaaagttgcggatctcctcccagacacttctatcaactgttcttgttgcagactcatgctgcaaccataaaaaagaacatatcataaggtagatgatgaatagtgcataagagttgtaatgaaggtcgggtttacatatgactattcaaaattacaagaagctgaagttagcttgttgttatgaaagcacatcataaaatgattttctcacctgcaatggcagaataatgcagtgcccagggacaacaggctcaagctgtggcagcatcaagtaagtgaagtttcctatagcaacaaccagatgctttggccgtgatgggttctcgaagcaatacatacagcgctctttctgagttgtgagccaatgagtgcttctcctctcctcatgtgcatctttgttcctccttttgcctttcttactgggggcatcaccaaaatcatattcatcctctatacttttagacatgttgtactgtttattgtgcataattttatttgcaagatgccggtcagcatcctcttctcttttcctgcgatcagctgcactaggctttattgtgttcctacagattagaaaaacaatagtttgttcagcaagcagataaacaatacgagtatatatatgctgatacaacattgaaatagaaaggtcatttctgtaatgcttatgtttgtaataaattggatgtctacattaaaatatttgaatatccctatgcaaaacaggtgcaccctgtgttttgcacttttttttttgtcatagtatgccaaaatggcatacatatggccaccaaaatatttcagaggagcagatcaagtgcatgctgtatccattccccttcttatctatacaactatgcctcatacgcacatgctctagaaactagacattaagaatatgaaactgagagtatttcaatatgagagaacgattactgttagaacatttcagcatagctttacagttgcagacatatttcttttcaagtcctcagatattgtgggagaataacaaggtaccaatactaaggcgtttacaagtttttagccttacaaagtgacatcatacgacagtgtgtgaaagcaggcatctgtaatgtgctaactcagaataacaacgtcatggactaacctggttgaactcctcacttcatgcctaggttcttcaacagcagtatcctcattctccagcaccgcctccatttctcgctgagcaagaatagttagcagttacaaagtcttgtcacctctaattcaagtatattcaagcatatggaaattcaatttcttaatcatgccctatttcagatataaaagaaattgtgcttcggcatcctaaattgtatattgatcataaagcgataaacatagtgcaaattcttgagcatggattgatgcggatccgaccatggttacatgctactataagagtatgttaaattaggggtcaaagccattattcaatagcaatatgttagctcaggggtctaagccattactgaaaagcaatgaacagcatgtattttctgttacttcaaatgaataaatgaaaccatgtgcaaaactgcactttcattactatattgtaataagtatagttattttccaaacaaattatatacactaataatgaatcaagaaggtaagcctgttaatgttatcacaataacaataatgcaatacttaccgaaagttgttcagcttcttcatgcttgcctttcattcggagctgcagaatctttgctgctaactggttcgcatttagcttttgagtgctaactgaaggtgctttctttgagctacccttatcagacttgagctcatcaacctctgcagtcaaaacatttacagtcttgctttcaagattattaatcttttccaaaaagcttccatcattagagaacttattgattcctgctatcgctgaagagataagtgcctgatcctcagaagaaatattctgcctattccttttccatggtacagaatcaggtttaggttttctcattgcatgatgccgagaggaaacatcttttaagtattcacgtctaccactgtctccaccttgctgaccctcctttggattttctttggaatgttcttctgagctgcctgcttgcccagcttttctgcctctaatggcatgtaaatgagcatgcgaaggggcagctctagatgctgacactgatgcagctaagtggcctaacgagccccatctctcaccaacaacctatattgaatagtaatagaagttaggggaataaactacctaatgtcagtcacttccaataataatatgtggcgacggacatacctcctcaagttgttttccttcacgagctgcttgctcttttgcacgcttcaaagctttgagcctccagctagcacctccatcaccaaccacagaggaagcaagcaactggttgcctgcatttgaagggctagattcatcagggtacccactgccattatccctcaggtatggattcaattcctttggattggctttcttcacctgtcagtacccaagaagttgatgtaagcaaagcaggagagatatcccagtttagagtttagaatcactaaacaaaacatttattccatacatcttatacagatccgtagatataaatatagggtgtgttcgctacagccggctcccaacgtgcacagtacgcacggaaaacggagcagcccattagaacgtgattaattaagtatttgctaaatttttttcaaaaatggatcaatatgattttttaagcaacttttgtatataaacttttttgcaaaaaaagcaccgtttagcagtttgaaaagcgtgcgagcggaaaacgaaggaggggtttggaaaagggggtgccgaacacacccataggccgtgtttagattccaacttttttcttcaaacttctaacttttccgtcaaatcaaatgtttggacacatacatggagcatcaaatgtggacaaaaaaaaaaccaattgcacagtccgactataaattgcgagacgaatcttttgagcctaattacgccatgatttgataatgtggtactacagtaaacatttgctaataacggattaattaggcttaatagattcgtctcgtagtttacatgcggaatctgtaatttgttttgttattagtctatgtttaatacttcaaatgtgtgtccgtatacttcaaaaaaaattttggcgcaccaactaaacacagccatagtattcctgcactgaacaactgaatgttccaggggtttattaaaatatgagttaacgtacaggacaaaacatactcatccatcgtcatgaagaaaattatacagcagttacttgactaaatgtcattgctaacgaaagaaaccaaatctaaatctaagtatgaacatcataactaaatagcaacggtcactcactgaattgatcacaacaagcttagcattgaaccaactttcagctactatagcttagcataaaaccataagcagaatagcattctaccatgggaatattgttcataatttgagtagataggatgcaagtgcctaataccatctgaagactactgttcagctaccaacaattaaaacatggcatcttcactgcaagtggtgaatcatatacaatattaatgcagtacctagcttatggaaatattaccatcacaaacatggcctcagctccacaaagaactacaataagctaccctgaattgcaattatatggcaaaaggtagctactaggacacaagcattgaaccataagcatatctcacatgagatgtggtaatcattacctcctcgggtgcaacctcctcctcatctttgtcagccccgccagcttggctgctctccgcccgaccactgcttgccgacttgagcatccattcgaggcccatctccttcctgacaatatcactagctctcaactcctcacctccaattccctcatcctcctcctcctcatcatcatcatcacctgcggcacctccaagcttgctcttgcgactgcctgtaacaagaggtcagcaataccaggtgatcagaaacacaactcacaaaaatcctaccaaaaagcaccatcctaacctaacctaaacaagtttagggctacttgcctcttctcttatcagattcaccactggactcctcgtcatcatcatcgtcgtcatcggagaactcatggcgccgcctctgatgcttcctccggtgcttgctccggctcaaccctttctcctcctcctcttcgatcgagtctccgctatcggacccctcctcggagtccgagccgtacttgctccgcctccgccggcgcctccggtcccgcctctcctccttgtccctccccttcctgccccgcttcttccgccgccgcctatcctcggagctgtcggaccccgccgagccggcgccgcctagggcatcctcgccgatctgctcccgggggataaacttgacgccggagagcatcgccggtgggcggcgaggcgaacgcgctagggcttcgttggttgggggagagaagcggcgaacgcgagggcttcaacggcggcggaggtggcgcgccggcgacgagccgacgagagagaggaagaggtagcgagaccgcaagggggatccagccatccagggagagagagagcctttccgtgatgtgtaggctggatgggccgggccttaacaagtgacgggtaccgatacaatcggcccatcggcccgtgttgattcaattggcccaatactcaacggttttcagcccaattacaaagcaacaccagtagcctttactacttcctccgtctcataataaattctatttttttagtaatcattatttcattggagtctgtaaaagtagaaaataattatattagaagtacataaagtaagaaataattgtattagggtttgataaaataagtgtattatagtcttttgggttgtttttttatgtgtgtgggatgggagagaaataaacttattttggatggaggaagtaaatataaatcctcgccaaatattgaaggtatgaatttgtttatctctgttccaagacttgtttgttcctcggatagttgggaagaggattagaaagataatgatctcacgatgctgacaatagggtgtgtaaatatcactttgaggtcaaaaccaaatttatgtataattctgatatattatgtacgagtattctatttgatagtttgacacccgtatcccaacttttcctgtaccgaagaaaatctgcttggactcctgtttttcattttccctcctttcctgtttcctagcaaaacaattgatacggaattcaaattacatatacccatttgttctcgctgaatgcgtacatatccaaaacggtctgtgagataaatatccttttccctcttgcactagtcagaaatcatccgaacagcggatgaacaaagcgaacaatgtcttaacttccatgaagtgtcccctgcaacacgcaagcaaaatgctactacagcctcagtggtgtaccacgaagaaagatgatcgaatgtgcacaatgaagaaagatgatcaagcatggccgtacagttcgtgagtaagtaccattttactaccaacaaaaccttcctgctccatccctgagaagggatgtacaagccgtgctccgaggtctgaacactcaacttggggagacgaattcgacaggaatcggtttagctcaaacccagaaattcagttcgcttgtttcgcaccgtgaaacttgcgtgcgaatgttgcagccacaattaatgggaaagcgatcgtagcgtcacaatgcacctgcatttcaaaaggttgaggacttgaggtatcaagattataggtttatagtgcgacaaacatccatggtgtatgagttaacgatgctccaactatctcttggtatcataatttctcgttcagatcttctatatcaggcaaagcagaatcatgtcaaccatcatcgcataaatcattgaacaaagtaaaattgatgcatgcttcaaagctaaaatgcatcaaaagatataggtgcaatacagagcaaaactgtgaaatgaatataagatggattagaattaggatctagtccaagatcattgatgcaatctctttggcataccttgttcaagcgaagctgacaaaaatgttcatatatgcagcatatgatgtttaacaaaaggcacttttagctagctaggcgcacatcaaatattaaaaataatcatgtgaaaattgctcaaggtacagaaatataccttgacgggtttggctgaacctttaatctttccccatgaaactgcttcatcaggttgtgctccagaatcactgccatcaaactcttgggctgtgttgatatagactgcataatctgcaccattgcgaaacatattggcgttgcatatatgatgcttgggtagacctccaccaagaactatgatccctgtcttccttggggttgcatgaatggcttccccattcatcaatcttatatctgccacattttcgagcataatatgagaaaaaaaattgaatgcaaaagcaagaaaaccaagcacacaaacttgccttgtacaatgtcaataattaggccaggattgcggactgcatgacagaatagcatgtctccaagcgatccatcagtcaatgctgggcagtatacaggaatattgttctgatcaagttttggaaagtcagtactatctcgtttcagtcttttgattaacagatcataacattgcacttgggcataagaacttaaaacccacacaagaatatcgaatatcgatgctggtttacgtgtcgtattctccacagatgcttaaagtatatggtctattgcaacatcatgagagagaaaaaaaacaagtgtcttgaccaaatccactcaactataagtctataactcattctaaaaagtcaaataaaggttaaaatttggatatcatgtacattatat

SEQ ID NO: 43076 - DNA, 750 bp, Oryza sativa
acaaaaaataactcaaatattttttcaaggaacaaagaaaaattttgaatcagactacctagtatctcattgtgtactaaggatagagatgcatggactttataaacagaattgatggtgtggtccccctcttgtgctattattttgcactttgtaaggatattcaggtgtagttaataaacatgtgttaccttatacgcccaataaaggtaggaactttcatcatttatttctttgccaagacaagctatgaccttcgatggtgtccaaacattctgcaggtaagtaaaattgatcgtacttcatgaacaggagagagagcacaaaagtagttggaagagttgcttctgagagaaaagatgtatctgataattgatagttggaaaacaagggcacagcagtaaagctacagaaattcatagttggtgtcctcatatgtcagttttatttggatttgtgcgtgtatcattactaggttaataaaacacggaccaatttgaaagggagctaatgaaggctggttcaaataatgtgcatagatcctttttattcctgtagcattgaaattcaacatattttaatttattatttgggagtacttgtggggcagattatagctgctttccatttaagttttttctctcatgtttcttatttttgaacattctgtaccataatactagtggagttttaagcactctaagctaggtcattttatattactgcccaatacatgattcctcctctata

SEQ ID NO: 43077 - DNA, 7805 bp, Oryza sativa
  unsure (1)..(7805): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctcgacgatgcatgcgtgtagaacagcactgtgacctggcagaagctttattgtttaggtaggtgcatagcacagtgtcacagtgaatagtccatgcgaaatgaagctcagaattttaactcgtaaatcaatcacaaagcagcaatggaaaccatatttttacgattttatcaggtataaatgatgccatgtggttaatgtcttccagaaaagccaaatcacaacttcaatagcatatcagagtgtatattacgaattaagataggaagtgctctactgacctattgtaacactgtttccaattatggttgggagaaccttcccactgatattagcttttgaaacatgtacaagggaattgtcttgtatatttgttccaactccaatatgaatgctgttgacatcacctgaggacaaaagaatgaaaaggagctaaaatggttatcaccgcaccgtggaagtatccaaagtacaacttcaacactatagttactgaaactttaaatatcaatatgctagggttaacccagtatgtatgacagcacaaatgcctcacaccatgataaaagatcatatggtgtaggaggaacgttatcatgtgaatgaagctgcttgaatcctttttctacttggatttggttgtaaaggagaccatacaggcattggtcaaaaccattctcacctaattgttttcttaagagctactagtatgttactccctccgtttcatattataagactttctagcattgcccatattcatatagatgttaatgaatctagacacacatatatgtttagattcattaatgaatatatgaatgtggacaatactagaaagtcttataatatgaaacggaggaagtagtacttaatgctttatggttgggagaaccttcccacatcatcgttgagagcccaacacatcatcgttgcaggttaaaaactcgaacttcatgtgaagtgtcagttgagagcccaacaatgaaaagatgagtgtactagagctgtttgataaaactgtgcatctccgtacgactggtggttctgtcagttgtctatgtagtaccattcatcataacaatgagtgtactgcagtcagaagcaagtttattccaaaaacaaaaatgtacagtaaacaaggtgtaacaaagaaagaaatgggaaacaaattatcaagacaaagcccatgcttactcacatgtgtaataatactacagtgtatatcgaccaagagtttacctcttaaaatggagccataccagattgaggatccatgtccaatctcaatatcaccaatcacagctgcactgggagcaacaaaaacatccttgtggattctgggctctttctcaaatatgttcatgattgtgcgatgccttggcactgacaagggcatacaaaacggtaacatgatagtcaggctcaaccataaagtttatgtaccttgctaaattcattagctcgtggttattctaaaatgacctatctagacataataccaaaacctttttgatacaatgtccaatttatgctaattcaaggccctctacaagatgcagcatggtggaaatcaatcaacaccaactacagcaccacacctaactagaaggtggaacaaatgacattcttcatgatgctacgcaacagaaaatagatgcataaccactcgaaaattggcatgccaaattgccaatgtgacactcccacaatgggcagtatgaccgcaataaccaatatgcgcaatccttgatttacttgctgcagttttcacacacgagatcgatcactagttgaaaacctggaatgcagaacttcacaaataaccgacgataatttaggctcatttcgagactcctcgaatccagtcaccccctatccattcctaccaatttcttcccaataacaactgccaaattgtcagagagagagacggcggctgctgctgcttacgctgctcgtcgacgcggaggccgccctggatggtggatccgaggcggtccatggcctgccccgtgccgcggatccacttccccgccgtgtagatcgcccgccccagggtccccatgcctcgtcctccccgcttgctccctccgctgtccggacctcgccgccggccgccgcccgccgccgaggtgagaggtaactgtgtgagagagagagagagggagaggaggtcaaacagcttttggcccaggttttttatgggcctggatccggcccgatcatcacagaggcctcgcggcctattgagatttgggcccaggtttttatgggcccagcctgttgcgcgaattctagagtgatcacggccgtccaaaattcgattgaatttttttctttatgtttcaaacgattaaacagtactccatccgtcctaaaatataagtatttttagcatagtatcaagtcaaatatttgtaactttgactattaatagcaaaagaataaaaaggatcaatcatgtaaaattgatgttactaaatttatcattaatgtaactctttttatttaaaacatattacttttatagatattattggtcaaaatagcatctcatagactatgtcaaagtctaaaaatacttatattttaggacggaaggattagtaataggctcccttgttgggaacttcggatacgggcttaaaatttgaagtgaaatattggcttacccacatgattggctaagagttccaaatcgctcaaacttaacgtgactgattatgttgcagtcatctacggactgcagggaactggagtcttggatcctgcttgctttgcatcaacaaaaacaaaaatctaaagcttttacaacgtgcacgcattctgcagctgccgtctgccgatcatccgcaccaggactacagagagtgtgcaaccgaacaaaaataattgaccctgtttggatggtgttacatcggatggatgtttgtacaaagtattaaacgtaagctattgacaaaacttattctatcctagttaattcgcgagacaaatttattgatccaaattaattcatgattagcctatgtgatgttacaataaatatgtgttaattatgaattaattaggcttaaaaaattgtcgcgcgaattaacactcatttatataattagttttattaagtagtgtatgtttcatactacatcagtcccaaaatacttgtcgctttgatttttttcttgcaacctttgaccattcgtcttatttaaaaattagtgtaaatataaaaacgaataagtcacacttaaagtatttttataataaagcaagttacaaacaaaataaacaataactctataatttttgaataagacgaatgatcaaaagttatgtaaaaaacacaaaacgacaagtatttttggacggaggtagtatctaaacatcctatgtgacctaggagtatgtgactgggacggacaacagtgtacaacctttcgttgaacaacagagacgtacacgtacgcaatgttgcacgggtcacagatataaaatgcacacgctacaacgcagcggatgtactcattgcgttggtgcactgcacgcatgcagcgagagatgcccgccgacgctgacatgacgcgccgccgccgctcgccgtcgctaccgtgcgcggtgcgcgtgcaggcggccggcttcgcgctcgggcaccgccgggacggcagcgtccggcgcctcgtcttctccctcttggacatccacgtcagggccaagcgccgcgccggcgtccgctccgtcgacgtcaccatcgacgcctcacgcggcctctgggcgcgcgtcttctccccgccgccgacgaagggagaggcggcgcaggcgctcccggtcgtcgtcttcttccacggcggcggcttcgtgctcttctccgccgcctcctgctactacgacaggctctgccgccgcatctgccgcgagctccgcgccgtggtggtgtccgtcaactaccgcctcgccggccccgcgcgccgcttccccgccgcctacgacgacggcctcgccgcgctccgctacctcgacgccaacggcctcgcggaggccgccggcgtcgccgccgtcgacctctccagctgcttcctcgccggcgacagcgcagggggcaacatggtgcaccacgtggcccagcgctgggcggcggcgtccgccgcctcaccgtcgtcgtcgacgacgctccggctcgccggcgccgtgctgatccagccattcttcggcggcgaggagcggacggaggaggagctggagctcgacaaggcggcgctcacgctgtcgctagcgaggacggactactactggcgggagttcctgccggagggcgccacacgggaccacccggcggcgcacgtgtgcggcggcggcgagcacgacgtcgaggtggcggaggcgttcccggcggcgatggtggcgatcggagggttcgacctgctcaaggggtggcaggcgaggtacgtggaggcgctgcgcgggaaggggaaggcggtgcgggtggtggagtacccgggcgccatccatggcttctgcttgttcccggagctcgccgactccggcgagttcgtggaggagatgaagctgttcgtccaggagcatagaaccaagcgtgtgcagtagatggcttgttggcccaacgctgtaattgatccagtgattatgatgattccagcagaatttacgagattatttttcgattacacgacaggctcatatgtatgcacatgtactcccccgtcccaaaaaaaaaacaatctaattagagatgggatattacctagtccagcgtatctaaacaaacatatgtccggatacgctggactaggtaatgtcccaccttcataggttgggttttttttttaacgggaggagtatatgacaacacacataacaacacaatcatacgccaccaatactgtgagaggcactacacgagaaataaattttattattcattcctaaggaatactcgatgggatgagaaataaataacaaccttgaagatgagtaaatatcatagagcaagttttatgtcatttaagagatatgcgagaaatgaagacatcacatgggagacaaaaatccatctgcggttatttgctgccttttgttatcataatggttgccacctgctattcgttgcctttcgtcgatatacgattatattactatagtgaagtgtgtgtcgatgggttatacctcaatcacatgattcgttcatatacaaattgtttggaggacgtaggaattgattgttaggaggatacaaacaaatctgtaaatggagcaaggggaaagggatttttatataggtagacccttgatgacgagtaatagcattatttctgttgaccggagctggtgttgccatcgtatatcaatctatcacaagtacaaagtagagaataacctaatctagtgtaccagcgtatcaatgtaaagctcgagtatggttagtcgttggttagctatttttggcttcctcgagaatccattcggcgagattggaggttgctctatattttttttattaggcttgtccttcacttctgggatcttgtacttatatttttaggtgtttcctttttaagtagaactaagaagataaacatagatacgatcgtcggttttgagggctctgtatttattttatgtgactcatttcttatctatttaggacttccgctatatgcacgagagttgtttccgtacaaatggtatatgatggtcttgcaaagctaaatacatgtgtatagggtactacatatttagagcactcacggtctaaatttaaagtacttttggttttggcatatatatttatctattcattttatttaaaaattatgtaaatatgcgaatataataaatcatacttaaaacaacttcaataaacaatacaagtcataacaaaataaataattttgtaactttttttttaaaaaaatatcaaacatacattcaatgtcactggcgtcctagagtctcaaaggtcactctaatctcaaatattcttttcagcataaaatatatagtaaactgagaccgaacaggatgtatctttttacaatgaatacgaatgtgaataaaaaaatctatccagattcatgaaatcattatgtatctcatctaatttcaggttgctatattttgagatctcctctacgtcttcgtctcaatctccttgcaagcgactactaccagaatggaaagactctacgtagtccaggacactgcgtgtgatacacttcttgtctatcaggtgggtaactgggcacgcatggcagatagttgctgcctaggactcgccaagaacgtgccacacaggagttcagagaaattcatctggagaaaatggcaaaacggtaaaaacaaaaacgaatacgaaactcacaactcacaaggaaaaagtctagggcctgttttgggggagcttgttccagctgcagtttttcctaaaaactgattctgctagaagttgcctcaaacagtccacaacttctgagaatctgtagttacaaattctgaaaaatgaactaaaaaatcagaagctggagaagctgggtttcagagcttttctagattatcaaaaactagctaccaaacagctgcttcttataatttaaagatcccaaacaggccctaggagtagtatctctctcatgattcattacttgatacatacagaaatcatacaaccccactagctagtttatttaagtctattgcatactactctgtcgaaaaaaaatcctacctacgaacctaaagcatgtatccatgtttataggtaggattgattatttttttttttgacggaggggtatgtatctgtaaatatttaaaattttctcctaaattatgcagaagccagcatgatagcgtcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctcgacgcgctcgccgccgcacacgcgcgccgccgcgtggtcccgggtggcgccctccggcaggaactcccgccagaagtagtccgtcctcgccagcgacagcgagaggctcgccttgtcgagccccacctcctcctccgtccgctcctcgccgccgaagaagggcgatatcagcacggcgccggcgagccggagcgacgacgacggcgaggtggtggacgccgcccagcgctgggccacgtggtgcacgatgttcccgcccgcgctgtcgccggcgaggaagcagcgggagaggtcgacggcggcgccgagctcggcggcggcctccgcgaggccgttggcgtcgaggtagcggagcgcggcgaggccgtcgtcctaggcggcggggaa

SEQ ID NO: 43078 - DNA, 45580 bp, Oryza sativa
agagcgcgtcgtaggggcgcgacgccgcggagaagagcacgaagccgccgccgtggaagtagacgacgaccgggagcttcaccgccgccgtgttcgtgggcgggcagaacacgcgcgcccagaggccgcgggaggcgtcgatggtgacgtcgacggagcggacgccggccgcgtcgggacgggggctggccgcggcgtggaggtcgccgaggtagaagaggaggcgccgcacgctgccgtcggaccggtgcgcggccgagagcgcagcaagctgcacgcgcaccgtccacggaagcggcggcggcgacgacgacgaccggcggctgcggtcaacgccggccatctcttgctgcaccaagtgtggaggagagttttttttttctttttgagtgaattgcaggagtgatgtggtgctttgatcttcgatgtgaccaatgcgacaaatctgtcgcgccattaattaatgtttaaggacaagttgttcgcaagttgcacacggcacagtggctgtggagttatattttatttcaatttgtttgtttagttttactactagtataaattattgtttgataaagctcaaactgtaataagagtgccaaagtactgaaagagaagtgcagatgactcaagagttgcaaatttctgccatatgtaaaagcttctgttctttattgtgtagatatattttgacccttgaatatttgaacattggtaatggtaatatgatgtaatcctagttggccaaaatcatgtccaattagctcaaattctctgtccatatcccgcaaattctcaaatttccttcgtctcttcggttgcttcccgttcatcttctccatcatcgtcgtcatcgcatccacagtcgctgtccatagccttcctcttcgtcttctccacgaccggcgtgtgcacagccgcaggtgcaagggttgtcgccgttgtcgtcgatctcgcactcgacgtagccatgggcagcgagctccgccttgacccactcctgctgctccttccagtactcgttcaggtgccgtatatatggcctccgcaccgtcggcgtccaagctgcaggagcgcctcctcctccgcctcgctcgccgccagatcttcgctctgtaacacggtcgcggggcggacatcgtgacaggatgtgcggtcgatctgctcctgcagcatcctccacttcctcagcttcttcattatcttcttcatcccttcggcttgcgacgaccaactccagttcatcgccggcagaatctggatttgttgggatttttctgatggattcatggatcgctacgggaccacgccataaatgggccagaatgcccgtgttctactcggcctcgggctcctagtttcctttgtgaattctccgccgcgcccatgtgtgccggcccaggctcccaccaaatacttctctgtgacttgtgaggaggaaaaagtacaccggagatacctactcttgtcgccgatttacaaaatcatcccttaaccaaaaaaccaaatacaatgtatcctccaacttttaaaaccagtgcaaacaaaatccttcgatggtattgtccccagtttcagctaacaaggcaccaatgtggctccttcgactagatcttcatctcacatggcgcttatgtgacggtttcatcaagaaacaaattataaaataataaaaatgggtgggccaattgatcagatccccttattccttttctctcttcttcctctcttttcttgcgtcagacaggaaggaaggacatgaggacgatggcgaggtatgcaccttgcccttccccatttctctcccaagcttctccactcctccgcggatgaccccgcccatctcctctgcgccatccagctcctattcaccgccggtgccctcctccatggtatggtcaccgtggttgcctcctctcccacctcacctcgccagcctccttcgctcccgacgcttccctctacccagcgccgccatgtcgctcgtcgtcggccgtcggacctcctcctctccgcaccggacagccagcccacccaaatgacgacaagaaaaacgagaaagggtagaaagggagagaagaggataagagagagggtaatgccgtggtcaccttgatatgtggggttcacgtgggttccatggtgactcagtcgtcatgtcggacaaaaccaggatcaatgttgtctaaggacctggaatgatctagttttgtaagttgagggatcttatacatctggtttttttagttgagtgacgattttgtaattcggtgacaagatgagggacctcggacgtactttttccgtacgaggacaccttgtctccatatggcccatcaaaagcccatcaccgtcgttctcttccttcttcccaccaacgcatcctccctattcttccccaacgttcaagttcaaagttcaaacaagcagccatggctaccaagaaacctccaatcatgctgtttaactattaaaactggtagacagcaggctagtattaatcacacataatcatattaaaaaatataatgcagaaattatcagtgatcgaggttccagccgtctaatttcccgaacagattttcttctcttcagtttcgtcctcataacaatcatcgtctccttcttgttcttcttcttcttcttcctcctcatggtcggcagcataggcgcagccgcaggtgcaggggttgtcgtcgtcgtcgatctcgcactagacgtagccatgggcggcgagctcggccttgacccactcctgctgctccttgtggtaccggtccatctcccgcttggccaccgcgtcgtcggcgtccacccgccgcagcctctccttgagcgcgtcgctgatctgcaggcggccgatgtccacgtcgtagcgcggcggccgggctggctccggcgaccacgacaggatgaggtcgatctgctcctgtggcatcctccacttcctcagcttcttctcctccttcttctcttcgccgacgttgttgacctcgtcgacggccatctccgtcgtcgcggcggtggttcgatcgatgctggattaatcttggattgcttggggattttttttttctgccataaataggggcagaaaggtctccatgttcttcttggtttcctttgcgaattcggatggaataagttcacttcatgaccctcaaaagtgatcgaaatctaatccatgacctcaaattacaaaaccggatatcttgacccccaaactcttaatacccgtgcaattttactcccagtgcggttttggagagcggtttcgctgacgtggcgcctacgtggcagcattgactcggtcttctttccacgtggtgttgacgtggcgctgaggtggcattagaaataaaaaaaatatgcgtgggacccatctgtcattcacacacaaaataaaagtggggcccactgacatgtgggccccacatgtcatcctctctctcactacccttcttcttcctcctctctccgttgtttctctctctccgttgacataagccgccggcaggagggggctcgagtgccggtggtggtgggtgggtgatggagtggtggtggcggtgggcggtggacggtgtacctccggcgacgggcgcaggagcagctccttctaccgcactgggcctcgggcgactgggcgacggtaggcggtggacggtggggagcacgggcggcgggagctaaagaggcggcggcggcggcggacctcgggtgtgtaggcgacggtgggcgatagacggtggggagcacaggcggcgggagctaaagaggcggcggcagcggtgggctggatcgtccggctgctgcccgccccctctatctcctcctcctcgtagtcgtcgccgtcgacctccccgaccatgcagagtaccagatcgagaccagccgtccgccgcccctcgtacgcccgccgccgccgccgccgctctcgtctccgaccttgtcggctgcggccatagccaccacccacgggacgcgtcgccgccactccgggtcagcacgcggcagcgctgtcgtgagcgcgagtgcgggaggaggcaccggcggcggcggtggcggcgacaacacgagctcggcggctccgcctctcccctctcccttccggcccttacacaccgccgcctcctctcatgtcacccatcacatccgtttcctccctcacctgctctcctctcctctcctctctccacttggcgaggccgccgccaccgcttcagcttcctccgccgctgccgccgctctggcgcccgcccgctgccgctccagcctcccatgctccccgcggccggccgaaggagagaggagaaaaagaaagaaagagagaagggaggaagaagaaagggagatagaggatcccacgcatatttttatttctaatgccacctaagcgccacatcaacgccacgtggaaaagaagaccgagtcaatactgccacgtaggcgccacgtcagcgaaaccgccctccaaaaccgcccagggagtcaaattgcaccggttttaagagtttaggggtcgagatatccggttttgtggtttagggtcatggattagatttcgatcacttttgagggtcatgaagtgaacttattccaattcggattcggcctctcgagcaaatgctattatgtgggccttgtgttgatatgggccggtatctcggcccattaagagcctgtaataaaagtacgaaatgttcttcaaaatgtactgctgtacttttgaatttagtttctctatatactcgtgtaagtcgatcgctctcgttttaatactgatttaattctcgtcccgtttcccctttttttttgcgacaaaaaaaagtctgaaatgtgccgatgtgcttgtgctccacgtgaacagaaccgtgtagtttattttatccttaagagtgtcacttttaaatgtgacaattaactctttgacattggacccacatatcatggaggggaggggccaccgcgcaccgctctcccccttgttgccgcgccgccaccggcctcctcctctccagccaaatcaaaaagagggaggtgaggggagagagtggggcagccgccgcccctggcctcctcccctccaaccagatttgggaaggaagggggagtggggcgctgccaccgacgctccatatgctgccttgctgccaccaacctcccctccttgactccaccagactgtcacccgcgaaagtcgccgccgccggatccaccacacgcttgactcgccgtcaccagatctgccacccgcttgattcgttgccgctggatccgtcggtgaagacggaggaggggggtgtgcaccagtgaggaaggaggaggggtgcacgccggtgggcatctgcagggaaggagaaggagaggggtagggaaggagtgcgtaccgatagggatggagagggagtaaagagttaggtgcggtggagagagctgatcttttaatatggcagtcctcttcaaccgccagtggaaatcgctaaagtgagccgccagcaaaaagatacactttcgttggccagcgaagatccatttttgctggcggtctatagccccattgtcgctggtagttttcacgtatggccgccggagaaaataataaggtgacgccataaaagatcgattttgtagtagcatacgctcctaaagtgttcgactttggcacacgtgaaaaaaatcattaaacatttgttttatacaaaacgccctctacttaattagaaaatatcattaaacaaaagagtgtgtttcattttggaccgtgtaatagacgactaaagttggaaatagaagttgtttaaacttacgaaataattgtatgataacacaatgattatattttctggcccaataagggtgcgattgtttcggctggggcggtggacggtttagtcgcacgcaaaacgagaaatgcgattagtatatgattaattaattattaatatataacttttttatgaataaatttgttggatttttttaacaacttctttatagaaagttttcgcacgaaatataccatttggcagtttgaaaagcgtgctaacagaaaacgaggagaatctaatcctataggctcaaaacgagagcctgtaagaaaaggatagaaccctacacgaaaagtgttcttcaaaatagcttttgaatttgattttttctatcgacgtgtaatgcgtcgcgtacgtctcaaaagtcagactgattttacttgtcgcaaaaagtaattcttatcatgtttcaaggctgtgtgtttagatctaaagtgaatccaaacttcagtccttttccatcacatcaatctgtcatacacacataactttttagtcacatcatctttaatttcaaccaaaatctaaactttgcaccgaaaacacagccttcctctctctctctctctttttctcttgtcgcgtcaaaaagaagtcagaaatgtgcagctgtgctcgtgctccgcgtgaacagaatcgtatggtaggttaatgtctccgtcagcatcatgggatccatgcgatgaaatcggaataaaaaatacgctgctagtaaaatcggttttattttattaggtatgtttaattcatttaaactacgttcagtgtttgggtgttacttttataataattggctgtagctctgatgagcaaaagccgagatgttttatttcattatctaaaaaaagtaaaatctgtttatttcacagagcaattcatcatcgcaaaacttgatcaaatttcagcaaaatatatatgaaatagcagtccaggttaacattttgaaatgccaaaggtaaataaaacgcttctaattaagcattcgatttgggcggcgcgttgcgctccatgaacgccttcatctccttgacgagctcgccggagtcggcgagctccgggaagacgtagaaggagtggatcgccgccgggtactccaccacctgcaccgccttcccattccgccgcagcatcccggcgtaccgccgctgccagtcctgcagcgtgtcgtaccctccgaccaccaccatcgccggcgggaactcctccgccagctcggcgttctcgccggtgacgtgcgccgccgggtggtcgcggtcggcgccctccggcaggaacgccctccagcaccagtccgcgcgcgccatgctcaccaccggccccacgccgtccagcctcagctccgcctccgtccgctcctcgccgccgaagaacggctgcagcaggacgacgccggcgaggcggacgcggcggctcgaggaggtggtggcggcggcccatcggtgcgcgacgtggtgggcgatgttgccgccggcgctgtcgccgacgaggaagcagcgggtgaggtcgacggggacggccgctactacgtcggcggggaggccgacggtggcgaggtggcggagcacgtccacgccgtcgtcgtaggcggcggggtagcggtgctcgggggcgaggcggtagttgacggagacgacgacggcgcggagctcgcggcagagccggcggcacaaggcgtcgtactggctggaggcggcggtgaggagcgcgaagccgccgccgtggaagtagacgacgacggggagcggcggggattccacggcgctgctgctcgcgggggagaacacgcgcgcccacagcccgcgggacgcgtcgacggtgacatcgccggagcggacgccgtgggcgtccgggcgcgccgcggcggcgctctggcggtctgcgagggagaagaggaagcggttgacggtgccgtcgccgcgctgcacgatgtcgacggcggtgacgagggcgaagagctggagccgcaccgtccacggcaacgccggcggctcgggccgccggagctcgtcgccggccgtttcttgctccttctcgtgccccatttcgccggtttctgtgcgagtcatttcagtgtccagaggacactatatataggtgaaccgattaattttttttggaaataaagggggtgtttagtaaagtttcggcgtgtctcatcaggtattatatacggtgtgccataaatgttcggcactaataaaaatactaattacagaatccgccggtaaaccatgagatgaatttattaagcctatttaatctgttattagtaaatatttactgtagcacaacattgtcaaatcatggaacaattaggcttaaaagattcatctcacaaattagtcacaatctatacaattagttattttttagtctatatctaatacctcatgtaggtgtttaaacgttcggtgggatttggggtgggatccacacaggaccaaaattatcccttgatttttacgtgaatattccaatttgatagtagaaatttgaaataccgtgtaactactcgtactacctagaatttaagtccccagcgccgaatttagcctaaattggcattcatgagtcatgaccatatcgtcgaaccaatgaactctagctgcgttcaaatttgacaaattggcacttgatacctctcataatctcatgtacaggtattttaatgcaattccatacgaccatatatagctccgttgcttctgtttgttttgagtataattagtacgtcttcaatttaagttttatagttgaacacattggtactacgtacgtacaacccaatagcttcaatgcgatatgattttgatccaatctcattattgtgtactgctcaactgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggcgaggtggacgacggggttatcggtcgtcgtcgtcgtcgtcgtcgccgtggccgtccatcgctgggccacgtggtgcgcgatgttgccgccggcgctgtctccgacgacgaagcaggtggagacgtcgaccgggccgacgtggtcggggaggccggtggcgccgaggtagcggaggacggcctccccgtcgtcgtacgcggcgggagcccggtgctcgggggcgaggcggtagtcgacggacacgacgacggcgcagagcgtgcggcagagcgcgtcgtaggcgcgggaggccgcggagaacagcgtgaagccgccgccgtggaagtagacgacgacggggcgcggcgacggcgacggcgagtagaaaacgcgcgcccagaggccgcgcgaagcgtcgacggtgatgtccgtcgagctgacgccggcggcgtccggccgcgggtcggccggcgcccggcggtcgaacagggagaagaggaaacggttgacgctgccgtctcggcgctgcgtcgcgtcaatggcggcctcgaaaacgcagagcctgagcctcaccggccacggcagtgccacccggcggcgccgcccgtgcgcgcccgccatttcttggctactccgacggttctaccttttcgtttgggagactgataaaaaaatgcaggttcagaaacaaaattcagagaagttcaggaattttatctttcagtgtgcagccacaaaattcagaggttcagaaagtgttgtttcagtgttcaagcagccacaaaattcagtggttcaggaagcgtgtctttcagtgagtgttcaggcaggcacaaaattcagagaagtttaggaattccttggtctgaaaacaactttcaaagtgatatgaaattgatattacgattgaggcctggatagaggtgacatggagttatggagatcgccaattctccgtacttgaagataacgcagacgctatctttgcggtctcacgccgtaggattgttgtgagaagggtgcaagcaacacatacgacatgtgactatatgaggtcgcaatttgtttgtacgcttatcagttatcacatctctcttccttttcgcaaggcaaattcaggtgattcttgacttaagtattgaaaacttaatcttttttgctgattcagtaagttcagtgcgtactatagcttagtttactgaacatttagaagcgtctgacatgggattttgaagtttaacaggagcaatatcctgaaaaatcccagatagtattaggctgattttgaattacactaggcctacactgtttgatgaaaaacagagtgtgagtaaggatgggtaagaacaaggattttctacgcctaaatgccatagcacccatcatttacatacgacttaaatacttatagaaaaaatttagtaacattaattacgatgatataaatctatacagaaacatgcaagattatatttgatctacaactagataaaccaaaataataatcgatatcgtacaacgcagataaaatttattatttttgtttttcatgtgtatatcgaatttagacttacatgtttgtagtatcttatattatcgtagtccatcttatcaaattttatgaaatttttatataactatttaaactacatgcatacacctgagtgtagaaaatacattcccgaatgcgtaactattggaggtatgtactcttacgagtcgtcgactcatacataatttctataccaaatgccttttttttattttttatttttgccaaacacggtacaaacatactaatttgtcaaaaaaaaaacaaactctaaaaatgaacctggacacacatatatccagattaatagttaggattggtttatttggacggagggggtaaacacttacatacgtacccacacttactccttactatctccaaggactgcaccggtgtaaacccactctctatccgtatgaacatctccaaagactgatccaacatctttcagtataaagcgggtatgacacctaccattaaaaaaagggtaaaaatagttagctgcaaatacgaacaccctagtaagtctatgacatgttggggtgagcatgttttcaacacatgaaacttagccaagtgatcttacactcgcttcgtatgaaatgccaaaatttcatcgcggtggcaatgcatgatcatacaactttcatcttaattcatacaactttcacatgacacttagctgtgacctcaatttttcatttttgaattaaaaaccgttcaaattcaaatttaaaactttcatatgaaaacttaaaaccttcatactcaaattatacagttttcaacataaaatcatacgaaacttttaactgcggccttaaactttcaccttgaatcacagaaatcccaattcaaaatctcaagtatatgaagtgtacgacgcgtgtacggtacgaagcagatcaaactctcgaatctcaattcaggcggtggcgcgcgccgccctgttgctctggacgaacaccttgatgtcctgcaagaccttgccggcgtcggcgagctccgggaagccgtagaagccatggaaggcgtcggggaactccgccacctccaccgccttccccttccgccgcagcacgtcgacgtaccgccgctgccagtcctgcagcgggtcgaaccctccgatcaccaccatcgccggcgggaacgcctccgccagctcggcgttctcgtcggtgacgtgcgccgccgggtggtcgcggtcggcgcccaccggcaggaacgccttccacgagaagtccgaccgccggaggttcaccaccggcgccacgccgtcgagcgccagctcggagggcgtcctctcctcgccgccgaagtacggctgcacggggatcatcccagcgaggcggaggttcttggccgtgggctgccacgtggccgcccagcggttggccacttggtgcacgatgttgccgccggcgctctccccggcgaggaagcagctggcgaggtcgacggggacgacgtcgccgtcgaggcccgggatgccgttcccgtcgaggaagcggagcgcgtccacgccgtcgtcgtaggcggcggggtagcggtgctcgggcgcgaggcggtagttgacggagacgacgacgacgccaacgtcgccgcacagcctgcggcacacgccgtcgaacggcgccaccgccggcgagaacagcgcgaacccgccgccgtggtagtacaccatcaccggcatcggcgccgccgcctgcgccgccgccgcgggcgcgaacacgcgcgcccagaggccgcgcgcggcgtcgatggtgaagtcgaaggagcggacggcgccggtggcggcgtccggggacgggtcggcgcggacgctcatcaggtgttcgacgaggacggagtagagcgcgcggttgaccgtcccgtcgcgccgctccaccgcgtcgatcgccgccgagagcccgatcagctggagcctcaggcccagcggcataggcggcggcggcggcgggcggcggttgctctcgccgccggcggccacgtccttgcccatcttccctcccattcgcgagcttgacgaacactctcgttttcttctctcgctttttcggtgtggatttgtgagtcgtgatcacgcaacgctgtttccgaaatgggcacgttatcgccgtcccgtaaatgaggagtacagtgattgtactaacgtgtcgctgtcggcgatgggacacgttccaaaaaaaaaatatttttccatccatttcacatgtatcaatacaaaaccaaaaccaaaagaaaatttaaaataatcatcgcttcatcaaatcctaatacagttatttatctactcctaatacatttattctttacttcctccgtcccattttcagtgtagccatgattttttacgtccaactttgatcgtccgtattatttaaattttcttaaaaaaaattgaaaacataagtcacgagtaaagtgctattcatattttatcatcttataactacaaaaatattaattataaaaatttttcaaataaaacggacgatcaaagttaagcgcgaaaacttatggttgcacttaaaatgggacagagggagtatttttcacaaatttcggtgtgctaacggtaaacgggaaagttgaagtttggaattgagaaaaaagaactgaggccttattttgggataaatgggagagaaaaaaaatttgtcctcaaacagtggaagtactagtaagaaattgctttagtagaaaattgaactcggaattgttagaggacagtggctgtttaggtgctgaacctgtccagtcagtcgtggctgcgcctgcgccgcaagttcatcagtcaattgcggcatctggaaatccatggcaagaacagagctaacactgccaaaagcccaaaacacaactagagcataaaacggtggggttcggaggatgaaactccgactcccctttgatctctctctttcagcttattttctgcagttttcttttgttcgtcgttcaggtgcccagacgcaaaattcataccgtttaaattaaagccgtctgatacggatgaaatgatctgttataagaaagaggaaatgcaattttcagtgttattccaagatgagagtagatcactgaacagaagagcagaggaatgaactcaaatatggattctgatttcagaaaccatgagatggctaaaaggattgtgggatgaggtcatatgagtccgtagagggtttaactgaagatctctgaatattaacaggtgagcaggtgactgacaagatgacgccgccggctgttcttttgcgctgtcggtggcgagcaatcattttgtgcattagtttaaagcttgcatgtgaatcattttcatctaatataatacttctccattattcttgggataagataatccactaataaattggtcgttgaggatcgtgcctgcgccgcaagttcatcagtcaattgcccgatcaactgagaaccgcatgatcactttcaaatagcaactttccttacggcaatttaatttgggtgcatctttttttcttactggaggagtcaaaacaaactgaatcaaagttcagtgcaaactttgctgaaaattgaacccaagttcagtgtataatacagagtagcatgatttactgagcatttagaagcatataacattttttttgtgaagtttaacaggagcattcatccagattccagcctgattcattatattgagagtgctcctattgattcattgcgaagagaattaacatttcccaagcagtggcactaggcagttatgaaaccatcaaacatcgtctgccatttacacttttggtcttgccatgatttgaaattttaattctttgaacactacagaccaacaaacgagaggatatcagctgctgctatgaatcaacgcttctctaaactgcttagcacttggtacccctgcaaaggagacgcagtatgcgataggagtggggtccggagtttaaactccgaacctctttggtctccttttttttttcctcaaggtaattttctacaattttttttcatcgttcatgtgatcagacgcaaattgaacctgttaaaattcgtctgatacgggtgaaatgatctaataaaagaatttaataaattgcaatttgcagttatttcaacaaacggaaggaaaaaaatatttgatgattccttttcaaatggatttcgctgctttgcacttggacaacacctccaatctgaacttctctgcaggatgattaaggtctaaggagtaaggaacaacgaaagggtggaaacgagccggctcggctcgcagtggctcgcaacaaacaaggcttggcttggctcgactcagttagggaaacaagtaaaacttgagcacggctcggctcggctcgtttcctggctagcattcatgttgaaacacctcttcatatatattttataattattaaaaaaaagcaagaacaatcatcaacatgtaaaatttaaataagtttcaattcttcaaaatcttaatggtaaatttcaagttgacaaataatatctccataaaaaaaataaaataatcgatataaacacatgatggtctaggctcgcgagccaaaagaagttgctcgcaagccagctcgggctcggctcatttcagcaatgagatgaaaagaaggcttggcttggctcgttttgcttacgagccgagctaagccaaccaaggttgagccaagcccgagctgagctcatgagcctaagctttttttttttccaccactagctaggagtggagcgaccggagcgagcgaggagacggagtttgtgatgggaaaggggttggagtttcaaactccgacagaccgacatcctttggtctccttcttttcagttaacgttctgaattttttttcttcgttcattattttgatcagacgcaaattaaacctgttcaaagccgtacgatctgttaaaacagaaaacctattttgcggtcattccagtcttccagatgaggctaagcaacgaactgccgaactgctaggagttcttattcggaaaaaaaaaaacgaactgcgaggagtgaggaatacaggaatgaactcaaatatcgattctgatttcaggaaccatgagaggactaaagcctaaaggtagggggaagagttcgcatgaatcagtagaggttttaactgaaaatctcagaacataatggccaaatatttaaagtgaaatgctgataagtaccaaaaactacaagtttcagaattttaatttcattgtcaatttgtaattggtagttggaattgaacctgcctcacaggagaagggaatactatgcacaatgatgctatacttttgtaatctttgtacttcattttagatagcgtagcacctaaaaaaatcctccttaatatttatgtgatttttttaaacttttaattcagctagccatcttttttagaggagttggggacctgtcccatcacacgataatttttgttttctcagatggctgagatgtaaataatttccattattaaaagaaattgaaccatccccaataactgaacagtactagacagttctgaaaccatcaaacactatctgtaatttacacttgtcttgtcatcatgccatggtttgaaattttgattccttaaatcctacagaccgacaagcgagagaaaatcatctgctgctacgaaacatgaatcaacacttcgctcttccagtttgatgattctttttcagatggattttcgcagctttgcacttggagtgggggtcggaggactccgatcccctttgatctctttttttttcaggccatgttctgcattttgttcgtcgttcatgtgagcagacgcaaatttatacctgttgaaagccgtctgatacgagcgaaatgatctgctaaagaaaacaatttgctgcatgaactgaagagcagaggaatgaactcaaatatggattttgatttcagaaaccatgagtgggctaaagtgtagggtggtgaggtcaaataaaccattagtgggttggactgaacatagtgaccaaatattatcggttgaaataccgattaatatcggaaattagaaatttcagggtcaatattactgttaatagtaattggtactgttgaacttattagcgtgctccccaataaaatccattagacccctccccctgatgaagcaaatcagattgattggtccacaacaaggaagaaattaaggcctgatttcactaatgatttcgactgcatggacttttgtggaagcacgtgtgtggcggcgttttgcagaaattaaccaatcaagcacttggctagcataattcctttgttgttttcttcctttaggtgatccatcttctttgtaacatttcttatctttcatgtaattcaccaactcttcttataatatatatattttggtaaccctccattgaagctagccttttgcagcctctatgttcatgaatgtacgtacagtaattaacctgtatgagcatcagcatcagatcatcattggaatcaaagcaatattcaagcaacaaaccccaagaaaagcgaagggaatgacaatattatagttgtgcctcagcccctctaagtctaaggtttgcctctcagccaccctaaaatttaaatattaaaatttaattttgaagttgattttagagtttgtcgtagtagtttatttttgacaccggctttcaaattgttaaacatgcatatataaaaaatgtattcacaaactatttttttctttaataaatagttgtaggtgaaatgatggtagtctcactatccctcttgatccaaacaactccagcttgcaaagacattttgccagataattggcatgcatgcagcctaccattttcaatattttaaatagcgggctaagatatttagcggttagcttctaaaactgctatagcgggctaaatggagctataccggctaaattgtacatgaaagcaaatagctagaaccctctcaaacagctatagctgaagaccctgaccatttctcatctctataaatagaagtgcaaatctcgagctcctaatcacaggcagctgcagctagctagctaagcttggataacagtgcaagggcgccggacggctacttggtccatggcgtctctgacgatcgtcgtcgccaccatcttcctgctcagcctcacctcggcgagcgtcgccgtccatggccggagcagcaggaggaggttcgtcaggagctacgacgagccgtgcatggagatgaggctgtacctccacgacatcctctacgactacagcaacagcacctccaactccacggcggcggcggccaccaagccgacggcgctggccaacgccgtgccgtcgaccggcggcaccttcttcggcgaggtggtggtgttcaacgacccggtgacggaggggagggcgctgccgccgtcgctggaggagacggcggtgagggcgcaggggctctacctctacaacagcaaggaggcgttcaacgcgtggctcgccttctccatcgtgttcaactccacggggcgccgcggcacgctcaacctcatgggcgccgacatcatcgccgagaagacgagggacatctccgtcgtgggcggcaccggcgacttcttcatgtcgcgcggcgtcgccaccctccgcaccgacgctttcgagggcttcacctacttcaggctgcagatggacatcaagctctacgagtgctacgtatgatgcatccatccatggtcgtataatatatactccatccgttctaaaatataagtatttttagctatgaacgcttatattttaagacggagggagtaccaaacactattcattattgtcgatgcaaatttcagtgaagatgtgacatctttggtcagggagacaaatgatcagccaattgacaaggtgatctgatgctcctagcttcgtctacctatagatttatttgttgctgctcccatcatcagatcagaccaccagctgtatgagtatatacacagtttgtatgctaaattctttctaaataaacatccttatgcaaatgtgttgataatgaatctatctattatatactaaaagtccattaaactccctataaacactctaaagccaccacgtgagactcctacaaacgctcctagattgccacgtgccgctttaataaatcttacaaattctaagaaaaaagcaaaacatctagccatcaattttcatttaatttggtggatccaccaccaactgcagccgccgccccaccaccttcaatccctgccaccaccaccaccaactgccggctgccgccgccacctcacgccgaccctccgccggtggcctccccaccagatccggccgcggcggcccggatctgggcggtcttcactgtctactgcgcggccctccaccgccgacgggagagggagacgaagatgacgaagccccgccgccgccgtccttgcggccgcgcggctttgccgatggccgcttgggcagcggcgatgcggcggaaggaggaggggggggggggagcaggcggcgccggcggtttccgcctcccgtgtcgcccatgagggaggacgacgcgggagcgggcgacgctttttgaactacgccttcttggtagcatgtttaatcaaaataaaaatcttcttttcattaaacaataaaagttgacaagaacattgtatataaaaaagagagatttaattagattgtttatgagataggattttgtaggattattgcaggaatgactccaattttctcctaaacagttaatttatgccattggaatgattttgaaaataacatattataatagtatatgtcttacgattgcaaattttgttcccatttctacttttagaatttcttatatacaaaacataattgtatctatgaaaataaaaattatagttaattatatacatattattatattatgtttttaaatctggtttggcgcaaattaaattgcatggggaaaaacttgctaatctcatcaatgatttttgactgctcagatttgctaatcttctagacaagctcacctccgggatccggctattatgccgggtttcaggagattaagcgattggctaggcgtagatcacttttcttcctttacgactttaagcactccctcttctatagatacatgtaacatcgatctcattaattcacccactctaatttcttataatattttaatagacatgcgaccagatctgtcagaatttttttttctggtaaccctcccttgaagcctttgcatacctccatactgctcataataacatgttacaataccctgcatcagcatcagaaattcagaatcaagcattcgagcaaacagtccaaagtaaagagaagggaataacaatataaatatataaatataatagagtagcctttgcttatatctcactccctcttgatccaaccaactataggatatgagatttgctccgatccaacaaaaagtactttgagttaccagtacctcacggtaccaaatcattttcgatcattggatctaacagtacccattctgtccagttagattcaacggtcgaaaatgatttgataccgtaaagcaccggtaccttgagatacttgttgttggaccagagcaaatctcagaacctacagcaacacattttgccaggcatgaacatgcatatattattccatttcacacctctataaatagagatgcaaaactcgagctccatcacagctgcagcaaattaagccagcaacacttgctaagtggagtggagtagctagcttctccagctagttagtgaattaagctcattaagctgagttaattgcactaacttactactccaagatagcaatggcgacttggtccaatccctccctgatcgtcgccgccatcttcctcgtcatcagcctcacctcggcgaccgtcgccaatggcggccgtagcggcggcggcaggaggctcgtcaggagctacgacgagccgtgcaagaagatgacgctctacttccacgacatcctctacgactacagcaacagcaccgccaactccacgtcggcggcggccgccaagccgacggcgctggccaccgccgtgtcgccgaacggcaccttcttcggcgaggtggtggtgttcgacgacccgatgacggaggggacgagggcgctgccgccgccgtcgtcgctgagggagacggcggcggcgcgcgcgcagggggtctacctctacgacagcaaggaggtgtacgacgcgtggttcgccttctccgtcgtgttcaactccacggggcgccgcggcacgctcaacctgatgggcgccgacctcatgtcggagaagacgagggacatctccgtcgtcggcggcaccggcgacttcttcatgtcccgcggcgtcgccacgctccgcaccgacgccgtcgagggattggtgtacttcaggctgcagatggacatcaagctctatgaatgctacatctgatcattacatgcatgttttttttaaaaaaacaaattgaatttccatttttttttaaaaaaaggtgaatttccatctcgatatatagttgcttgatttgcgtgacgagttatatgcaccgacgagtgtgcaaaatgtatcccaaacacagttttattttccccctaatttgtgtgtgtagaatgtatcaaactattatcgcacttttatttcattcaataaagactaaccacataatcgtgttttgcgcgactttttatcctgtttaagaacttttgtatgtggtctattagtttaccttagctcttaataaggttttgatataagttaatttatttataaagtatctattatcctagccaacaatagaacttccttcgtcccataatataagggaatttgggtggatgtgacacatcctagtgcctctcgagggtcggcgccgaccctaggtgccacatcggcgcaccagatagaccaagaggccagggtggcagcggggaagatgccagcattcgttgctgcttgcaaaaatagttccacaaaaaaaatgataagtattccacaggttgagtttttatatcttaacaaacatactgtttgagacaccagaatccaacagattaaattctggagctctgtctccctattaaccatctgcagggaagtcttattctaccagtcgtcacaaaagttgatacaagctcgaaagtcgagatcaaacaaaaaaaaaccaaccgatccgtagattcgctacataagtaactatagttgccatgaaagtaaaagaaacacaacagctgatgacatttgcactttgagatcggcaatatcaacatcatgacctccttcaaccaagccccatctatcaacctgggggaattaaacaccataagacaagagaaaagtaaatagccttaataaagatagacaatggttgcagaataacctggtgatcttcttcaagtctgatcaattcaattgcctgctcaattcccagcttccctctgaatattgcgagagggattaccagggaatgggctgctgctgccatagcatcaatagatgccaactcaaagtcggtggtattcttcaaaacagtttctacagcattagctaacccttcatcttgctttccaccaaaaaagcttgtgtatacaacaggcttgaagccaaactcagtgtttacccagtctagtatagggtcaattttctccttctgtctttctgcacacacacacacacacacaagaagcataagaaagacattgctggagggaaatgaagagaagacatcgctaaccaaaatgtatggagttatatgctcacaacactatgaattcatatggacgtcattgcatacacagtcaagaggaaacaacttacgataaactcctacagtcagctcattatcatcaggtgaacggcagaataccaaatcttggtggaatttcttcatcaaattatcaattattttttttcgtgtcaatggaactcgttccagtgcagtgcaagcaagcttcataagaggcattgtaaaaggccggattccatctgcttcctatgatgtcaagaaagtttggtatcagtatatgttacataagaaactagaaaatcaaatacataaagaagagacttgcaaagaagttaaattcaaatataattctgggctgtgtagatgagaagcacatcaagtaaacagaattcgttgtaacatctcctgtcacttgtaaaatagatgatgtttgattgcagcaattcagccatgaacatatgttacagttgaaggcagtaatcaatattaattggatgcacacccgtgatgctaatataaccaaagaacaaacaaaaccgattacttatgacatgacagatcttttaattcacatatgcaatatggaagtatagagcagctgactacttcctaagtttacccaccgcaacatataagtacagacatacatacattttaagggttgccatgtgaatatgtgatgcaaatgcaaaggcgcaattgccttatgaagtttgcttttacttagctgctggaatcaacctgataaatttgaatacagtccatcttgtggtagtactattatagggatgataagataagaaccagacaacaaaataactctaaatgctgcattcttcatatcctactgaaacaataactctataataccagtatccgaattaattaggagtcctggtcatcttctttgctacttcccccgtttcacaatgtaagactttctagcatttcccacattcatatagatgttaatgaatctaggtatgtatatgtgtctggattcattaacatctatatgagtatagacaatgctagaaagtcttacaatatgaaacggaaactattctttaaagctgaacaatatttgtagttattctagctgctctagccgcaacagggagaaagaaaagaaatgtaatgccaaaaccacctctaattgcacgatctaaatcatcgatgccactgccactgaatagtacactatggcaagcgagattcactgattgaatagatttaaattgcacaaaatccttccgcaactcattacagttctgggttaaactgaacttacaagattaagatcgacctaagcgctactagtcacccaatttccatttcgaatcatttgatttaccatcttccatccgaatttgagtaatcttacactacagttgagcagcataaccaatcgagggccaatcaaacagaagatggggatcatgacctggtactcccactcggcggcgatggccatggcgagcgtccgcgactgcagcttgagcggccgcttcgccggcgacttgagggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatctcatctccccctcccccgcccgcctcttccctccctcccggagaggaggacgcctccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaactccttcgatcgttttggaagtggtttctactgacatgacagtttgaccacggtttaacttgctaagtcagtagatgggatccacgtgtcagcgactttcatgtcacctcatcttcttcatcatctctctctctttcgggctcattcggtttaaaggatttttataggattattgtaggaattcaaacattaggatttttttcctatatgcctcattccttccattcctataaaatcctatcaaatacctaaggattatagccttacaagcttattccatatgattcttattatcatgagataagacctcttagaaaaattcctaagaaataagatgcatctaacatcctaattctttaccttccctgtacctttgatttgggaatcctataaaccgaattagccttccatctgtccccccccccccctctctctatcatcaggctcaataactaggcccatccgcaaaatcggcccgatgtttgaggcccaactaggcccagagaggttcgagacgcgtggagcagcttcgtctccgcggcgacctaaaatcgcgaggactacgaccaaatcacgcaccttcgctctcttttccattgcagagccctcacgcttccgcaaccaccaccgcgtccgtgatcccatccacctccatcgccgccgccgccgcgtatgcgccgccggtgaccgggatccatggcggagccggacctactcgcgcccttcgccgacctccccttcccccccggcgacgatttccccgacttcccgaccctcggggatgacgccttcgcgctggaggatttcgatctcgacgatctggacttcgacttcgatgtggatctcttcccgccggatgcgccgccgccggtgacgacgtcgtcgtcgtcctcggccgccggatcgccggaagcggggacgtcgtcggccggcgacgggggttccaagaacgaggagtccgcggattcgtcgtcgccgtcgaggagcgggagtgacggcggcggcggcaaggatgggaaggatgatgaggcgaagcggcgcgcgcggctggtgcgcaaccgggagagcgcgcaccagtcgcggcagaggaagaagcagtacgtggaggagctggaggggaaggtgaaggtgatgcaggccaccatcgccgacctcaccgccaggatctcctgcgtcacggccgagaacgccgccctcaagcagcaattgggtggcgccgccggtgctggtgccgccgcgccaccgccgccaatgcccatgtaccctgcggtttacccattgccgatgccatggatccacccagcctacgcaatgcgtggctcgcaggtgccgcttgtgccgataccccggctcaagacgcagcagcctgcgtccacaccggagccaccggccaagaaggcccggaagaccaagaaggttgcaggtgttagcctgcttggattgctgttcttgatgatggtctgcgggtgtttggttcctgcggtaaatcggatgtatggtgcagcgtacactggggaaggcgctgcgattgttccgtcacatcatgggagaattctggctgttgaagggccacaaaatagtgtctcaaatggtgttgatccgaaggtacctcagaatggaagcgaaacgctgccagctttgttatatttgccgaggaatgggaagcatgtgaagatcaatggaaatctggttattaagtccattgttgcgagtgagaaagcctcttcccgtttgtctaactatggcgagaagggttctggaaaccaaggaaaggaggagactagcttagcaatccctggctatgtagctccgttagaagctggagaagtcatggattctgctaaaggaatgaatgaactgatggctctggctcctggagatggaagcatatacagggaggatgatgggatgctgccgcagtggtttagtgaagcaatgtcaggtaagaatgctgcataatgtcgcacgcacaccctatttaatttaaatgaacaatactgtatatgccttgttggtgtttgtaggacaatgtggcacttagtgcgatgaattgtttggagtataacacttactatctgctagagctagcgatcttaatagatgaatgtagtgcttattcagtgctggaagtagaagatatctgcatatattacatgttcttttgccgtggtaaagttgtaaacttattgtgggtttagtatgccactcgggtggatgattaccaatataccatgatacataggaggcgatcatagacttttgggtcagtggttcattgtttagtcaccattgtgaaaagctcaatgttgtagttttttccgttgcggtatgctattggagaaggtaccattgcagcatatataattaactgctcaatgcatatattttgttgactggaatgttatgttctgaattactgctaattctgtatattttatgatatttaatttactattgtacagtatactatttatgtacattagtttgacgagtaaattgcattgccggtacacgaacttgtaaaatgctcgttttggtgcttgaatttgtctggtgcatgcggaggaaggcaaaaaggacacaacatggctaatcttattaatttaggggctcattaggaaattatgtaaacatatatctgagaaggtttgctattagacatacacctcttcaataaaaatagaatggatatagtgatcgtagaaaaagataaaaaaaacaaacaatgatataagggttagaaatatatgaaattcatcactttcatgatgaaggataaagtagagaccacatttataaatattgcatgtcttatgtacactcactacacgtatgcacgtcacatcctaatcaacattagcttcgtaaaattaacattgccaagctattttggtcctcattcgcacgaactagacaagtttgtgtatcgaaacaagcatttcacaagtttatgtactaaattgcacccacctaacaagtttgtgtactaccaatgcaatttactcttagtttgaccttataaacttcctctggacaaaaagtcactgatcgaatgaattgattatatccttagctgcctctgtatagttgaattcaaccttacatgtataaccatcacaagtaggtatttcctttgtttgctgaaattcttccattacacatgtcctgtttatggacatatggcacaattgaataatatactggtttttctaaattgtgtagtgaggtagtacttagatttgtgcatatgtgaagcacttattctcttttttgttgatggattagtagagtgatgaaacatttgtgccttgtgatgtagctttgaccctaaccttttaattcctcggctgatagttgttataagtagtttgatgacttggtccttcatttactgaagttaaccctgtctattgattattttccaggtcccatgttgaactccgggatgtgcactgaagtattccaatttgatttatctccaacaacagctgatgcaaatggcattgtgcctgtctactctgggtcagtgactaacacgtcacaaaattatactgaaaatcttccttctggccctgttcagaaggtgaagaacagaaggatttcgtactcagaagccatccctttacgaggttcgacatccaatgacacggatcatttcaaagcaccccccaagaaccatagtcagagccatgctggtcgtaagccagtttcgtccgttgtagtctctgtcctggctgatccaagggaagcgagcgatagggatggtgaggggaggatctcctcaaattctctgtcccgcatcttcgttgtcgttcttatagatagtgtaaagtatgtaacatactcttgcgtccttcctttcaaaagccatagccctcacttgtaatgtaagcaagttttacaacgtaatctgtaacagaacggatctccaaatgagctgactttattgtgcgatgttgatagacatatagagccttttttttttctttttactggattaccagtttattgacaggaatgagtgttggttccttgtctctgtgcttgtgtttccatgcctttgtgatgcatggtcttgtttggaatgctgggatgtcgaaatttctctgaggttttcgcgttccaaggaggcataattcattgttgcatcaccgcatggctctctggttcttgtagattgctggcagttggcagtaaaaggtagtttctttttattactacaacataacttgcatgtactccttttccttttgttatctgtctttcaggtaggtgatttgcgtattttcttgaaacaagtggcattgttttgttctcatgccatgctactcttagcaggatgtcagggatatcattttcatgtcgatgtttatgatcactaccaattgtttgtttcacagatatgtcctcaccacttacttttgttggcttgtttctgttagtttttgcttgtacatatcgtagacctgttttcattgataggaagcaaaacctacagaaaattgttgcttcataagaggatttaagcattcgcagttttttgtaatcccgagtctgaataaagcaaaggtaacctttctacttccatcatggactcacttgaggtgtggttagagagtcttgaccaatgcaacccaggccctagagctgctgacattatccatcctgtcaagtcctgaatacacttttatctgctccttttcatcagaggccaaaagcctggtttagttcccaactttttcttcaaacttccaacttttccatcatatcaaaactttcctacacacaaactttcaatttttccgtcacatcgttccaatttcaatcaaacttccaattttaacgggtactaaacacacgtattacctacatattttctgtggcttctccaaaaagaggatcatgttgcttgatctgtgtgtagcgtgtgttgctcacttgtgtgtgctattaaagacactaaacaaccattgcggatagcattaagttgtgatttgacattccaactgatgattcattggcgccctcgttacctactggactactgtggatccttcctgtgatcatgtcctggtctttctgatcatgcacacctacttgtcttttgtaccggcttactccgtatgaatggattggtgagatccgttgttgattgggattccatcacctaattcgtacgtagaccactttgatctcgtcagtgagacctttgttgattttgtcagtgtttttgctggatggaacactctgttgtcggtcagattattggaagaaatagcagcgctcctggttcaggctgctgtcatagtgctgcctgaacttgcaacatttaggcccggatgcaaatcgtctgctggaccgcacctgcagtaggtgtcactgacatgtgggtcccacctacttcgggcccacttgtaagtggcacctactgcatatgcagtacagcacaggatctccgcactcttaggccccctttgatttgcaagatagagaaaacataggattggagaaaacacgtgattttaaattttggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaaatatgtccccccatgctgacttcgtgctcttcttttagggcccgtttagttccctaaaattttttctcaaaaacatcacatcgaatctttggacacgtgtatgaagcattaaatatagataaatagaaaaactaattgcacagttatagagaaaatcgcgaggcaaatcttttaagcctaagtagtccgtgattagccataagtgctacagtaacccacatgtgctaatgacggcttaattagtctcaaaagattcgtctcgtggtttccaggcgagttctgaaattagttttttcattcgtgtccgaaaatcccttccgacatccggtcaaacgtttgatgttacacccaaaatttttcttttccccaactaaacacaccctaatacttcgtctgcatcttgagttcaaagctgcctctgtgttagccctttgcttagctactaatcatcccacatatttcaaaccatttaaaatccaaatagtcctaataacctactgcattaacgtcactactagagatagtgagagaagataacaaagtgtgttctcgctgacgaaccaaggtgatttcttctatatatattttgcgtttttatatgattttttaagttcgttgctaggttgcatctgctatttttttgcccccaatttttgatggttctaccaatatccgaagcctcaaaaccctatctttgtcactctcctgcttgattctgcctacgcatccgaatcttggccgctttgtaagctgaatgtcgcctgggttttctcgagcggagtaactgggtttggatctttgttcttcttttggtcgccattttggagttgaatctcttcaccgcgtcggacttcttccctctcctggggattctttgtgccgcaagttcttggtgagccattgtttgagcatttcagggttttctcgtctgcgccttcctttcccccccatttttggtgctcaatcctgcttgaggtttttattttttatttcccctctatttagggttcttgatttccatccaattgttgtttgctgctctttttgaagcgtttcggtgaacagattgttgtcattagcacttcgtttgtaggttcactaagtttcttttttttcttggtttcattttgcaagttgttgctaactgcaagaatctgtaacttaccagaatgcagtgtcactcatccacaaatggtgatgcttgtttgctgcggacaaccggaagaagcagaattcggccgatatagtaccaaattgcaataagaaaatggtactgcatgattctagttttgtatctctgatatctgatagcaacaatatttgatcatagttttcgtattcgcagcatccatattcacttaaaagttccaagggagcaccgtttccaccgcgaccgattcttgtcttcctcattgcaatatttggattctatgtatgctacatctcctttaaccagataacactagagaatagatctgaggagaacagtggagaagtgcaggcagaaattcattgccgaaagcctcatcttcctcatgaggagctgcgttatgtgcactttccgaaacctgagagttatagcaggtaattttcctctagagtagaattattatctcttagtacgcccctgttatggatgtgcattttctgattcatgttgcttcaaattttccttcttccataggggagagtgttcctgcaatctggttcgatcctttgtgcttgtatctatgcaacggtcgggaagtggatggtttgagactttgctgaacagccaccctaacatcagctcaaatggtgaaatatttaacagggtggatagaagagagaatatctcatctatcttacagacccttgacaaattgtataatttggattggttcaccagtgcagcaaagaatgagtgcacggctgcatttggattgaagtggatgctaaatcaggtatatttcagcttttcttggtccatgtgaatattagagggttagctctctgttacattgaacttcagaaatcgcacacctttctctgaaacttaccatagtccatagttaccgacagtgtgcactagtcctgttcttgggcaatccagttcatatagtctattcgcttgctaaaattttagaggtatagctagaatttttaacagaactacagggtaatatgcttgcaattcccaatgatatgttctggctgctctttgtagttgtacaacacaaactggtcagctatgattattgatgttggcatttgtgtgttcaatctcattcatcaagcattattgcatgggtaaaattatgcctacaacttacaaagttatgcatggctttgactgccatcattgtgttctccaggggtttatggaccatcatgatgatatagctagttatttaaacaagaagggtgtttccgtgatatttctcttcaggagaaatacattgcgcaggcttatctctgttttggctaatgattacgacagagatgcgaagcagctgaatggaacccacaaatcccatgtacactcaaaagaagaggttatatccatgcaacagtttatgtcctctccttactattttcagttcatatttttcacattgaacatggtttcatactaggtgcacttttgatgaaatatgaccatagtatatttgaatgcatatgggaaatattgtatcaatattggaggaatgactatattgcatttggaaggagccattttctctacatataaaagggctcctcctttccgaacttgtacccttatattaggttatattatagaatatagacaactactggacttctggtatagatattttggtgaaacttaaatcctacatatttccattccaagagaaatgtaacatcactatcaatcatgttggcaaggaagaaaaaaaaaatgaaatgcttatatattttttctgagcaggctgagatattagcgaaattcaagccggtgctggatgtgtcaaatctgattccaaacatcagaaatgccgagaaatacatcagagattgcttggaccacttcaacaccacacggcacatgatcctctactacgaggatattgtccgcaacagaaatgtactaaaacatattcaaatgctgtaacgaaggatcaatgataaccctcgctttgctaaaatatcatctctatgaatgcaggcattgttccaggtacaagaattcctcggagttccggtgagaaagctggtcagcaggcaggtgaaaattcacactagtcctcttccaggccttgtcaggaactgggatgatgtgagcaacaaactgaatgggacacagtatgctcattttcttgacggtgcagattatgtcaggtgatctacatggatgtgagcgacaggattttttttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgattgccttctagcctaaaagagggaataaaaagcggggaatgtacccaatagttagtacacgaaaaaatggtcgcagatcaacaacggattaataactcccgtaaattcttgtacaagagcaaaaacaccactcaaaatcatgtttacaagttgttacagctacaacatcgttaagggcaccagctaatggtgtgggcatcttgacagtggcagatcattgacgccttcgcttaatcctctcaagggcgccaagctgctcattctcctgggcaccagagctttcctcctccctgttctctgcagctctcttgccgagctctccaaacaccgcagcgggaacactcttctccgcaatttggacatcgtcttcctcctcgtcgctctcatcgggcagctcaatgtcctcattgttagtagcagcagcctgttgttgcctgctgctgctctcagcctgtgcctgcactccagcactgacaaagttcatcatccggttagcaggagcagtagcagtgcttggagctggtggagccgtggaaggtcctggcgctagttgcctttctaggttagccatctcatcctcaggaacaccggctcgtttcagagtgtcaactgcctcatcgaggttcagcctctggtccctctgcatcaagtactctgggagtatgaaatgagtctgcacatgaaacgaaatacatcattttagtttactaactcacaagatgatcattgataataccaaactgcctataaggttggcccttgtgacatacctgactgcggctagcagccacagtacgcttgatgcgaagcatctccctgaatgtatcttcgttaccatgctgaatctcaaattcattccatttattccaaaattcaggatgagagtttggatcagcatagttggatgcgtggacataaatggcacgggcacgatcaatttctccaaggtttctttcaagttctgcaaatttcatgcacattgtcatgacatctctgtctgggagtccagattcaattgcttgctgcagcacaaaggaataaagttagaatcatttacagttgtgcatacctaaagtgtgactcaactaaaatctagaacatactatacagaaaaatagtatctggatttttcataagtatatgggttgttacagcgagtgcagaatgagttctttgattcatacgaacagttagcaaaaaaaaaaaaaaaggcaaggctgttggaatgtaataaaacccacattaattttgtcttaaaacagcaaaatgtaaaactggatctcaaaacaagcacacgatataaccagtattagtaagaaccaagataacacactcacctcatatatctgtcttgttcttggaacaccaaatagctccgcagcccgtgcaatatatatttcgtacatactcatcttttcgctgttaggaacagcccttacagcttcgtcgtatacattcattgcacgtttcgcaaggccatagtcttcctccagcttagcatactgcaaatacaataccttcttttcttgtggaggagcctgatcaaacaaaacaaaatgtaagtactgaagcaatataggaaaaacatcattttcaaaacagcatcgatgcaggaaaaaggaacacgaaataatcaaccaaaggtttggaatctaaacaagcaagcaagcaaatgcaaaatatcgcatgacatgatatcagcaagcagagacaaggttcttaaaggaagaagaaagcaggcgcaacaagaatcgccctgaacttattcgtatgaagcaaggacaaaatttctgattgccagttatacccaaaaagcatttggtaacatgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccctcagcagcagctgcacaggacatattgcattactgttagaaaatatgaacagtaaaacacacaacaaaaaataagatggtaaatatatatatatatatatacctcgcctcttaacctcaacagagggttctgcagtagcttgcctcatcagctcaatagccttgtcaaaattactgtgcctcagctccatctctgcccactcacaccaaatactggctaagtggtcaactgccttgtagttcacctgtgttgcttttttaaagatctcttcagcactatctagacgattatgtttctcatacatctttgcgaatgccacccatagagtatgtggttttccagctgccttcatagggtctacggttttcacagcttcaacatatgtggctacttgccttgtaggatccttctcaaaaagtttcaccctcctgcaaacataatcgtattgttagccaattccatcaagtatgagaatggaaaacacaaaagggaactgccaacatactagtacattgctaggctgagaaatgaaaacacctgccactagattgatacattccacagtatacatgttttgaattaaaatttaccacagccacttactgcactaaagaatccaaaacttgtcgctggaaagaaatatgtactacaaaaacagtaaattgcaactacaataaaacagtaaaaatacatagaccgtatacttacaaccatatgtaatagtccagtggggtcttgcattagtcatttaatatatcacctaaaatatgagaagggaccaaactttttgcagtaacagtacatttggtttgctggtttaacatgaattatccaaatcaaaattgttctactaggctggaatattgagatgctactaagttaagatgttgatgttgaaaaaataaacagcatgtacatgaagtgaactaaagagcaaattagtgtttactattgtcaaaacacatgaaaaagaataaatcaatgtgatcaatcaagtgagtctcacctgtgccattcctccacattatgcggattctgtcgcagcaggacactgctgaggagctctggccggcgatccaacagccgctcaaaccttgccagcctcaaatcagtatcatcctcatcattcagccagcaatctgcgaggaatttcttcgacagcttgtccatcccattcttcctgcccgcttcctcttccccctcactccccgcaccctcctcctcggctgcctccagctttgccgcaagcatactctgctcgaattgtgtgtacgcctcaaacaccacgctgaattcctgcaccgtcatcaccgaagcaaccccctcttcgaagacatccctcgccttctcatacaaggttcttctgacgtagtaatcggccagggaggtccacagcttgccaacctcatcggtgaacttgcgaatgccgccccgcagtatagcgtccaccttgagccccgcaacctcatcggcatgcttggtgaggatttcgcagagctcaagccagagctggtgctgggtcttacccttgacggagcggaagccgtcatcgttgagcacggacgcgaggcggtcggcggcctcctgccagcggtttgcggagatgaggaaatcgatgaagtcctcagcgtgggaggggtcgtactggaggtatcgtcggaagacgcggagcgaggtctcgacggggcaggccgggagcgaggcgaggcggaggtagagcggccagatgcggtcgtgctgcgtgacggggagcgcgcgcagcgcgcggtcgaaggcgcggcgcgcgcgcgtgagcaggcgctggtcgagcagcgaggtgaggtagagcacccagacgcggggcatcttgtgcatggtggcgagggcgcgctcgaaggtgttgttgagggaggcgtaggcgtggtgggagatggggtgcgggcgcgcgtggtcgaggcgctcgcggaggtaggcgtgccacagcttgtagctccccgggagcgccttgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaagaaatgtcactgccaaacttgccaggtcctgatgaaggcaacagaggaggaaccctgccttttgcctgtccacacagagatacacacccaaggccgtgattagttgcatttttttttcaaacttctaacttttccatcccatcaaaactttcctacaatcataaacttctaacttttacgtcacatcgtttcaatttcaaccaaacttttaattttggtgtgaactaaacacatcccaaatcgtctctgcttcttgctctccacggagaagggagatcaccggcgcttccacgagttgctcctcgccggctcgccgctggtcgcctcggccgccgccgccgctgcagttcgcgagaagcacttggggtgctagtgtttgggcccaaatggaaacaactgcacgaggcccatgtagtccggcccaatatgtatagccagtataattcgatcctttatatttgtggtcggaggtggtgagattaagctgcaccgccattttagattagtacgttgtcagcatcggtagcgccttcacttttaatacttacccgtgtctccatcgcaaaatataataagttttgattagataagatacatcctaatattataaatctagatagatcgtttatccggattcgtggtattaggatatgttctatctaatcagaacttcttatatattttgggtagaggaagtacttgctctatccactccaaagaaaagcttagggcatgtttactttgataccattttcaaccttaccaaattttggtaaagttgtcaaaaaaaagtggctacatttagtttgctgctaaattttggtaactatacaagaaatcctatcaaaattttagcaatttgccaaaattttagtaactatgccaaaatttggtaagattttttttttcatcaaagtaaacaggcccttaattctagttatagaactggatgggtgcttatcaagttcatagatagaattaaattattattgtttttataataacaggtctactctctccatctcaaaataactcaatttgtgatagtaatgtaacataaactagattcattgttcgagtcacttgggaaggaggaagtatagctcaggaacgggagaaattcttggcgtgcggcagaggaaagctgtcattgccttcgtcgatgatgtgtgctgctaatgtccattgcacaacactgattaatttatcagctcattgacttcaatacattcaagtattcaatcacatcctaaattaatggatacaagggcacgtgtccagctgtcgttggttcaggagctgatggcctggtgctgatcgagacgctagctcagctgcaactgcaagaatgtaaaacaattaattagccaagctgactgtaatcactggttcagaaactgatcctgaagatctattcacatctcaaatactccctccgtcttgagtttttcttgcactgtttgactactcgtcttattaaaaaaattgaaattattatttactagcaaatatgtccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtggttttttaaaccgtttttattttctggcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccatttactttggaattttttcgccctgttttcaccacgtcgacggagtcggattcgtttttatttttcccctttttggctttttttgtataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttctttttattttttaaactctttttaccgtgtcgatgtagtcggattcgtttcggtatttttttccttttttttgtcggacatatttgttttttttccgcccggttttttttcgccaggtttttttatcggacttttctttttttttcgctcggtttttttctcccgttttttgacggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatatttgcataaattttttaaataagacgagtggtcaaacaatgcaaataaaatctcaaaatcccttatattatgggacggagagagtgtatgtagtactacttaattagtcagataattcagagctgctgctcgaggtcgtcgttgatgtcggtcaggctgatctgcccggccggagagaggtcgtacgtcaccggtgaaacacctgatgacctgaatggtgatgctgctgctgtccagcttctccaacttccgcatccgtgtcatctcgacccatatttgctgtgtgcagcgcattgccaaaaaagaaaaaaaaaacagagagagaccaattgacagatatgtgcagcctgagctgatttgagttctaaactaacaatattcagttcaattcaggggcggatccaacgtgggtgagtcctccctacacccacaagacccatggataccccggagcacctcattcaattttttcgccataaatgataaactaaaggtctctaaatggctggaggttaaagaaactgtgtaattaagccccccccc

SEQ ID NO: 43079 - DNA, 13538 bp, Oryza sativa
ccccccccccccccccccccgcccctggttcaattcaatctcttattcgaaaaaatattcagttcaatcagatggttttattttgtgagttgtgctagctacctcattgcggttgatctcctcgagtcgtcaatagtgagtactcgtgacggtttagtactgatcaatggtcgaagacttgaattttacaacttaatttaagttaattttagaggtttattgttgtactccatttttagtattgtcttttaaatcacgaataattaatacatgagtaaaaattgtaccgtgatttttttcttcatttatatttctatagcttattagctatagctgaaccaatcagagcataagacacactccctccatttactatcgatgtattaatcaaatgatataaattaattagttactccctccatttcattttaggttataagacgttttggtcaaagtcaaactactctaagtttgactaattttttttaaaagtaataatatgtttaacccaagaaaaatatattatgaaagtttattcaattatagatttaatgaaactatgctgatattataaatattactatttgtttatacagaattagtcaaactcaaaatagtttaactttgaacaaagtcaaaacgtctaacctgaaactgagggagtagttttctagaaaatgggataaacccagcctcttcatccaatcggatgtagaatttttttgagaattaatatcatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggtcctgtcgaacagcccctgttcgacaggcagggctgtcgaactgcccctgttcgacaggatatccgtcgaactggcgcagttcgacagggtcgtgttctccatttatttgtaataataattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttttatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatatataagtcaaggacgatcagtgcccttcgcacgcttgctaggtcctcccttcttcctacgcctaatctgctcagtaggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttctccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgcggtgtgtggccctgctctggcgcacgcggagtgatatgaagtccccatgctgatgtgttcaacacgttgtcccccgttggcatgtaagggaagtgtgccgacccagatactccctgcgtggggtgaacataaggcagagtttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctaacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaatttaaccatacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaacaagcatcgcggcctgggtggacggggctttaaaccggcctgtcgaatgcccattgttcgacagggtcggtggagggccctgtcgaacgcccccggttcgacaggcctcgcggcgccgggtgatgggccctgtcgaactccctccgttcgacaggtgagcttgtcgaactccagccgttcgatagggatttgtcgactgcccgtcgttcgataggtgccctatcgaactgcacccgttcgacagggagctactttcgcaattttccccggttggccactacttttgcgattttccataaaaataatattaattctcaaaaaaattctcggatgtacaccaccaaagataattagttagttattgatactttcatgcaaacaaattaaacctaccaaatattatatagctctaccttgtcctctctcctactagttcgtaaaatcgtactaccgttctggggtcttgagaaaagaccaccatagaagtttctcattttgaatgggatagatgattttaaaggtgcaaattgcacagtgaggactgattcatcaacctaccacctacctgtgtcacatatttatcattttctcattcaaaccactcatactattttgtcatgcgaaatcccagaataaagtttacatcttaggtggtgtttggtcggagggactaaagtggggctaaactttagtccctctcacagaaacataaggggctaaactttagtccctccaaccaaacaccaccttattcctgtcttatgctaatttctggattttagtgagattgaagatgtaccgctaatttctgtcttatactccatccgttcccgattgtttgatgttttaccccctaacatttatgcatgaataattaacgttttgacgtattgcttgtataagtgccactacttaattctatgcttaaaatatttcctgtgtggcttactccctccgtaaaaaaagaaaacataacttaaaaatgaaatgtgacacagtcaactacaacgaatctgacacatcatatcctaggttatcttttttttttaaaaaaatggagggagtacttggttggtgccatttgtgctaattccctgattaaaatgaccacatacaaccaataccaataataatttaggataatttattaattttcacctttagctgatgtagctcaccaattatagaacgatcaacatattggacagaggaagtaaaacatatattcggaagcacattcatagggatataaatatgttgttgcgtgtgtgcgtataagtctaccatgtaatcgaaaaaaataaagaaatactgtattacgtgtgtagtgcatgtgagtttacggtgtaataaaaaaattccatcttaaaaaaagaaaaaaaatgcaaaacgctgcataataaaactagtactactagtactccataaactaaagatgtggacatcacggagaggtgggtcccacggttcaatcagggaggccaacacgcacatggccacatgggccatggccgctggtgttagctcacggcactcgtctgcgcgcaacacgtgtccccttcccccccgcctatctgttgcttggcggtctccatgtgggccccgcgcccttcctttccgtgtctcggataagtgggcccacgtcactcgtcccaccaccacctctaacccacacagggccccacgcagactagacaaaaccatagttattgagaccggactggtaatcgaaccggtgaggctgtcggttcaatggttcactggttcaaccggttggatcggtggtctaatccggttcaataaatactaaatacattgatcattcagtgtaaacacaaagagccaagtagtctggtggtggaggagtttaactaactcccacgtggtcgtgggttcgaatcccacccacgccaaccaccaccaggccggttcaaagcggttttataccccggtttaatagcggtttttaagcaaaaccgggcggtctaaccggtttatagccggatcgattgcatgccggtcttttacctggaccggaccggtggggctctggttctggttttttccggtccgaccgccggtccggtccggtcttaataactgtggacaaaacacaaacaagcaagcactgtagaagctaatatcttgggccggccaactgctcaaaagaaaagaaaaagaaaaaaaaaagaaaaactgatattggtagtcaaagtttattgttcatgctgtcttattcataattggtgctattacgagagaagatttgcaagtgttcgcccatttgcacggatgctttggacagtttgtctgacgaaaaacagctgctgcagctttgcctgttttgcgagcagagctttctatggagtattatccatcacattcatatatactcctctgctactccctccgtcccaaaaaaagacaaaccctggtttccgtgtccaatgtttgaccattcgtcttatttaaaaaaattatgaaaaaaattaaaaagataagtcgcatataaagtattcatcatgttttatcatctaacaacaataaaaatactaattataaaaaaatttcatataagacggacagttaaacgttggcacgtaaacccgtggtttgccttttttttttgggacggagggagtatgctgcatttctctctgcattatgtgtgtgttccctgatttccatgtcggaaatgccagtgacacttgcattcatctgccatcggtttttggaacaaccattgctgtctgtctgaaaaatgcagatgcagagcttatcctgaacgaaacgacgcagcagtttttgggtttccagccgctgtttcatcaagtggccgagcaagcagaagcagcggtttgtgaatgaaatccacgcgccactcatattcatggctgatcctgaactgaattcaatgtgtcccacagcttagcactagcttatcatgcaccgatcgatccagtcagtggcggagccaacgatgtcatcaaacccaaacgataatatgtatttcttacttattagtaatggcggagccacgttcaactcaagtggtgcacacgaatcccagatccaaaatttcttacttaagaacactaaaatgtgcagtgctacattgattttttttctaggcttttaatgatgagaaaattccctatctagcatcagaaaaaaaattgctcttccctctatagcacccaactttcaaaagttccctatctatgcaccatcaaaatttttgttccctatctaacacttccgttactcccgttagcctccaccgtcaaaacaatcatggacccaccctcaggaatttttttcgtcgctctttctctaggacagagcgcgagcgcgacctgctttccccaacccgcgtgcgcctctcagcaaaaccctagatcgccgtcgcccccatggatggagaccccccgggcggcgaggacggcgaatcagccgtgcagcgaggatggcgaccccctgggcggccattggcgccggcgggctcccccggacggccagcgccggcggcacgggaggccatccctaggcctgctcggccggctaatcccaggcgggcgcaggacaggcagctcatggccacggcggcacatgcaggcagctcccaggcgggcacggacagcaaccccctagatggtgcgggcaaacagtccggcatggcgatgaacacaacctttttcttgcttttgccctggatgtgaatttggatgatttggatggttatggttatctatggatgtgaatttggatgctctctaaaatttatttggttcattattgtgttgcaaacatgctgttgttgcagacatgctgtcaaatttctctaaaaattttagatatagaaaggttaaaaaactgtgaacaaaatgaaaaaaagacgtacagacatctggacactaaatgaaaaaaaataaagaacaaaaaaaaattgtgaacagagagagggaaaaaatgtataaaatacagaagggcaaaaccgtctttcctcatgcaacttaacaccgtcaccctcaaaactaacggaagtgttagatggggaacaaaaattttgatggtgcatagatagggaacttttgaagtttgggtgctatagagggaagagcaatttttcttgatgctagatagggaattttctctttaatgatagtgcaccacctctgtttggacgctagcttcgcccctgctcattagtaacattttacaagtattttcgataattaacaatggtgatctcactaagatatctgaactgtaaaaggctttagttagttagttttagttagtaatctgttcttgtcccactacaggcgctgaagcttttggttaccatccagactttgagtggactaagtaggtcggatgcgattaacaatttactaattggatatctgaagagagcgatcatgagtgagcatatcgcggtgcagtgcagtttgcatctttgttcaggtcgctgtccatcgattttaatttcgcacaagtcaaacccttttaaaacaatgcagcatagtgatcgccgaaagagagccatgctgcctttactgccaagttaattatgatatattattagcactagagttcatgccagttgacttgaggttgtcagattttaatcgatttggtgctgatttgtggcacggatcatcgcagcaagtcaaagcaaaaatcgaaaagtaagtttaaaaaattttcaaagttcagtagagtaatgggtgggctaggatcacaggggacacataatcgcgtgggaaaatccttgaatattcggcgcgaaataagggatccatcgatcagtagacgcatgatcttcatgagcttgctttgaagcaactggatgctgcccaaaagcaacatttccggtgcatgatctccagttaatttgatgcatgggtttcttgatctgacagtgtttttttcataaaaaaattggaagagaactggatctgatgatatgtgtccctatcttgagatgacgtgtatgtgtctgtcaatttcttgaaacaattttttttttgccttttttacattcacagaggcattgacttggtgtgtacaattagctgcatctgaaaagagggggaagaaatgtgtgaaaatctttttttttatctacctgatagttacacttgcgttgctgtctgaattgataattgcctaaaagtcaggtcatgtgtgctgaaactgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccgccactccacccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacaatggtatcagagcaatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgatggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccaactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtattttttcatgcaaattacaatagaattttgaattgtcttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatacgacacagctgataaagcagcttgttacagagaggtaccatggaggtggtgtaaaataccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccatatgagctatggatcctccgtgtgtgggggagtcctgcaaaggataaagtatttaacccaaaacagtaagctgccattttattggctaattctgaaagatcaaagggtcatcgtttctactgtccaaacagttatacaaagtttgtagaaacaagacacgtcgtcttcttggaagacgaaatgattagggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatcatgtcttacagaaaagcagaatcgctccagatagtggggtattcggattctgactttgcaaaagataatacaaagttaacatcgggatacatgtttaccctggcagtaggagctatttcatggaaaagctcaaaacagacgaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtctgggatcaaacaatcagtcttgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaatggctcaagggggccttgacccgcgccctgatcgggggcgcccagcccaatggctggtgggcccccgtcacactgtgccatataaagaggggtgg

SEQ ID NO: 43080 - DNA, 44463 bp, Oryza sativa
  unsure (1)..(44463): unsure at all n locations
tccaacgcgtcaaccggtcacatccctaaaccctttcccttattctctattgttgttcaatcatccatcgcaaatagaaccacccgactagatctaaacctaggtgatccaatagacaacactaacagaaactaggcccgtttggttgttctcgagctcacaaattagtactatttctttaaaaataacttttttttaattataaaacaacatatcaactttgtagtgggtactttattgatgccttcaaaattatcataaacttagagtaatccatcattaaaaaaaattaatcgtttcggctataactaagcttatcatcaatgagaaaatgattcatgggtaaaaattttatatatgtattcttaccaattttatataaaactaatacgaagtaatacacaacggtaaaaatcagctctaaaaattaaatttaacaaaggatggcgtgtgttacatatttcgcttttttaacttccactcctattattttttgtgcgctacccaaacagttaaacgatattttttttttgcaaaatttgatagcaacgctgtgtctgaaaaatcatattaaccattttcttaatttttagctaataattactaattactaagtaatacttcctctgtttcacaatgtaagactttctagcactgcccacattcatttagatgttaatgaatctagacatatgtatgtgtttggattcattaacatctatatgcatgtgagcagtgctaaaaagtcttacattgtgaaacgaagggagtagtaatttgttaatcctctgtttcatttttgcttagggatagatttgcaattaaaaatactccctccattctgtaatataagaaacaaccacttttcttagatgttccatgataaaaggcatacaattaattatggtatcttttccattaaattattaccttttaaatcctccactcccatgttatctaattctattgaatgcatgtattatattattaggatgattcaaactataagataataataattatttcttgatttttgagttaaggatggttgtgccttatattttaaaatggagggagtagttggaccagatgagaagtattaccaggtctgaggcctgtggtgcgcagatctttttctccagggagccgtaggcgaatgttccatctctcctctcctcttctcctctttattactgcacgcagagagctccagctcgcgctgctccgaccaccgccgcgccgctcgccgcctccgccaccgcctccgccggcaaaccaccccctcgccatggcctccccctgcgagcaccacgtcccgtacaccctcctgggcgcgctcctcagcggcggcggcccccacgccgccgcgtgcggcggcgccgccttcctccgcgactacgcggagcggggcaccaacgcgctgctgtgggcggccctcctcgccgtcacgtggctgctcgtcctccgcctcgccgcgctgctccgcctctgggccctcggcgcccgcctccccggcccgcccgccttccccgccgaccctggcctcgccgccggtgacatcaccggtaggtttccgtcgtcctcctcctccttcctcccttctcttccctgttcgtgcgagtagcggttggtttggtggtagttccggtgggtacggatgcggagctactgtggaattggatttggcgcgagttcggcgccttcgcagggtagaattattgggcatatggccttctctttttatgcttgctcgggtttccgtgggaactgttcgattgggaggaacgttgccgcagtttgattcgagattcagcaactcatcatcctccagttgctacgcgagcgacctgagtacggtgatttgggaatctgttcttattttgattaattgatgtgggatttgatttagttgggcgctgatctgggtggagttcgattagaatgtcaaatcggctgatttggactgtgtcgaattatttgatctgttttacgacagattcgtgcccaaatttgtagcttcagtggctgtaagcctgtaatatttccgttcctctttgaggaagtggaacctgctggtatgaggtaggggaagacaaaaaaaaaagaagctagtgattgaggtatgaactgtttttggcggatctgttttccagcaactgagcgtgacctataaattgttgcttaatttgttttgccgtttagattctagagtactttttactttttatgtgaggttgtttttgctgaattttcatattttgtaagtcagcaagggaactgaattattaccaagttgaccttgatttgggatatatttccaaaggattggacggtgtagagatctgctacgtattactttgaggtttgtctgattatatgaatatagtagaattcccaggagaattgaattaatactctgtttcctgagaaaaaaaaacacatttctcatgggctcatggcaatcggatcaaatcaaatctgtcatcagtgtatgctgatcttcatgtcaattgtctagatctaatcctccgctcttcaatacatcttggctattggtgctagagaacaatatcggtgcatcatgtaccctatcaaaaacacctgcaaatggtcattaaaaagtgtgaggtaatttgaaaacaatgatactgcatggatctacgctgccacagtttctaaattagtttaacacagggcagaaaattgaatagacagattttagtaaacaataatatagtaccatcctctttttttttcaattatcctctttcagttgattttgcttctttatttcaccttccatgacaaagttcgattttaaactatgtataatgaattgtggtctggtatatccattgtgcctgaatgttttcagtttttctttaaaataaacatttacaccttattttgaatacgatgtacatgaaggtaggatgaaccgtcctaccctgacctgcgccaaactatgatttaggaaatattggacaaaaattgctgaaataacctatctggatgaaaaaaaacatctcccttatatgaataagttgttcattacgattttgccagatgaggattgagttactaacagaattcgctgtgcataaggtaggtgttttgcatataaatataggaatagataggcatcacacgagtattttactaactttaatacggataacttttttttttttgcagggaaatacggataactttttgataccatgctgtcctatgtttgtggcatcatattgtatttctcatttttcctgtttagtcaaatgagcatgtgcgtagactggcctagctcaactctgtagtctttagggcccgattatacaatgctctagcacatggtgcatcaaatactctacataacagatagtcggttgtacattgttacgcataaaaattctggaaagaaatagctaatgcagattttgagcagattcataattgcgatctaccagtatttgttgagtaaaacactaaaactgtggatggtttgatttctgatcatattcccctgaactgctgtatttcaccactgatcatatgttcctttcaactgcattattaaacaggctacctatcgaagttacatggcagttatggcccagttgttcgactgtggctcggaccctctcaactgcttgtctcagttaaagattctagggtaattaaagagttgctaacaaaggctgaagataagttgccgttgactgggaagacatataatttggcttgtggaaaacttggtctgttcatttcctcgttcgagaaggtttgtgtctcaaatgtgataaaataccatatgcagtctgctgtattaatttgtctcgtttgccttgcatatttttggtgatagttatcattcagatggcacatacaattgctgattcatctccgctattcttttaatgcttttctcctgcattttcaggtcaaaagtaggagggaatcactgaagtcattcctggatgaaaaacttagtgttggtactggtggaagttccttcaagatcattcaaattgtccttgatagagttgactccattatggccagggattttctggactgcagatatttttcccaacacatggcatttaacattgttggctcggctctttttggtgatgctttctttgattggtctgatgcttctgcctatgaggagctgatgatgacggttgcaaaggatgcttgtttctgggcttcttatgcagttcccccattttggaaacctgattataggaggtacagaacactatgtgctcgattgaagctattaacacaaggcatcgttgcaaaatcaagaaaccaaaatggtgtacttagccttattgatctgagttcctgtcagagaagtgaaaggatgataaaagatccatgcagaggcttttctctgcttgatggtgtgatttcaagtcgttgtctcaacgaggcagctgaagggcctctcagctcagaagaagaaatatgtggtaacattatgggtttaatgttgcatggaatttccacgtgtgctaacctaattggcaacatcctaacaaggcttgccttgtacccaaacttgcaatgccaggtacacattatttgctttatttctctgttgcaaacaatcctggttgctctttatgtgatgattggtgcttgttactgcttttttgtttcaataggtagttcctttacctaaacagatctctcccagttatatatatgttacaatgttgcatattgtccagtattgctccttgttctttgcttatgcaatatatttctgcccttcatgtagtatcatgatagtctcaagttattctggttttgttatagcattcctttgttaatttgacaaggctgaacttgtttcttcatttatcttcgttgacatggaaactgcttctttcaggcggttgcattgtatttatgctgtttctctgacttacatgtgctgttttcctacagctgcattcggagatagtttcaggtcacagtgaatcatctgagcttaagatagatgatgtgcttaggatgaaattcctacttgctactgtatgtgaatctgctcgacttttgcctgctggacctcttctccagagatgttctttgcaacaaggtatacatatcttttcaataaaacttaaaaagtaccgatcaatgaaaaatgaaaaaatattaatagtgtacatagcaccacgtttcataccctgtatttcttgaggccatttttattaatatataaattttcttatatgtcctgaaatgtcatccatatcatattatcatatgattttaaatggagatgtcttttcttcatcctgatcttgctgtactgtattgagattatgctttggttctgaggttccttaatatatccattatccagttgtaggagaaatcaggtgtacttttatttcatttatttttagctcttgtgtgaagtgtgagctctagaccttttggattacctgctgtacattattgatctccttacaatttccttgagtgcagatgttaatcttaattccagcatcacaataccagctggagcaatattggttattcctttgcatctcgtgcaaatggaagcttctacatggggaaatgatgcttgccagttcaaccctaatcgtttcctcaaaaaggaaattaattttgaaggtctctccctctgctcccttcattttcctttccgcttgttcatttgtgcattatctcaatatgttttcttcttttacttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctccaagcttgctttctttccatcgcagaaaccgcgacgtggatggttttttcctccagatttttaacggccccagtgagcttttctagacctagtttccattaattagcgttttgaggcacttgtgggcggttaaatcacaggaggtgtgtaccgatgtgcataaaccaatagtagcttcttcttttttcttttttttttccggttggtgttttcttctccttctggaggaatgtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcagagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaaaactttaaagtccaggtttgaaaattttgaaaactttcagcttaagatttgaaaatttttaactcgagattcgaaaactttcaactcgagatttgaaaactttcaagttcagatttgaaaattttgaaaactttcaacttgagatttaaaaatttttaactcgaggtttgaaaactttcaactcgagatttgaaaactttcaagaccaaatctgaaaatttttaagttaagatttaaaaattactagtaaactaattatgattttttctcctacccgtgcgacatcgaactgtgaaaaaaaaaggaagaaacatggcggtagcaaatgggggatttacaattatgacactgcaaacattaactgcgccaaaaaaaaaagagaaaaagaaacacgtgtgtgggccggaagtacgcgttgacggcgcatacgcgggaattaggaattctgctggcggtccggcctgcacggtgagttaccacgttggctgttgatcgagagattctccggtcagaattttctctgagaaaaagaaatctgaggatgcccggcccaatatatggggcccaaaacaagcgagcttttatgggccgtgacgagtagccatcggcccatctccgctttcccttgttgaggtcaggaggccgtggcccgtgtgtgcgacatggtcgcacttccagccccatcttttgcttatcagccaaaatttaaatttttaacatttaatttagagttggttttgggatttttttcacctaagtttattttttagcctctacttttggatcgttaagaatacgtatataaaagttgtattcacaaattattttttttatgtaaatatatgaataagccaaacgatgaagcctctcccctcgcccatctcccgacggtcgtctcctccttcctcttaggctcgtcggtcgccaatccccccatctcccgccgcgcgcccgccgccgctccgcccgtcaccaccctgcccggcgtctaccacgctaagatttccgaactacggtatggtacgccgccgctcgcctgtggttactctactcatcttctcgctttcatatactattgtcggttatttttgagtatcctttctcctgcctcctccgaggagaaagtgtgctatttccaggggcagattgtcggatcggcggcgactattggaaccaagaaaatttgggaatatttgggagcccttgggcatatcattattctagtcggactctcaatgctcatgtcccccccacaaaagggcagccgaacctttgtcatgaacaacaaacacgagcattgggtttcttggcttcctaggcgcataaagggctcttaacttcgttgctgcataaaagagtcaggtcgtaagctttgggctttcaacatagcagcttcgctgcagaaggcaagtcagattccacatggagatagataatggacacacctttgtaagttcttggtttcaattataagtactacatccgttttttaatagatgacgccgttaactttttctcacatgtttgaccattcgtcttattaaaaaattttatgcaaatgtataagatataaatcacacttaaagtactatgagtgataaaacaacccataataaaataaattataattacgtaaattttttgaataagacgaacggtcaaacatgtaagaaaaagtcaacggcgttatctattaaaaaacagagggagtattctttagagttttaatgcttcaagccactaacatattttgtgtaatctaattattgtagcaagcggaggagggcgataggctcagcaatctacctgacgatattttgttggatatcttggcgagactcaacattagtacggttgcaaagacaagcgccctgtcaacgcggtggaggcacctaccttggtagttaactaagctggatttggatgttgcagaattcctacatgccccagcgttcagtagcataacgactgtgcacatggatcaagctatgtcagctctcaccaaagcagctacgagtttgctatctgtgccacagagagacacctccatcagaaacctatgcctcaaactctacatgatgggcagccactcaagcaatataggatcagtattaagtcaagcaattgaagctgggatagtaaaagaattggaccttgctgttttgcacgagaagagacatatagattgcaatgacgatgatatgcttcatcaagccagagctgtgaaggtctttgctggtgcttttcctcgtgtgatttgttgcatcacaaggctctctctgtacaatgtgcacctcgatggagacattcatcgtattcttttcgattgttgcactcagttggactatctgaatctcgagcattgcgatgatgggagccgcgatgtttggaagataaatgcgccaaattcaaagctccggcatttggagcttgcagtgtgcttctttgggaggctcgatttagtctgcctcccaaaactcgagtacatttactgggaaatttggttcactccttatgcccccttgtcattcggctcagtcccaagccttagggaattacgtctcgcatgtcctgcccaatctgacttccaaggcttgaagttaagcaaagttttacaaggtgtcccgaacttgcatactttgacaatagatttccaaggagaaaaggtaattgcataatcatttgttatgatctgcttttctattattggtacaactgttacgttgcggcatgttactcagaatgaggatctagcactaaaatgctgtgatagtttcagctggctcagttcaaccacttaggtgtatttaccttcaatttaaaaatgagaaaacctgtgaggtggtcaagtgtgcaaccacaccctcctaaattttggtttaacccctcttttgcttgtaattgcccgcaaggattttattatttaggagtaatcttgtttgtgcaatggattcatatatatttggcaatcactcacgtgcttcatttctgccttttgttttttcagttatggatgcaacctgaacaaaaacagctctgccctgcattcaacaatctaaagaagttatctattctttgcattcatgttgaatttgacctgttatggactataaacctccttgaagctgcaccatccgttgagctcctttgtattgatgtaagtttcctttttttttaatagagcgcaacaatagcatatgacagtaactgcaactggactatcattatgtgcacaaattaacataaccaagtgctcatactaaatgtagacctgggaacatgtatgcttggtaaacaaagaggatgaagatggaagaaagcttgttcatggagaaacaacacatccttcatgggagatatctgagttcactggcaccagaaattggcaattgaaagaactccagttcactggctttaggccactcaagcaacaattggtctttttaaaggccatcatggagcaagctcgcaacctgcagactgttattctgaaagaggaagaaccatgcgaggactgtgaggcattaggcacgcctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaaaggagaagaaaggggaaaaaaaagaggaaaaaaagaaaaagaaaaaaattaaatgggtcccatttgtcaatcaaaataatgccatgtcatgtccgtgtggcatgccacatcaacgccacgtaggatcctgaaggggttgtggcgatttgggacctagatgacacaatatgacaagttctgggatttagatatgtattttgagagtttagggatctagatgacacaaccctacaagtttaagaaccgaccgtacactttactcaaaaattttcagataagatgaacagtcaaacgttgaacgtgaatagtgcaaaactatacttattttgggacggagggagtaacagataaaaataatcattacgtttatgttgccaatgaatctctctctagtcacttttcatcggcaaacataaaatgcctaccaacaagattagctaaaaagaaaatagacggtgtactacaacagcacataccactaggaatgggctgggtgtgaatctatcctaaaattactgctccttttgctacgaaaaaccccacaagttgagcccgtgggtcggtgtgcctgatgtcccacatcttgtcacgccctttcgatctcctgggtgcgcacatatgcgaattctccgcccaattccgcatcttccccgacgctctaacgccgccacctgatctcctgccccgatgcaccgcctcatctcttctccctctctcatggcatctgcagcggctagctggtggtcaccattgcttgctcgaggaggacctgtccgtcgtgtttccggtgtgttttcttgtcactcgacgatttcaatcctgactgatggtaccatcttatttattttagatgttgactaggtaggtgtctgtgcgttgcaacgggtaaaaaatatacaccaatttaaaatcacaaagtaaaatgatgttgaataattaaatttgttaggatgaaaaccttattattgcacgaacaataatttcatcacatccttataagttttcacaggttagtaatacaaacagccaaaaaattcaagaatagaatggcacaataggtctcttagggcacgttcaacggttgagcccgccatggactcttgaataggctatgtcagagaaaaacaatagttctacaaaggctggctttccgatcgtctctccactaatatgcagtaattaaatttttgtagcaatggtgtcgtgattttctgcattttggatctaaatacgtgacttttcttgaagatggactatacaacggccattggttatctcgtctgctcgtgtttttctcattgtgagccgatgtcaggccgattgcatgcaaaacatcgatgcatctccattcttttttctctctcttccacatcatcaaatctgcttccatggcaataaagagagcccactaattaatacctttgtacatgccctagtacctcctggccctcttccatagatcctgcacgcacaaataaatgaagaataactgtgcagtaatgcaggaagtaaattaagctgaatcaagttgtatagatgagataggtttatttaaaccatcaagattaatatttgtagcatcatggttgcatgatcttccaaattcaacctgtagcttcgatcgaaaccaaacctgtacaaatggtcttcccagttaaagaaatttcaggctgtgctacttatttcaaactgaaaatttccaacctttgaaaaatatactaatttaaatgagacaaccgatttaagtggttcatagctagaaacaccataccttgatttttcctaataattatgtaatagactaatagttaacagattgagccacaaaactctattgtaataaattgctagattccccaaatttaatcactaagtgcattagttacttgtaacggactcaatttcaggggaaaaatttttacgaaatattttagttgcactcttctcaattcttcttttgaagtgatcttgccttctcttaatttcttttaacttggatttagactttatttgcaaagttaatcgcgctcttttaaattttgcaaaacatttctattattttctttaatctctaactttggctctagattatttttcctttgaatccattcccgaacatctccaacaaatactatttcaattcccactcaaccatctctagagtacaggaaaagttgatacctttcctttggacccccaaatatttcccctttgaaatctcgttcatctaaattatccattcaagattttaaagtctactatttagcttgggccaataattcccgattgacccgactctttgttatattccattaaccattttatccttgggactaaaccagtataatttcctttttgctggaatttattctagatcaaacccttgatctagacctatctttagaaatccttgttctctttcatacaacaccttccacaaactcctctagatgttccacttcttctatctataaattaaaccgccagtttgattcccaaggtttgattctttctagcacaagaataatatttccagaataattgttcttgtgctaacaaaccttttcaatccctcctattcaaaaggtccaaaactcctttaaaacctatttaaaaccctcccgtcaaaattcccttagttttcaattccttaaattctatttaaatttcttgtccaaaattcaaaaggttcacaaatatcttcctttataatttttcccctttgaattctagtcaaattcaaaaagtccacaaacatttcttcctatagatttcatctcctttgaattccattcaaaatcctctacacaaaaattccaaaggtttctattcaaatcgggctgaaattcctttttcttctcccctcagcccatctccctcctcagcccaagcgacccagccccagctgagccgcctccttcctcttccctgtgggcctgccgccgccgccgtctgcaaccacagcgtcgtcgccgtctcgccccttccagatgtgccgccgccgacgccgtgctcctcttctccacgccaccgtcaccgtggccaagtcgccgactgccttcgcaaccgtcattcgccaccgcctctcaccgcctatataagaagacgaaccccctccattttccacacaccaatcgagctcttcgagctctgcctctctctctctctcctgccatgtccggctgccacctaccgtcggccgatctccctcaccggaattccactaattaaatccttgcgccatcgggtttgcctcgacgaggtgaactcattttcctagtttccccttcctttacccttccgaaaccaaccaccacagccacctcctcttgttgccagagctatactcttgcctgcgccgttccggccatctccttcactccctttgccaaccaccgacttccccggatgcgcatcgttcgggaacaccatcctctaccggcgcagtcatatcttagccaccacagcatcggcgcccttcctctcctcctctcggttccctggctaacagagaggaagaaaacgaagcaaggagagaagaaccggaggaagaagagacatatgacatgtgggccccacttctataaagtaaatctttttcctttaatttccatttcaatcttcaagcacccatgtctctccaaccacagatcccatcccagtgagaccttgacctaaattcttctaatttcaaactcttttgttttgatatcaaattcctattttaaaattttatttaaatttctttatttgaatacctttttaatttaaacctatttgatttatcttaaatacctttaattttaaatttcttattttatttaaaaaccttttccttatttatttatttatttatttactttctaattttaaattattttaattaacctttaaaaattattttacatccctttaattttaaatttcttgttttatttaaaaaccttttttaaattttaattatcctttagtttctttaaatacccttttctttaccattttaaattttatttatttaatctatttaaaacccctttttaatttaaattcctttgatttatttaaataccctttttatttctaaatcattcccataccatcccttagccactaaaaatccgccgatagaactttacgccttccatggagacgttcgtgtggtctcaaaccccgacgtcaaaccgttggtcgtaaatcctggcataacctaatcctaaggtcgaagtgttgctcttcgcaccctacgcctcaacgcgtacagtggtcagagcctcactactccctcgacctctacagcatgccacacactagctttcggattctgtgcgatccaagccgctctgctgccactcacggctgtagggtaacactttccacccacaaacctacataaaccctcccaactctctagtcgttgtgccacttgattgtagcatcgactagatgggccgatatttagccgttatgccttaacatcggctaaccactccaaatatctagccgttgtgctgcgttactctaggaccgactagaaaaccaaatccaccaaataaaccctacctatccattctatcctttctttgtttttatttgattcccaacctatagaaaccaaaaacctctcttttgttttcaaattaaaatttattttgaactcattcctttttcctctcgcctcgctccaattttatttattccttggctttatcatttctttgtagcaatttgcttataggctttatttgttatcttttcgtattcgtacattagaccgtacagtaagttttatcagtaacttggataaggaaatccgtctctttgatggtgtcatcagtgagtcacgtggtttaaagaggtcggtggttgctgtaaggagggattctttcatagatttgaagttcgaagtgggcgcgtttccatccagtttcgaccagcattatgtttccttcaaggagaaaatccatggctatgatactcaagaaataaagactgattttgcgttaatctcagtaaaggtgacttggtcggctttgctttctggactagagtgatacctctgtttctgtaacagagtgggccaagagtggctaaaaacctgcggcttactaaacctaggtgcggcaaacttggatagtaaagtattgtaataaatctgtcattgtaattaagccctccgtccctgaaaaaaagtacttttagtaatgcatctgaataagtgtttgttgagatgcatagtcggtcaatctctccgtccctgaaaaactgaacaagaacttttagacatgcataattagtttcgtctctgtattattacttcagcactaggggttgtattaattatatggaggaatcttcaaggcacaaccgtagagtggcttctctgtgatttctgcatttctgaatcgtatgttttgtggttatagttatggttttggtactagtgcatacacgtaagttctcattttatcacaacttttgcgacactatggatgtgcaaagtttcaaaaattttcagaacatttgtgccattttcacatatgactagcttattaagtcgcgcgttcgcgcgactataacctttctttctatttaaatgtgtggatacgttgtttaattagtttaaataagtgtctgtgaaacatactttgcaataattgcagctataagggaacaaatttatcttgatctttttcatgaatagcattattataaaaataaattacttacatttatgaatgtgtcatttgtaatattgcaagtagacttgtaatatgaaatgtcagcccttctttcggcttaacaaaatagtaacatgtactctgtaatggctagggttaaaaacttaaggtttctattcatcttcgccattgtttcgctctcactatgtgtgcaatcataagctctctttctgttgcgcctatcatctaggcaccatattcgctgatgcactaccccatcctcctcttatgcatttcattcatcctcttgtttagcaaatttaatttaattttaaagtaaattgcgttgacggtacaataacttggcaggtgggtgcgattaggtgtaaaaacttgaaaatacactgtccagcgtagcggtacaataacttggctaggtgggtgcgcccatagtgcataagttgccacgtaaacaaaaattgccatgttaccattccaccttatcacaattgccgcatcggctttgacacgaaagacctatctcattttatagaaaaccacttaatatcatttcttgacgtacacatatctcctttcatctttcttaacgtgatcttgaggtggttgcgctggtggcggtggcgacgcagcggcggtgttcaagccctaaaccagtaaccaaaccaattcaagtgtcgacgtgatcgctgcaagctttgggatggctccgactcggcgagtttttggagcatctgctccttgttttggtaaatcacttgctgatggttgtagatttctatttcttgttcaattgatggatggtcgcaaagacatcagccaacactgagaagtggcacttcgtcagtcccaaaatagctcaccagatttgctaacccctgcaacccttgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgacaccagatcaagatgatggggcttacccaccagtcctgatgaagctccccgacgatttagcggccgtcttcaccacaacagcgtcttcatcccgtaggcctaggcggaagtcagcttcaacaccgatttcgcctagcttcagggaagtcggcgtcatcctccaaccactcggcacggtttcgacggatcagctagatgactacaacagctctcccaccgtcgactcgcgccccaccgacatcgtggagtacgatgagtttagctctcgctaccacgacccagatctcgacgacttcgacggaagcctagatgacaactacacccctctctactttggcgttttcatggccaataacgagacggaggagcaacgccaagcccgggagactgaagaacgtcgccgactggaggaggagcgtcaagcacaagaacaagaacggctacggcgtgagcagcaggaccgtgagcggatcgccaaggaagctgaagatcgacgtcagcgagctttggaagcagggcgccgagcgcgtgatctcatcggccaacaagacgtcgaagggacgccggttttccgcacccctcagcagaatgcggttgccgcgatcaccctactcgacaccctcctcaaccaaaacgagctcaatcgatccgaccacgtcgtcaacatcttgaaccagaccaagaccatgattgcggcctcggttccagttaactctgaaagcgtccacacgccgactggtagccgagttccacacttccggtctcaagactaccgtcatccaagcctcagcatcaccggcgcaggatccaatcgcaggagcaggggtcacgacgagcggtctgttcactcacctcccgaccttcatagggagcgccgagtggaacggcctcgctcaccacctcgtcgccgccccatcgatcttcgcgatacaatcatacagcgccgagcagctcgaggctaccatcactcgctggaccgccacgacgacgaccttgacggagtagcagccttcaccgacgacctgcgtcgagtggattggccagccggcttcaaaccgactggaatcgagaagtacgacggtaccactaacccagaatcgtggcttaccgtctacggtctcgcaatccgcgcagcaggaggtgacaataaggccatggcgaactatttaccagtggctttagcggattccgcccgatcttggctccatggactgccccgtggtacgatcggatcttgggccgaattacgcgaccacttcatcgccaacttccaaggcaccttcgagcgtcccggcacacaatatgatctctacaacgtcattcagaaatccggagaatcccttcgggagtatatccgacgattttctgaacaacgtaacaagatctccgacatctccgacgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgttaccgcatcgaagcagtcgggtcccagttggaagccgaaaaatacgccggctacgggaggaggtggaagtaacaatcataaggaccgcaagcgtaagcctgaggaacttgttgcaaccgccgctcattcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaacggaagcaaaagttgactgaacgggagatcaacgctgttcaacccgacacgccccagtatcttcgatggtcagagattgcaatcaagtttgaccgctcggatcatcctgaccgagtggtccacccggggcggtaccccctggtactagacccagtggtccgtaacgtcaagcttcgcagaaccctcattgatggcggcagtgcactcaatatcctcttcgccaaaaccttggatgatatgcagatccctcgctccgagctgaaaccaagcaatgcgccttttcacggagtaatcccaggattatctgcaactccactcggccagatcactcttccggtcacttttggcactcgggaaaacttccgcacagagaatatcagctttgaagttgccgatttcgagacagcataccacgccatactcggacgcccggcgttagccaagttcatggccgtcccgcactacacgtacatgatgatgaagatgcctggtccccgaggagtcctatccctacggagcgacattaagcaagccgtcacatgcgacaaggagagttgcgacatggcccaaactcgcgagatggcgtctgcccgagaggaaatccgactggctgcaaccacggtgagcgaaggagaagtgcccaccgccaagatttcaaaaagtggggaaaccgaagccaagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgtcgatttgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattacactgatctcaacaaatcatgccctaaagatccttgcgggttgcctcgcattgaccaggtagttgactcaaccgctggctgcgagcttctcagttttctggattgctactcggggtatcatcagatccgactgaaggaatccgactgcttgaaaacttcattcatcacgccttttggggcatactgctacgtcaccatgccgtttggattaaaaaatgcaggagcaacttatcaacgtatgattcagagatgcttctcaacacaaatcggccgcaacgttgaagcctatgtggatgatgtagtcgtcaagaccaagcaaaaggatgatctgatctcggatctagaagaaacctttgcgagcatccgtgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctcgccgactccaaaacaaggtatcctcaggttcagaagctgttatatggtattttaattactaccaggaagctgtctcattattttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgctagctgattttgtcgccgagtggaccgagtgccaagaggatacccccgcggagaaaatagagcactggaccatgcatttcgacgggtcaaaaaggctttcgggcactggagctggagtggttttaatttccccgactggagaaagactaagttatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaactggaggataagttcgatggactcgagctcagtcatgttcttcgacacaacaatgaagccgccgacagacttgccaattttggatccaaacgtgaggcggcgccctcagacgttttcgtcgaacacctttatacaccgaccgtgcctcataaagatactactcaagatgcggacactcatgacatagccatggttgaagccgactggcgagagcccttcatacgatttttaacttctcaagagctccctcaagataaagatgaagccgagcggatttcaaggcggagcaaactttatgttatgcacgaatctgagttatacaagaaaagcccttcaggaattctgcaacgctgcgtatctttagaggaagggagacaattgctgaaagacatacattctgggatatgcggaaaccacgctgctgcgcgcaccattgtcggcaaagcttaccggcagggttttttctggcctactgcagtatccgacgctgacaaaattgtgcgcacatgtgaaggttgccaatttttcgccagacaaattcatctaccagctcaagagttgcaaactatcccgctgtcttggccgtttgcggtttgggggctcgatatggtcggcccgtttaaaaaggcagtcggcggttacacgcatctctttgtggccattgataaattttccaagtggattgaagctaagcctgttgtcacgattacagcagataatgctcgtgatttcttcatcaacattgtgcacagattcggagtacccaatcgcatcatcaccgataatggcacacaattcaccggcggagttttcaaagacttttgtgaagactttggaatcaagatttgctacgcctcagtggcacaccccatgagcaatggacaggtggagcgagccaatggcatgatacttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctcccatgcttccagccttcttgatattcttgaaatatacttccggagcaacactcagcttgtcaaatatttcggttgcgtcgagtgtactcggaccaccattattgaggaacatggcttggataattggtgcagcggcattggcgacgtcatcccttgctccttcaagcctcttgatcttaccaactaggacgtcaaactgagcttgagacttgattttccggtctacaaaacacatttataatcagaatctactgcatttaaaagaggaaagttcagatcatcagccggcagtaccttcaacttctttcaaggctgagtccctttctgcagccagttctgttttgtcttttttcaaggcttcaatctgtttttccatctgagctattctggtggcttgcgctgtttgaaatccaagtgtttgaggatgcaattatgacagcataaatcaatggaacagatctggatgattacctttggatgaaccactcagctcatagtttgaatcttggagctgagcgattcggtcccttaactctttttccgtctttttggcgcactccttggcctcatgcagctggtccctaactgcttctagtgttcccaaatgaggaaccagcttttccaaagttgtagtcttggcctcattgcgaagatggattctctgcatgatggatcatggttcagttctgctaaaaagaaaacaaagttaccgaaggccatcactcggaagacttacgtttacaatacgagtggcttctccgagcgctttcttcagctggcacacttcttcatcttctttctgacggtttatgactataccggcggcttgtgagttctcgtcccaccatttgatcaagataggaggacgagagtcgtcggtcgcctttatgcgagggatttcttctccgtcatcacctgatggtcctgatgtgtttccaagacattagacgggtacactgaggttatttaaatcgccattgtttgagaagacaactaacctgaagatgtgcctagctgggcgtgaggtgatctttgttctttacctgaagacccagctatcgagtcgttaccagcctccggtccttgcgaagtcgtcgtctgcgcttctacttcgggaatctcttgatcagggcctgcgtccgactggtttccagtcgggggctcttgagttgttgccgtttcagttgttgccgactggtttccagtcggcggcgggtcactcggattggctctatcgcacgaagcatgggcgccagtcggctgactttcagcggtcggctggttttcagcagtcggctcggggtccttggatatactctgctctgtcatggcaggatcggggtcttttccagatggatctatatcagatggtttcctgcaaagtgttctttcggtattcagcatcatttttatgagcaaaacatgccgaagcggaatcatatcgagagatctaatacctggaagatgttctgatctttggcattgcacggccggccagttttttcctgggcatggtacgctttgggggtttattaggcgaacctttatccccagatttatcatcgtcgccttcatcatcatcaagtaccagctttctcttgcgaggacctgtttgaccagccaatttggaagtctgaggttgcggatctggtctgattgttggccctccacctccctgagtggtgtgttggcgaggagaccggcgctgagagattggtggatctgacttcatcaatgcatattcctacacaagatgcttccatagttagtcaattcagcatgaagataaaactatgttctgatcatggtttgagggtttccgatgcatacctgtggaggcggattgaatgcattatatggcacgactggcagttggtgagagtagctgactacaattgcatttgagaagattttgtacatcctctccttcatgattttgaaatccaaggagtctggttcttcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatgcctatttaggcgccgcatacgcttttgtcatataatgcacaactgtgttattattttgtctttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacaagtagggtgaggcatagctcctgcagctgctggttgcttgtcgtgcgcgataggaggtccggcggggatcccctgcactcgtcgtgtccggcggaggcggcgccgctggctgtggacgaggaggggaacagggacttgacgttgtcagagactcgatctgcgcccagcgaatgtggaaggaatgagccagcagcggacgcggagctggtcatggcgctgccggtgttgccgaatccgtaggacgtcgaggtcgcctgctcggtggcctctggctgctccgtcgacgccacgtcgggtggtggtggggcctcagcgcagtcgatcggggagctcgtcgatggcggccttggcgttgcacatgagccagtcgacgaccttgcggggctggtcgtagaaccgaatggcagtgtgccagtgtgcgcggcgaggcggatgcgccggtccccgctgcgtgtcccaaccgttgtccctcttcaaggatccatcgccagttgtttactagccgcgctgccgctgccacgaccaccgccgtctccgcggcttcctccagatctttcccatctttctgccaaacaatgggaaaacagatgaatttgaaaaagaagtaactggaatataaaaattactatggacttttttttgtaaaatgagatggtcaatgctaatgtggcactttcgctgaggtggaacaatggcgtggcaacttttgcatcatgagcgcacccacctagccaagtttttgtaccgctacgctcggttttcaagtttttgcacctaatcgcacccacctgccaaggtcttgtaccgtcaacgcaaattttacatgcttgaatagatgtttggagaacctatttgataggaagtctagatatgacacagagaaatttattttgatccatgataaatgaatcgaataatgataataaattatttactctggctacattaaacctatggaatttatcgtaaaaaacaaaattataaattttcctatatgcatatatatcatgttatcatttttttctatattatgcgtatgtatctgcgcattctaccaaatttcttataataatatgttgtactaaatgtcttaggtattaatttatatctctagaatatgcctaattatttaataacattgacatatatgcattttgtaacttatggggttagtttgtagattatattttattataggactaaaatgcaaaaaggtcattacatccccattcccccattgtacctctacacttccacagccctccttttcctttccattgctgtagctgttcctcattcttttttctctcccgctaatctgttatctgtggaggactccagatgataaaatgatgtggaattgtttgaccgacttcctccttttacatcggacggttaatatccattccaccttttctttgcttcttaatccaatggctatgaattaatacatgacgtggctcagtgttgtgaaatcttgaaatttacttttcacaaatgtagatatgcacagtttatagtcgacctttagattcagtcctcattgtttcgcagttcatgttatgatagataagggctgctgaataataacctggtgatcttaaagtctaatcaattcaattgcctgctcaattcctagcttgcctctaaatattttgagagggattaccagggaattgaatgggctgctgctgccatagcatcacaccccaattttcgttcgggattaaaaatcatttaataatttattttctagaaattaaattaaaattaaaagcaatttaacaggtgaatttaatgagggaaataaaatttacttttaaaatcatggctggaaatatttttgtaatattctccatgccctaaaatagtctctagaatttcccgtggatttttggaggtcaagaagtatttttaaaagcacaaacatcacttaatcaattaattaaattgaaaaacaaataaaaatctccttctttctatttgggccatttggactaagtccacttcgcctcccttgggcccgtccccttctctcttctcccggccggcttcgtccctccctagtgggcctcaagcccgctagcctcctcccttttcctctaagtcgaattgacgtccctccttctttcgtgtcgccaacaggaagagcccacctgtggggctcacctttaacctgcaggcacctctcccgaaactgccggcgttccgtgcctcttctccgcaccccatggaattggtgcggacgcgggtcacctcccttcctccaactttttgcccccatgtcctgcactgaggccctgtttagttagtaaaaaaaaaagttttggctttatgtgccacatcgaatatatagacacacatttgaagtattaaacgtagtctaataataaaacaaaatgcatattccacctgtaaaccgcgagacgaatttattaaacctaattaatcagtcattagcaaatgtttactatagcaccactctgtcaaattatggcgcaattaggtttaaaagattcgtctcgcaatttacacgcaatctgtgtgattgatttttttttctacatttaatactccatgcatatgtacaaacattcgatataatagcgtaaaaagtttctgcgtgagaactaaacagggcctgaatcaaagagaaccaacactatctgtgcttgctgatgcatggtaatgtggactcttttgcggttctatactagaaattttgtggacttgattactacgagaaactttgtggcaagatcatgttatgttgaaaaccatccgtgtagtagtaatttatttactaagagaaatcttgtggtgataccaatacgttaactctaagtaatttatttactaagagaaggtgtacaaaccaattaggagtactactatcctaagtaatttatttactaaagaagagctgagaacgaactaagagtaattcatttactaagaggaggaatcaaattgagaagggttgaaaacaacctgggagtaatacatttacctggtgcagctgacctgcaaagaatgcaaacatcaaaaaagaccagcaacgcataacatggctactaaaagtataattacatccagaaagtatgagattgggcagttagccatgaaagcaagattgcattctagaaattagtcaccttcttttcacccatgctctattgaacatgcaattatatctgtgcttatgttaactttttctgtgacacactagattgaacctaaaacagtatagttaatgcttatgttacattgctggaaagcagcatgagtgaatgctttttaataagtaggctagcaccagattttatgatatctcaggattagatttcacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaatatacatcgtgtacgatcctatccgtgctccctcacctcaccggccaatcccccccaagccctagtttccccacacggacacacaacattaattaatgcacgaacaatctcggtgcgccgcgccccggtgagttcatccccggccgcgcgcgccgctcaccatcgatcctcgtctccggaggaatcaatngccntnncgngggccccccccccccccccctccccctaaccgctctctcgtctcctccttcctctcccccaccgatcgacctccaccgtataccaccgcgcgcgagctagcgatcaacaacctcgctctccggtctggagaacaacacctacacaccatttcgagacgagatccaatccaggaaggcagattagccggaggagaactcactttcccatggcagcgacgaaggtgaccggtgacgattgcgagcgattcgctcgaggtggtgggggtttctggggtttctctctctctctcgtctctcccccttctctcacaagtcagaactcaccagcggtcgaggctatatatttgaattctcgatcgttcagatccgaacgtgcggcagcgatgccatcggctcaccgcggcgcacgcgggaatgggcccacctgcttacctttgtgtaattccggtttggctgtgcaggcgcggcaaatatgggaatttctttttactactttactgtagatacatctcagctactgttgtcgctggttgtaaagcagcactacttagtttctaccagccatgttaggggagtttctaccggccacagcttctcagataatctcagcttccctaaacaacccagattatcaaccagattttaaaaatttataattatagaatctataaaataattagaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagctttttttctattaatagtcaaagttaaaaatgtttgacttgacaatatgctaaaaatgcttatatgttgggacagatggagtagttgttattattacttactgcaattgaaatgatcataagtagtaggttaagttaagaacaagttggttttgtggttgtatgaattcgttccggaatgtttgggatgccaccatgagcttatcattgttagaatcggactcaacgacccttacaatttacatatcataaacaataagcaggatcgttggtttttccctacaagcattggattttacacttactagttttgttacaaacggcccaacacagattctccatggagttaaacaaagaacatatcctcgtaagttctgctctccagttcccgtcgtaataattatattttttcatttttattaccgatgctttaattcattaatttagcacaatctaattattgtagcaagtggaggatgaagatagactcagcatgcttcatgatgatattttactatcaatcctggggagagttgacatttgtacagctgcaaaaacaagtgtcctgtcaacaaggtggaggcacctaccttggcagttaactaaactggataaccaccgtgtacattgacgaagctatgtcaactctcaccaaagcagcaaggagtctgctagctgtgccgcagagagaaaccttcattacaagtctatgccttaagctctacttgatgggcaattactcgagagataaaggatttctattaagtgaagcgattgatggtggaatagtaaaagatttggaccttgctattttgaacgagaaggaacctgaagattgcgatgacaaagatatgttttgtcaggccagagttctgaaagcctttgctggtgcttttcctcgtgtgcttcacttcctcacaaggctctctgtacaacgtgttatcttcaccgagacattcatcatattctgtttgactgttgcactcagctggacattgtaaggcttagaaattgtgatgctgggtccaatgctgtatggaaaatagatgcgccaaactcgaaactccgacattctggagctttcgttgtgcagcttttggagattcgagttagcctgcctcccatagcttgaggaggtccattgggagatttggttctgttcctatgcccccttgtcatttggcttcgtcccaagcctcagggaactatttcttgcatgtggtgcccaattgggcttcgaaggcttcatgttaagcgaagttttacaaggcaccaaagatttgcatactttgacaatagatttccaaggagaaaaggtaattgaatatgtcattttgatgaatcattattatttttttatactataactgctacagtgagtacatgcttttcattactatgaatctgttaattcagttgtgttggacttttgcacaagtcatgaggatctagcagtagaatgctgtcatagtttcagttggttcagttctagtactacttaggtgcattcaccttcagtttttattttaataaagaaacaacctacttaggagcatgcattcttcattaagaagaagaaagacatctgaatttgagttaaaaggacaccaacctaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcgattgaaaaaactccagtttgccggctttaggccactcaagcaacagctggtatttttaaaagccatcatggatcttagggacaatatttcatcgccatctcagataattttcctgtgaatcagtagaatttgtgttctatagccgcttcagagttctatatgtaaaaattttactgtgcagcaatgatcagctcttgcatgttaatattatattttaattttgagtaaattgtatgcgatctagtgcaaaaaaattgaaaaatgagcaataccagtacaaaaacttgttcgctttgataagcacatctacaaagcatgcaagtcattgttcaactgcattggttctccaatgatcacaagctgaatacacaccggcagccaactgccaacctaaatatccaaagacatacttcaaatgcatacacttcttttgaacacattgcgtaaggaccattatatattgtagtcaaaggtttaagaaaaaacagtcaaaagaatacgttccgatccatatcctcgtagcaaatactagcaagttgtcaatgagacaaagttcaattcaaatatggacgatccaaaaaaggattacatcaaaagtaaggtacactctctgcagtatgatcaaatctctcaaatcatcagcaaacatacaatgcctaccaacaaaagaatcagttgattgaagggatgaactgaaggagcccagttggagccagggggagcaggggagtaatcacctgaacccgagctcgtgctgaggacaacgaccacccaatctccctcattcgcgatcccaacaccagagaacttggtgtcattcagatactggttgtactgtgacttggtgtagttggtcagaaccacatcaggtacaagtccgggaacgcaggccggcatcacctgaccgtctccggtcaccgacgcgttgagatggcaatggtcgaggtactttgggtagtcggggaactgctgctcggtgccagggacagtgtttgctccggtggtgttggtgcaaggttggtctttgaattgctgtgctagctgctcagccaagcaggcagcattcttgttctcggatagcgcagggactttgagggaagctctgtagctgttgatgcccttgagaagctgtgaatcacttcctggaaatgggaagcagtgtcaaacaaacaatgtaaaacaatgattgtatctccaagttttcctgatttaacagtggaatagtttgcatgcatatcagatctcgaccagcaaaaggtagaattttatcgttcgatcttcagcaaatgataatcgtaataagtactgttaacaaatgacaagtgtatgaataaatgcatctcaataaactatgatacttcatatgtcaccaaaaattttcacttgaaagaattttcattcgaaaccatatgcataaaaactgtgccatatgtacctaaacacatcaactccaatacatagcaattgtgacttaagttactgaaaaattttctccttagcagactaccactgagtcctccccgcaaaaaataaaataaaataaaataaaaaatctaccactgagtcctaaacatcagatcttgcacatcaaaagctggatttgtacgaaaacagcttcccaaacaagattttaactcaaaaaagaggaccaagcaaacctcgaaagtggctcacaaatcatgaccatgtgactagttacatcaaaatgtatagaacaccagtgaccagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcagattgcaggaagagcagcgagagccaataagccatttttaccatcagatctggcgcaatgcagcaaggaggaagcgaggacgaggaagcagacgagggagatcctggaatccattctcgccgacacaattcctcgctgctgcagcggtgttactgttgcctcggccggggaggaagaagagtgaggtgcgaggcaggcaagaagtaggagaggagtgaggaggaaggaggcgagttgctgtcaccaaccacttctttttaattttactctttattgaatcttgattaatctttactcttccttccggtctgtcctaaaaactttttagtaaaaagtggtgataaatgtttttattagggtccttattgtatatttacactggcaagataattcgattacttttgtatcttgtaccttctgggccatttttcactggcaagtggtaactttttgggttacagcctagctttagcagttgtagttaatttgcttaaaaattattgtggtcacataacttcaataaattctgaaaggaactgtataacagtttttatttattatatatccaagtcaccttcattacattttttatatatttataaataaatagtgcctaaagaaggtctagaaatagttttgttcctcatgtgaaaaataattatcccaaggaggcattagatgctttagtagtcataaatttccctgtataaaatcacggaaaaattgtgaatgatgcataaataacggtaatgatgcatgcgctgagtacattttatttatttatacatacaggtcgatattcatatgaaggaaatacaaatacaataatgtagattctgagaaaaaatagccccttatttcacctgactataactctataagttataacacttattagcgataatatatatatatatatatatatatatatatatatatatatatatatatatatatatattcttaacgatttaaaaggtagtattgaaaaataaactacgatgaaaaatatcaaaatcaatttaaaattaaattttaaaatttaatttttggttatggctacgagctatttgtgttttaagttaatacatgtttatggcatggtggtcgtatagtactccctccgtcccaaaaatacttaatgagaagtggcaatgaatctgaactaccctttattcagattcgttgttctagtaggggtcacatcccctcgcttgagtttttttcggacgaagagagtatgaccctgtttagattccaatttttttcttcaaactttcaacttttttcgtcacatcgaactttcctacatgcacaaactttcaacttttctgtcacatcgtttcaatttcttcaaacttcaaattttagcgtggaactaaacacaacctatatttgcatgggcccacccccattatattctctgtgcttataaaacaaacttcatatactctacgaaaccccaagctgtcggtgtttctcaagtagttgctacaacgtgatcatctgagatgcggccacaaataacaaatttattcttatcaggaaaagaaaaaagaagcattagttgaattaagccatggacaacgtgaaacaaataaaagaagaaaggtgcttggtcgatgcttttcatcatcaaataattaatttcgctgcgtgtgcgtcttctccggttggtcctgcactgacgttaaaaaggttggtgtagatgatgatgatctgtgcagcgagcgagcgaacggcgggacagagagacagctcaccgtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttggacttgctaatgttactatccaaaatggttttccagttgattgaagatagcaatcctaaaacatagtactaactgatagtaggtgcgcaacaaggtgaaatcagtagggaatatagtgcagtattggagcattgctatcatgtgaaattgtctaactaggaacaagcgagtgaaacacctcggcttgctgaatatttcactttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaatagtttacctcatcagcaagataatgtggtgatattaatttgatacgggtaatgacatgctccacattgtttatcaccttttgctggaaatccaacgggttaatcattccagcagcaactggaacagaaggaatgccaagtggcctcctccatgaccaagataacagttcatcacggaaaaacatagccaaatggtgccatatatgctggctttgctgaaaatcacaaagaaaacaatccgattacgtaggaaaaatagaaagatgaaccacaagggacaatcctaatattaaccaagacggaaaacaattaacagtaggagtactatcattagcgcatcctactataattcactctttaaagaatgatactcacttttggtgaaaccacagactgggcagcagaacacatggcagacacaatgagaccttcaacaccgaaatttgagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43081 - DNA, 1026 bp, Oryza sativa
atattgtggctaatgaagtagcttgatttggccatgctttctgctcctgctagcaagatcaaactgcgatgattaatgttattagccgggagttgtctagctaggacagtgcgttgccttcggggttaattaggaggtgacaatgacatgtggggccctggacgggaggaaggccaattccagtacagtagcccggtactccatgtcactatttatcagggtcgttgtgagtggtttcgagcctcgaatatgtgatatagtacgcaggaaagagacggatcactggattgacgctttatgtggctctgccgcttcgcgccaccaattggttgttttcagaggcaagtggccagtttggtttggtgcttatccttttgcaactaaacaattacggagaccttaattccatggcctatctatacgactatactgtatctgctttacatattcaggggtttgtttaacgcatagagcgcctagctagtcacacgccacaatggccgtgcacaaaagcatcggttaatttccggcaatcgcatgcaaaggcaaaggaggttagggggaggaaagcgagcattaagccattaattcccctgtgattgttgtgccctgtttcgtgatcaagttgcaatgagacgggaatatgccgtgcactcgtgcaaccctcggcttttgcacctactcgagaacaattaagaaaaggcaagtgtctgtctggaggcactagtagatagcgtactcgttgcgtgcgcaggtgtaaagcgcaacggagaccaatctgggtgtgcgagcgagcggcagcgactgcgaggcagcatcaggatcgcagagttacaagttgcaagttgcaaggcctttccgagctccggcggcttctctcggttcgcctgcgagtgcgaggcagctcatgcacgcgttgtgttccccctgtctcgagagggtgttgtactgggcctctagtgggcttctttaggctacaattcatttcgtcggcgaatttcctataggaataagtccactttgact

SEQ ID NO: 43082 - DNA, 8015 bp, Oryza sativa
acttgtcaaaaaaaagttgccaacacattgctcgtttgaccccttccacatacaaaccgaagatatgatcgatctgactattttgttaaagccatataacggtgttaactgaatcccaaaataccacttttgtccatatttcttcaaagcttttagactttgttcgtttccccaggttcccaactccgcctctcgtttttcacacgcacgctgtttaaactgctaaaaggagcgttttttatttcagaaaacctacaccacggcatcccgtggagatgggatcccctcctcctacctcactcctctccccaaaatcatccgaatcctctcctcctacctcactcctctcccaaatcacacggcactgcagccctccccgtcgcctcctcttacctcactctcctcccccaaattagacggcgctgcagccctccctgttgtcgtcgcccactgctcaccggagccggcggccgccgccgcgagggaggccgctacggtgaggagctcggcggcgagcgtggtgagcgagagggagagcgggagcagggtgcggttgcggcgacatcctccatggccggcagcaagcagatctgctacagcgtcggtgatgaagacctccatggccggcggcaggggtgcgctgagcacgtcgtcgtccacagccggctgaggaggctggggaggcatggtacaaggtaggcaccatatctgtcgcctcctcttcctccgccgccgcgccgccccgctgctcgacctccttgaccccgcgactcctcctcctctctcttagggtatcacgctgatacccaggtaccaaggtctgatacccaggtaccagctcgatacccagggtaccaggtatcagtcgataccaaggtaccaggacctcccaaccccgcgactcctcctcctcctcctcctctctcttggggtatcacgctgatacctaggtaccaaggtctgatacctaggtaccagctcgatacccagggtaccaggtaccagccgataccaaggtaccagccgataccagtgtaccaggtacctcctcagtaccttacccaaggtaccaggaggatttggcggtgaggtagctgctactctgggtgctcaggggtgacgacgccggcgaggtatcacacgtgaggtagctgctactctgggtgctcaggggcgacgatgccggcgaggtatcacccgagcacgtgataccgaggagaatttttggcggtgaggtagctgctacttcggcgatgacgccagcgaggtaaggtagacactgctccggcgacgaaaccaagcaggtagtggctaggtattgagacaaatcacgtgttttgtggggtgctcctttatgctgtcgttgcttttttagttatcccgtgagtgcactatttccacggtatcccgtggggtagcagccctctttttattttgcaaaaaaaaaagtttctatacaagagttcttaaagaatcatattaatccatttttgaaaaaaaagctaatagttaattaattacgcactaatggatcgctctatttttcgtgcgcgggacatgggttcccaacccaggctaccgaacacagccttagttagtttggcctaattattgaatggtggaaatactaggaacgatttttcacaaatcatgcactgagtgtagattttatagatttgtcacaaatttgatttagatttgttatattcttcattggagttatcgtcgtcaatccgtgccaagcaacagctaaaaagaaatccacgtataaactcatacgtatggatgaacagtagggcttaaatataaggaagttatttttttaataatagatctaatttaatggtgtaaaataatgggaccaccaatgtaagtaaaaatcaacattgagattagaagtgacacgtgaagaacgtttgtgcgtgtatagaaagtttaatggacttttaaaatataactagaaaggtagcctgcacattcacgcgggcatatattgtacgcaggattaaactttccgatttagccgatttgatcaggcatcactaaaatttccaaaattttggtctgaaattttgaacaaaatttagttgaatttgaacaaatattaccaaaattcatgaaaaaataaaaaaattttggccaaaataatatcgtatcggtggggtctaaaatgagcgaaatttccaacctgattgtacattgcgtttgaaatatagaatatcaatcggctgacatctcccatgtttaaaagtactttttttatttgaataaaacccatcaggtgaagcctccactgttcttcggcattttgctttgataatttttccaagatatttgttaggtttaaaatatatcatattttatacatctgtataaataattatctatgatctctttattatatgaaaggaagtttgatttagtttgtttggaaaacatgtctaacaaatcaagtgtaaattagtagtaaggcgtttagacctttttttaatagaatgtttacttgcttttttttttacaaattctaaagaactatattgttaataaatatgttttatttgtaccatcaagtagttctccttctggtaggtttaagttgatgcaagttgttacatacctacataagggtatttatatatacaccaatttaaataaaaatcaactacagatatagatctaatctaatagtctaaaataacgggtccactaattaaataaaaatagacggtgaaatcgtttataggaagtttaatgaatgatatttacgtaaatttatagaatagtatgttttatctttaaatagaattaaagatcattaattttttttcaatgcgtaggtttactttttttttcttcagataaacagctggtacgtctgtacttcattgttttttttagtcgtatgtagtatggagtacttgcagttatagttctcccgtatacatataaagattaaggaataagtttcttaaaataaaatatatctaatctaatggtttaaaatattgggtccattgatttaagtgaaaatcaacggtcgggtttgacagtcccacgtggcggcttagaagcgtttgtagaagtgccacgtggcagtttgagagtgtttataggaagtttaatggacagacagatagataaatagatagattgatgtggacattactagaaaattttacattatgaaacagaggacgtataaaacagcgggaatattaaataacacgtgacaaattaatatctaaaactctagttctcgaaggcccattcgttctccttgcggatctcctcctcctcctctggtgtgaagtcgttgacgatcccgaacatgtccctgatctcctgtaccgtcttgcccttgatcaagtcagccgtgtgttggcacgcaagatcaagtagagacggcacgttcaagtagttggcggccaagatcaagttgaacagcatcgtgttgtcgacatcgatgaagctggcatcgaagctcttcagctcctgatccttcacggcgacgtcctcggcagcggcggcggcggcgtgtttcttgcagtactcgagcaccttggcgaggacgttggaggcgacgttggggagagggacgccgttctccgtgcagccgtcctcgatcatgttgctcactagcttcgacatgctcgcctccgcctccgtcacctggaagtgctgcccgtccgagctgatcagaaggatcttgctgtcgccggcgtcggctccctcctttactgccgccattgatcgatgtcggttagtttctcgtcgaacacgcttgaggttgaacacggacggacgggacgaactcgctagctgatcgattggttgcgcgcggtgagctgaacggttgaaacaacgttaatcggtgcttggcgatcgagctgtttggtgctttgtgtatttattgcgagaaccaggccgagcaactccgattcgtactccaaatccaatctgattctaattagtttttgattgtttatttctgcgttactttgcaataacgccaacacagcttaattagctacttctactcagtttaatcggactccgcttcaaaaccgaagtaccccttgtaggtgttatttctggagagattaaaattagtttgttttctttcggtatattacactacatgcatgcatatacctaatatgagaattaataaagactccgagtaggtgcgtgtgtctcctgctagatcacgagagctactacaagattaattagagatcaccaagaatttctaagacctcatcaaccaaaacagatgggagtaactaaaaagttgttacaaattctttgaggtaaaaaacatttatctattatctactaatagtccattaaacttttcacaaacgctctcaagccgtcacgtggcgctcctacaaatgctctcagtcgccacatggcactatctgatctcacagtttatttttatttagattggtggacccgctattttacaccattagattagatctattattaaaaaagtaaaatgcaccaacgacccttaaacttgtcaggaggtttcacttagatccacgaacttacagagcgcacatcgagttccctaaacatgttttattgtatcatcccggtccaaagccgcgtttgaccgtggtcttgcctacgtggcacgccatgtggacgatgacatggaattttttatatttttttctcccttcttccttcttttttcttcggtggtgagaggcggcacgaggggaggggctgtcgcagtggtgcttggcgaggtgccggctgaccggcgcggcggagggagggcggcagaggcggggaagcctgcgtgaggaggctgtagccaaggtcggaggcgagcacgcggcggcggcgagcacctgggggcggcgtttatggggggaggacagcggcggcgatgccgaaccaccgcacggcatgggcgctgccactgctgcagtttcgctgagccgccgtgctggaggcgagcgagcgacgggagggaggacagcaatgctaacaggagggaggggacgggggcgactctgggaggaggacggcggcgctgacgggagggagggagaccgcggcgactgggggaggaggacggccgcgccgacacaccgtctcgcctcggccgcatcgtcgcgtgcctacgccgccgccgccgctgccgcactgagctcccccgtgccggcctctcccttccattgccgccacctgtgtccgcccgagccgagacgacgccacggccgatctttcttctcctctccacaaccgccatctcctctctcaccgccgccccgagctccctcgtgccggcttctcccttccatcagcgctgcccgtttccgcccacgccgagacgacgccaacagctcctctctcaccgccacctctcttaaaaaagtatatttcctcatgtttataacatacaagcgctacaatcgttgtgccgtaattacgagttgataagatacaaactctaatattgttcttccgtatatacatgattgtaaacaaaacaacaaatatttactaatgttcgtcggaagaaaaaaaaacatacgcatgtacataataaaagaccaaaaaataacacacatctataaaaatcgatggtctttaaaatacgattttctacgatatgaagtcaaaatatattacttcacaaatataaatatataaatataattaaattaagatccgtaataaatgtccgaccaatgttgcttaaacaatcttctatatctatctattgtaaactccataagtatattaaactttctgcaagcactcttacgctgctatgtggctctcagagagaaaccctagaaatctattatacagtaaaagtctgttaaagttcctacaaaccctcttacgctgtcacgtggcgctctaataaattatataaatcctagaaattcaaaggaaaaaaagaaaagcatcggaccgtcaaatttcacttaaattggttgacctaccccgttattttaaaccttggattagatctattaaaaatctcatgctgctaatctctatcccggaaaaaacataacgtgcgtatatgatcgaaaatatataaagcaaaaaataaaagaaatatgcacagtacatagtagaattggaaaaatcattagcgccgacactgatgtgtcggcactaatgattaaactatgattttaataaaaataatattacacaaatatacacagctaaacttaatctctgatagataaaatatcaaagcttcattaacttaaatatgccattgatgacttatgatggttatattgtagtgctaaataaatcatgacaaatgacgcaaacatgtaatagttaatgtgataataatgtttcaaataatttcatatcatattttatggtttcaaatatcacttgacaaatgtacaatgttaatttgaatcacatagtaaaaattaaaataacaaaacatagcattgttttttaagtacatctatttaggtttatttaattttgggagagattgagattctcaaagtatttggaatttttcaaaactttttgttcttatttgaggagtgagaagaacaaataatagatagatgagaaaaaataaattaaattatagcaagtggttttgctatgataaaacaacagaatttagctttggtttttatgtgaatctttgtagatttattttgggtgagattgggattctaaaagtatctgaaaattttcaaaacttttttattgctatttgaggagttagaggcatacatgattcatgatgtaaaaaaatatatataaataagactttaaatagatttttttgctacgatacaaccccttagttcatcacgagaattatgtattttctttgccaagtattattggcaaaacatgaacaatccagtaaaatacgaataaaattacttatattatattttttatagttgatagaaaatcaaatggagtgggtataattgatggacgaatgttatacaccactgaacccaactgtaaatgcactctagcgaattagttagtgtaaataagtttgtgaaaataagtacattcttagaattagtaaatgtgtctccattagctataaacaacatatggtggaaacaaatctggcgctaaagtataaatctttatcaaaatataaataatgatatggtcttttgcattttttttaaaagtagtgtcgaatgattaaccccactcatttgaaaaacataatactgtatatactccattaatatttgagaagtacttattactaacttcatatacaaatattgtctattctctaccacaaatcgaccaggacaaagggatttttcgggacattcctatcacattagtaatatattaaaacatactgtctatattacagaaaatatatttatttttttattattgtagataatttacattcctttaccgtgtatatagtgatgtatgatttcttttagcatttcgtttacttaataaaacataagatgctgtgtatctgtgcgggcttcctttccgatttatattccggaaatgttctcctatttatattttatcattataacgtttcaaacacagcctatcatacatgcccatgcgaatgcgcgggctaccttcttttttgaaatgtaaatatatcatacgtaaactgcaactagataattacaaacttacgatgtaactttacatatatgtacaaatagtgtatgtttcaaaacttataatctgaaatgttagcctaaacacgcatgatcatctaattttgtgaagccaatagccctgtagtagatgaatcctccccgtagggtagagttgtcggtgtagttgtggactggccgtcactaggtttgatgtctaaagcgtcgccggtgatcgatccataggttgatgtagcggtaacataccaccttgtgaaatcacctggttaatcatgaatgggtcccaatgataaacatggaacatggcttaccgtgcgacagagctcgtcattctcgcatggtgccccttcccttcttatatat

SEQ ID NO: 43083 - DNA, 702 bp, Oryza sativa
gttacaaggtaagcaacgcacagcgcacacgagctagctatccagctgcatgaatcacctaaaccatgaataaacctactaatgcacaaaatgcctaatttggcaacctacatctcataggcccaggcgttctcgttacggacctcggcctcctcctccggcgtgaagtcgttctcgatcccaaatacctccctgacctgctccggcatcatgtctttgatcaagtccgccgcgcgctggcatgtcagctccagcaggcacggcatgttcaggaagttggcggcattgatcaggccgaacaacttcttcctgtcgacgctgacgaactcggcgtcgaacttactgagctcctcctctccgctagctttcgcggcggcggtggctgtggcggtggcggcggcgtgcttgttgcagtactcgaccaccttggcgaggatatcggaggcgacgttggcgagagggatggcgccgttggtggcgcagtcatcctcgatcatgttacccaacgtcttggacaggctcgccgccgcctccgacagctcgaatttcgcgccgtccgagctgatcagcaggatcatcttctcgccatcggcggcgccgtctgctgctgctgccgatgctgccatctcggtggcgcgcttggtgggcacctgatcgatctgacgagtgcgcgcttgctagtttatcacgaatctatttgcg

SEQ ID NO: 43084 - DNA, 9000 bp, Oryza sativa
  unsure (1)..(9000): unsure at all n locations
ctttaaattattcgtaaaaaatacatcgtttaataatttataaaatcattaaatcattaatcatctctgtatataatatacggcccaaattccacaaatacatcgtttaataatttataaaatcatcaaatgattaatcatcctagtatataatataccgcctaaagtccacagccgtgcctaacccgtttaacctcaagctaagaaattaagttaaaaactaccatgtataagacaaacggcaaggagaggagaggtccaacagaggtagtaaacaggtatgtgtgcgtacgtacggtactatgaatgggagaagattttgttttttaatatatctatttggtccaccaatttaagttatctataattattagttgatctaatgtactcaaataatgaatcacgaagcatttatagaatatccatgtgtcagattaagaatgtgtttataagatgtttaattaacttaatatataatagaaataaaaggacggagggagagctggccagacctagtagatcaaagtctatttgtgagttttttccataaaaagggttccaatttttgttatttggggataaaaaaagcaagcgaaaaggagtacagaaaacgtacgttgtatgtcgtacgtgcatattccacacagagacagagacagggatggagggatgctttttttaacggagatctaaccatctaaaataataggtccaccgatttaaataaaaatttatggtcagatttttctattttattacgatgccacatggtggtatgagagcgtttatagggtgctacgtgacgatacgggagtgtttataggaaataaacttttataatataagagaagatagatagatagatagatagatttatgagtgcaactgttgttaaaattctacacatataagaatagtacatgatatatatgccaaattcccaatatatgatctgcatatgcactgagtatgtggctaacacatattatagaatctatcttataattgtggtaaactcttgtttaacggagacttgactggatttgcgcaccttgggagttatctattgacttgatctaaatcgtgctggcccggtacctactgtatacctcacatgccgagccgttgacattgacatgatactctacagctgaagcttttttgagttatgttgggaagaatcactaacaaaaacaacttaatttttgtgatataaggtgaaatcctgaaatatatgttccacaagaactgtgcgactgattaagaaactttcgtatacattgatggccaaattataaaaaggaaattatatattgaagagattaatggcctcaaagattggaagtgttcactgcatgcatggaataattaatgatttttacccacaaatgatgaagggtggttgcctacttgcgaagtggacatgcaagttgattaactaggactgatattaacaaattagaccttgtctcatgtgttgctagttagtcaatataaataaaatggcctttccttggctgtcctttgccagttaatttgatagttgccccttaacaactaaatagcgaacctctgagcagatggccttaatatctatctactgaagcttggcttcgacgaccttatcatcgaattagcgtggcagtttagctcggaagacaggcagagcaagaggtagcacatcctctccgaagggaagatatgagcgaccagagctcgtaccctaaccctgctcaaggtattagatctgtctgctcatcccttgattatattctaattattagtacatcagttcaattgcttttgaatacacaagaacttttttcgattcatataaggagtgaaacgtttcctgtgcaattaacagggtttaaaatttcagatcaatcggattcatccgatgcgtaattatattgatccagtttgttgtgcattcggaaaattttgttcaaaacttcagttatggcggatcgaaattaccgaaattttggtagaaatagccaaaacaaaattttgaacccgagaaaataatactgcaaaattactctgttttaagagacctttttgtatgtctgttcggaaagaaaggaagacgacgcaattttggagtaaattagtgttgccatgattacgcagggtactaccagggtcccccagcctcggcggcggccggccaagataacacggcggccggcggtggcaagtccaacgcagccaagaaagaccaaccgagcttcatggataacctgtccgtaatccgtctctgctctactaattaatctctctcgctttctgtatatttgtaacgccatttatgtactaattgcttcttaatccattttgcagccttgcttgcctcccctgtgcccgcccagccgaagccaagaacgacgcgagctaactaaccttgctccatcaggcagcctagcacgggaaggaaggctgcaaagctactgcatgattatgcccagtgtttgtttgattattcagcatctaagtaagcacgtcgttaattagttcaatccggattgctcatttgcgttttgtgtactagtgaacgatttatgtatttgtcgggggcgcatgtaatttaatttattcccctttggattcattattcagtttatcttgtcatgattttgtgaggaaagaatctgttttacgcatggttaaattgtactactactacttcacacaattctttaaaaaattctcgaggttaaaagttaacttttcaaaaagtaatttttttgttctttggggaagtcaagaaagaagaggataaatatcttttgtcactactacttcaaaacctataacatgtggcattctcacgggggccccaaatttggccgacttcccaagtcccgtgcacgctgcgcccctctacgctaattacgtgtaatcgcaattagcataaataatatttttttctaatagattagtaaatttgcccatgcgttgctaccggaaaaggtaaaattacgattagaaattatggtttattttttgtgatctgattcccttaaaaattactacaattgattatgattgacttataatcatttagttgatggatctatcataagtatgaatcatgtgtagcttccagactgtttcctctcaaaatgaaaagaaaaggatgaaattaagaaccgagcaccaataaccaaaagcgatgtgccaaacaatcagtaaaaaaaaaaaaagaaaaggcaaacaatcagcccaaagaacttgaatcgactactagttaataactagaaacgttattttctgcccccaggacgtaatgtgactgtgagaccttaatcttttccacacccaggacgtaatgtgactgtgagacctgaatcttttgtacatccaagttgtagggatcagatgtttacagggctttagtcagagacgggatgcctaaccatctgccaaaaaaaatgtgtttgaccatcggaaaaatgatttttatagcagtgacgcagccatacaggacgcacaggagacagacagatgattcgtccgttagagcactacttccatgactcctaggctcctagccaagcacacggcgggtgatgggtgataataagctatctatttatttcagcttactactaataatttaaattataataattctaaggtcttatttgattcagcttagagttattaggagtaaattgaaacaaatagatatcttattatgatatattattacaatgtataaacacatagcttatttaatcaactgtaaatgtgctttttagattaattggttggctaaacaactaataatccagagaaacaaacaactaacaacttatattctatatcggcttattataatctagcttatagtaatctgacttaataatttagattataataatcttaacctgcaacaaatgtcacgaccgcgagggcctgtgccatgtcgcggagaagctggcgggccggaggaaggaggccaggtgcgttccgccgcctatcccagactgcaggtggatatctcctattcgagcgtatcaagggccattgcacctcgatcgtccttgttccactatgttggcaccgtcccgaagccttgcactcatgctctggccccagcaccgtagtgtgcggtgtgccctccatgtccgtggccatagttcatcttcctcttcatctcatcatctgccggatttatccttgttagacggttgtggaaaatgacagagtgcactgtcaggacagggacgactctgcgtgtagatcgaggaggacggagaagatcagaagaggaacaaggacgccaaggaaggaatcggccgaggccgggagcaaaccattgtggcctttctgttgttgcgcgtgggcttgcatgtggtgattagtcgctaaatcgctgggctcgttgttggggccttggggatgggcaatgtggagtcaagggagatatatctgactcacccagtttttagcttggtgccagcgctgtagatggccatagagtcagaggcccgatggcctggtgatttggtccggcctaggcacggcctggcccgacagccgtgccgtgcctggctgctacctcggtacgctgggtcagcacaaagttcagggatgcgaaacaaagaatagagaggaaaaataaacgtattatatggcacaacccaaagaataggaacgtaaaatagacttatttcaaaaaaggcacgatgggccgcccgtgccttcgggccggcacggcacggcccgactgctagtgggctgtgccttgacccgaggtgcagcccgtggacaggtatggcacgaagcgccgaccgtgttgtgctcgggcgggccttatggccatatatagcggcagccacttcttccgcttccctggcagcagccatctcttccgctccatggccaccagatccggctggcgggagctcagccatgaggcgaccggcgccctagtgttagagttgtctgttggatcacttaggtttagatctagtcgggtggttctatttgcgatcgatgattgaacaacaatagaaattaagggaaagggtttagtgatgtgaccggttgacgcgttggatgaggaggaagtcccggccatcgtcgttgatgtcgctttgcttatcgaggacggcagcgacgatgtgcttgacggcgctggtggtcgtagcagtgggagtcgtggtcgacgatgaggcgtggcgcggcggtggcacgttcccgtcactggctgcgccccctcgatcggttagggtttgtggggtggagtggcggcagcgatgaacctcgtgtcttgtgccgtcccgtcctccacccctctttatatggcacagtgtgacgggggcccaccagccattgggctgggcacccccgatcagggcgcaggtcaaggccctcttgagccattgggctcaagggaagggagatctatctaacgttctcccccttgatctcactatttcttttaactttttctattccatcacagatttacatatcgagcatgtttcatcgtcacggttaattaccgatggattcgatagccactatacacatctctattcagaaaaagatactttaacttttgggtcctatagtccaggattcataaggcttcccttaaacccatgcatgctacatgttccttgaacatgttgggaggtaggcctttcatgagcggatccgcgagcattctttctgttctaatgtgctcgagactgattgtttgatcccggactttgtctttcataacatagtactttatgtcaatgtgtttggcagcaccacttgactgattgttgtgagagtacattactgcaggttcgctatcacagtataactttagtggtttctcaatattgtcaaccacctttaaaaccgggtatgaacttctttagccagttcacctgccccgttgcctcatagcctgctataaactcggcatacatagtagaccctgcagtgatgatctgttttgagcttttccatgaaatagctcctactgctagggtgaacacgtatcccgatgttgactttgtattatcttttgcaatgtcagaatcagaataccccactatctggagcgattctgattttctgtaagacagcatgaggccttttgttccttgcaaataacgcaagactttctttactaattccagtgctctagacctggattactttgaaatctgccaagtaacccggtaacaaatgccaaatcaggtcgtgtgcacacttgcgcgtactgtaggcttcctacagctgacgcatatggctttgttttcatttcattgagctcatactgatttctaggatattgagatgcccgatacttttcgcctttgactataggagcaggtgtagcactacatctgtgcatattaaatttcttcaacaccttttctatatatgccttttgagaaagtcccaatgcatactttattctatctcggtgaaactctatgcccaaaacatatgaagcctcactgaggtctttcatgtcaaagtttgaggacaagaatttctttgtttcctgcagtagactaacatcactactagccagtagtatgtcatctacatacagaattaggaaaatgaatctcccattcttaactttgaatcaatacagttgtcctcgatattctcttgaaaacctaaatttctttattgttccatcaaacttcaagtagcactgtctcaaagctttgctttaatccataaatggatctctttatacgacatcccatattttcgtttcctttcatgacgaaacctttcggttgtgccacgtatacttttttcttcaaatcaccatttagaaattccgtttttacatccatctgatgtaattccaaatcataatgtgccactagtgccattataatcatgaaggaatctttacaagagactggagaaaatgtctcattgtaatcccttctctttgcgtgaagccttttgccacaagtcgtgctttaaacttttctatattccctctagagtcataatggttttgtagacccatttatagcctattgttttggctcctttaggaatttcttctaaatcccagacatcatttaatttcattgatttcatttcatctttcatggcatccaaccattcagatgagcgagcgcttctcgtggcgtcttcatatgaggtgggatcaacctccatatgcaactcttctatattataaacttcatagtcatcacggatagccgatcttctgactctttcagaccttctaggggcctcctcatttggcacattatctgtttgaggctgttgcagctcctcctctggtgtggaaataatttatgttgaatcctgtaaaacaggttcttcactttcattcattgttgccacaggagagataacaacaggtgttggtaccgcaacgtcatgcattgctggcacaacatcagcaggtagagagaagaaatgttcctgagtagacggagcaggtacagacacccgcctctcctcaagatcaatttctcgaactaccgagctccccctaatcatttcgttttccaagaagacggcgtgtctcgtttctacaaactttgtttaactgtttggacagtagaaacgataaccctttgatcttttagaatagccaatacaatggcagcttactgttttgggatccaatttcccaagatttgggttaaatactttagcctttgcaagactcgcccacacacggaggatccatagctcatacggtgttttgggcaccgatgcattctatgcattgtatgcattgttctaaaactgagaactccaatggaggaataattacattcttagccagcctctcaattctccccctcgaaatatggccaaaacgacagtgccataatttcgatgagacatcaggagttcactttcttttcttttgtcaacgaggacacaacattcacattctcagaaagagataacaaataaagctgattttgcaacagagcaagaccaacacatgcattattataccatagttcacatttgccatttccaaaatggcaatcatatctatcaaaatccaatttggatacacttatttcttttctttgcaaagaagggacataaaaacatctggaagtaaaagtgtgaagccattcgcgagctccaacagcttcaacttttgcttcaactccattggcaactctaatgggtcttttacttctttgcgtagtcctcattgaacggaatccctttaaacaattacacatatgaatagttgctctagaataaatccaccatgtggatctagaataaccaatcataatgagattcatttacaaatgtaataatgttctcacctttctttgccatgatcactgtcaggaagtcaggacgatctttcttggaatgtcttgtcttcttgcagtggagacactgatcctgtctcaactgtgaactgttattgctgaggcagatgctgaggctgtttagcttttgaggaggatgacctctagctcttttccttgttatctttaacaaggttaatggagccaccattggtctctttgagtctttcctcctcttgcacacaattagagatgagctcttcaagattccatttttctggacttattttgtagttgacaacaaagttgtcaaagctctttggcaatgaggacaaaaccagatggaccagaaagtcatccgagatgcccaaatctttttgcttcaacttggaagccatgttgctcatcctaagaatgtggtcttttacaccacctccatggtacctctctattacaagctgctttatcagctgtgtcgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 43085 - DNA, 8913 bp, Oryza sativa
  unsure (1)..(8913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcagaaagagtatgaaaaatccagtaaaccaaaaagtaatatctaatttataaactaagtattatttaaaggctgcaccggaaaaatgattctccatatatatgtattatattttaattaggtattcatgattaaaactggtccatatcactattcctgcaattagtcttacatgaattatctgtatgaggaaccattggctacattatatcgcttcattcaacagttctagaaagatgaataaatgataattttgaaataacttgtatatcattgtaagaagccaaaattggtcattttttttaaaaaaaattaggaagttccttagtaccttcaactatgtccagtctagtaataagaaatcatgacctccgaatgataaaagaaataaattatgtccattttcactagaaagtctccagctaaatgtgatgttttgacttttcaatcagcccaattagtaaacaacaactgtagtcatttttttagcaataataacatgagtttaccactatctttccacgttaccctttttcaagaatatttaattatgacgctccaaacatgtattgctggtagacaactagctatccactgcttcttttttgttcctgtgtgattcagtcctcagacgcagcaatccaaagtactgacgactaaatctgactaaatggtctgtctagtgccagcaatactaacattggcaccaactaacacaagcctactagtagattgtaggctacgccattctattttattattccaaaatgttaccagttgaacattatgataaaagcaaattagcaggtaccttgatatcccttctgacgtattttccgctgccagcttctccaacagttccctcgatgtggtgacatactgcgattgaaggttgcacatgctaagaggaaaacggaattgaactttataatctaaaacgtgaaatgcagttgtcccacagagagcaccaaatcatgtctcgaatgttacacatgaactaaataggatccaacaaaagctggcagatcaccgattcaattagcaaatggtaaaacagcaaaagattagtttatattctttttcctctaaaactggttgcacgttattcagaatacaccattctcatcaaactgaaatctgagtgcagaccaaaattagggggcgaaatccactaggacaataaaactgctaggattccgagatacagctatacttacatgaatgagtttagcctggttctgctgccgcggagccgagtcaagcaaccgcagcagattcacttcagtcttactgatgcccattgtgggatatctgatcaaacacggtaccaacaatagaagcataaccacaattgcattaacttcatttccagaaatatgaacgcgaaatcgcaattcatgaatctcctgattccagataaacagaagaaactatgaacggcctttctccgaatggagagggggaaaattgtactacaaactaccttagcgcacgcgtccaatccgatggacaattcgtatgaaaatgaaacaagatccaatcgacgggtcgagatacaagaatccgaggcggggacaattgaacggagaatcgtattgcaaggggaaaagaaaaagattgcaagattcaagtggtagaaaggttcaaggggacacctcctccgcttgttggcgtcgggcacggactaccaaaggaagcggttctggccggtcgcggatgtcgctcacgggtggccgttgccggctggccgaccggacggacggacggacggcggcggcggcggcggcggcggagaagacgcgtacgcctcgtcggcgtcgccgccacgaagggagcacagcggtttgggtgctgggcctgatgggccgagaaggcaactaagaaccgtccgatgagattggacggtggatagggcagaaactgtagaaattgccatgtagggactattcgtgtgattgttagccaaagtatgtgagaaaaattcacatatatataattattgaaaaatgtgaatcatagcttctctaaagaaaaccatagcaaatagtccattcaactccaattcatgatgtgcgactataaattacaaaacattgtctaaataagagttacttttttataatggaattgattctggcctttactaaactacaaccaattattacagaattgctggatgaataagtaaaaaaaatacaaaattataacttggttagaaacaataaaaccgctaagaaaaccacccttaaaaatatagatctccatgcatggttggctagagtgtgtataaccgagctggttcttgtcttcctcaaagcagaaaagcataatcttttaaatgaatagtcgatacttgtattataattaaattttgtacctatcaccattatcatatggcgtcaaaccaaagcggaagaaataatggagattagctgaactgtatatcagtcattagtccagattttaccaccaccaaacgaatccgatccgatgaagacaccacaaggatatcacaataatagggaacctccaatacaacgccttcaagaaggctgcgacatcttgaatatcactatctctaggttttcaatgagagagtccatcctatggcacggatgcaaaggatattgtgacatcacctccaggaagatgtctgttgtccacagaagtaactgatatctatcttcggaggcaaccgacaacagactcggtgggtagcgacaacagatgccggaggctgagcaaggggacatgcccgaggaagctgcggccaaggacggatccggcaacctacatcgccaaccgtgatgctaaggcaccacctcccgtcaccgtgcagccaaccattgacgagggagcctgcaccagtgatcgtcacatgtcgcgccttgttagatccatgttggctccttaccttgcctcgttgccacgctttcctggctttcgcttgctcacggggcaacgtcctcaccagatccacgccacctccgccttcctccatgctacagcctctctgttgcaccattgagagaggagccgcatcgccttgccaacctgccttgtcattgctgaccaagaattgtcacgacgccccaattttatttctggattaaaaaccattaaataatgcagtctagaatttatattaaaagtcaaagtactttagggtcgggaatatcagtgtaattgtaatagtacaaagttcttttaatcaattaagtaaatgaaaaaaccaattaaaatcatccccttctccttgggccatttcgggcccaagtctgctcttcgttcctcgatcttcgcgggtccagcgagcttctcctcttcatggatcagctctccttcctctccttggtctgcccatctactctctgctgaggcctattcgcctcctctctctcgcgaagtccacttcacctcccttctcccttcagccgccaataggtagggcccacctatcagggtcatcccctgcctcaggccagtcagctgcaaccgcttccaccccacatcgccgcctctactgtgtgcctcccagatcccgcatgtgtgtggacctgagtccctacacgctcccgcgcccacaccccctctcttcccatgaaatccggtgggatcaaaccctacttctccccaccttgtcgacccactccttcaccaccagttctcgcctcgtcccggctcccattcaccctctcgaggctataaagctcattccttgagcttcctctcccattttccctagtatcccgagcccaccatgccccgaaaccaccgcctcactgcaccaccctagcgccatcgctcgccgccgtgctctgacctagcgttgccacggctagtgccgtcgccgcaccatgccaccattgccataagcttcgctgctttgcgtagcgcctcggccactgctcctcttccactgctatacttgggtgataatttgactagattgtgtatattcttagccatgcttaattaccactagttcatctaatgggataatcacactacttacatttagtatcttgacgagctgcaagctcgagacatctagccatgctttattggtcataactatccacctaaaatatatggtttaatgttgggttgggtgcatgattttgtttgtcacgaacacacgcgcccatggcaataaaggacgttcacgtgaaaccctataagacttaccatgcttaccacaagaaagcatgggcaattgctgaacttctagtatagcttttccctttccgatgtacccaagtaagggtgggtgtgatgaagtttggatggactgggcagcggtctatgcggcttccggattcattgtagcacaagaggggattgcccaccttggttttaaaggtacgggtgaaacctgcaatgtggtgcacttggttaggggagttatgcgaagggacttgttgcaatcactcgcatggtgacatgcctgcggaagcacggtgacatgccggtggattgcgtcttgtgggtatagttgtacacttctagccagagtaaaactattcgaatggacatgcttgcggttatgggcgatcgaccagcttcaccatgtttagtctcactctattatttaacttgacttaatgaattggtatagttcaggtggttggctggacctgtttatcgtggtgtagcattgttaagtggacattaatcttgtcttaattaattaactgttttattgttttcaactacaaatgtttacaactgcattcaagcaaatagccacaaaccctcctttgtctcctcttgcatgcctacatcattagcgtggcttgctgagtaagttggttgtactcagtcttgctattattcttcctttttagaattggtagaaaaaccaagacttataccccagtcgagttttacctatgaagtggagttgaagcctgctaggatcgtatttttctgttgttgctttcttttcagcgtgggaactaagtgtctcttccgtaagtatttacgttttatttatgttctgatctgtatattaatatttctgaacataaatttatacacaaaatagtctgaaaatttggttaaattttggattcacaacattataattcaatgctattcacctatatgtagccatgccattataatgttacacgtattcaatatttgccattacttgctatttcgatgcaattctaaattttttaccaaatttcttaatctctttaaattaaaaatacaaaaagataactactagtttctcgtcttcataacaaaatgaaatttccagttttgaaaaacaaattttctaattgctgcaaacgcattttctgttttatagttctaataaaaaagaaaatccaatcatttagaaacccatcattaattgatgcacattgctgacttcctgctgcctactaaattggacctagtgctactccaccaaaccaaagcatagagccaaacatggcttggctggctatggacatatcactatctagcactaccatgccatgtcctcacagagtcaaactctactcctttcatcattgtctcttgtgtcacatggatatacactttcgatggaaattccaacattgcggtcgcatgatcttgtcgtccatcttatcgtccactcccttttccaaattttgcatgtgatacactggattggaatctgttgctccatataaataagtgactctgagagtagcaaagccaaagcaacttcacacacacagtgtactgatcaacacttctggaagtggagcaaggttgagttacctgtgagacagtaatgaagaggaacaccatccttgctctcttcatctgggccatggctatggtgatcttcgccacggcaatgccggccaaggcaaggatggaggggatccatcctcaaggttagtttggtcattttacccttgttccatagcatattgtagtatatttttaagctaaatcaaacttttcttcatacctgtgacactagtatagcatatcccatgggtgtcggttgggaatctcgtataggtgccaaatttttaagaggttgtgctagtttttaattttagatccacaagagtggacgagagagcatgaaaagtctcacatgtattggtttttaggccgtccctgttatgggttttggagtagtggactagtggcaatacatgcaaaattttcctttatacatacacagatgagaagatttcactcttcttgtttatttggaagtaatcattgatttttcttgtgcaatgaaatgatcgcaggatgcagatgctgctatttcagacttaggccgatgatccagtgtgccaaggcttgctgtggctctgacgatgagaactgctgccttgtgaacaactagttcatctcgggaataaataaaccgagtcggtcttggacctttgcttaatttccttgtgtttcaacgatctcgctgaagaatgcagttatatatatgaaataaaatccagctcttgctgttcatacctaaatgtgtgtgtcctcatttccaaatctattgtgtgcggtcagcaccttgaataatactgcatcttattaactgcgtaccactgccaccagtaggttatttgtaaaagatgtagacataaatatccatgctacatatattctacagttctattcatgttggcctagttgaagcaaccttgacatttggcacttttaaaaacacataatacgaaaacttcaactaaatatatgtatatactccctccataaaaaaaaaacgaatataacgcattacagtacaataaatctatacagatatatgtccagatttataatagtaggatatgtcacatctagtattagattggtattttttaatgtaacagagggagtagaccccgtcctcatcattagtcctgaagaccttgacagtactacacaaggagcccttggactagcagtcaaaacccgcgggggctgaccgcgcgtccgacatgaggcttgtgggaagaatatgtgagagaaaataggatacccgataatatctgagttcgaacccgaattcgtaaaagaatgtgggctagaatacgggaagagttgtatccgcctatatgtctcatgctataaaacatatgtgaaaatctattataaattcacctatatacataataaaatgttagttgattattatttttataataagctctcatgtattattatataatttgttctttgatgtatctcttttagcacttcaattgtcttcttacattaaatatctatgaattaaatatacaaataaatatcgttccgaatctgattcaaagaaaataatatgggataaggtacggatgagtgatatgttatctgacattatcagtgcctagttctgaatttaaagaaaagatatgatttaggatatgggaatggtgtgatccaaccgttttcatctttacctgccactgaccactttactcatgtgacaccggggctgaactggctagccaatgcgtcaggtgatcatcaattcagcgccttcttctttctctagtcactcgaacgctggccacatcggttgacctaatataccaaagcgaaagtcaaaatttacaattttaaacttaattttgatgttgaatttaagatattttcaacatatattcttttccagtattggcttttaagtcgctaagaataaatatatacaaattgtaactatatattaaccagcatcaatacaaaattatcaatttttttacatataatattatttaaaatttgctaaatatctatcttattgtcttaggactttgaaagaccaaacattaattatcatcccctgttttctaaaagtcacaccaatcactacctcttacttttttattacccatttatttgcttcctcgatctaccacattttctattcgtcctccttataacctttaaaaaatgggaccttttattgtttcgttgggttttatttttataatttttagaagtcctgtcaaacatcatcattgtactcttctacggcccttccactgcctccctctttattgtaattgggattctacaaatcgaatataattcgttggagttaattttttactttgtaaaagtcccgccaaccattggtggctcaagcactatactctaggagtataacccatccactgcctctcttttttattatcattgtgattttaaaaataaaaaatgattgtcattgtggttttttttactttgatgaagtcccgccaaccaccgtgataggttacttaacggccttccatcatccccctcttaatcatcattgtgattctatttaggattttttttatagttttcctatgtcccatcaactgccactaccctactcctgctcgtttttaccttaccgccggtaaccgtgcggttaccgcggttaccgggcttaccgcgggggtacggtaatataaatacctcggtaacctccttaaatttagataaatttaaaaaataatttgaatttttgataaattttgcacggttttgtacggtttttcacggataccgcggttaccgtgcagtaaccgtgcttaccgccggggcgcggtaacccgggccccggcggtttgggaaaccctgttacgagcatgttgtttcaactctttattgcaatttatcatcgttgtattctagatggactattatttattttttttcatatctttattccaatattttgatatttatgaattgtgttcctacttgaactcttataattattttctatttttggaatttatttatttttttattccaacttttcatt

SEQ ID NO: 43086 - DNA, 3404 bp, Oryza sativa
tttagtttttatttctaattttcgttaatctcgtatgtgttctatatgagtaaacctttcaatatttctaattttttatttccattttttgttgtttgtaaattgtaatcttacttgaattcttactattgttatttgataatttattctatatttcgaattttaattaatctctaattgtgttctacatggactcttctttcaatatcttttattccgaatttcaataatttctaaatgcatttctactcaagctcctctcttctttttctctgattaatgtgagattttgtagcctccatagggaactaaatataatacacacgatggatttaaatatgttatcttttacccactctcgaagctttttttatttttagtcttgcgttggagtactttcatcgttgaaaatagatgttttttcacaggtggccagcgtactggggccacctatgataaatcttttacataggcgacccgtgcctcccaccatagatcaaacttattgcaagcgggcattctcatggatcgcttatgatcctgtacttgggtgatcggggttttctgtgaaaattattcttttatgcactatgactaaaaaaccatataccgttctaatggaatatatagctaggtcaacatgattttcagatttgatacctccagtaacatatttccagaccgtcagtatgatacttgtggtatcagatctggtacgttcagtatcagacatgatgccccgtaggtatcagatctgatacctaagtatcatgctaacatcattgtgatacctacggtatcagacatgataccctgcatgtcaatgtcatcatgatatcagctttttggttggaatggtataccgttgtatagtatttctgttaaaaattaacatatgtggagcataaaattcattctcatccaacctgtggatcttctccttctctgacatgattgttgattccggacgtctgcctcatcttcttcagccttttggccttgagcatgtcggccacacgttgacaggctagatctatcaggcccttgacgcccatgacattggctgcgctgatcaagcgccgcagcgtgtcgttgtcgaccttgatgaacaccctgtcgaacttcttgagctcgtcctcgtgcattgctttcatgtcgccggtgccagagctcaaggtggcgtgcttcatgcagtaccgcttggcgatgacgttgtcggcgacgttagggatgggaatcccgttgtcaccagcgtggtggtcactgttgttcgtattgttcaccactgtctatgacagtcttgccaccgcctcctccacttcaaagtgttcttcgtcggagctgatcaactcaaccatcttgccaccatccgtcgccatgcatcgccattgatttggctctcaagttttcttcaaatctaacccaacaggctgatggatatagatggcgatgctttgactcttggaagtgttatatatattgtttggcgatatcgatcgataacacactgatgaattttgtgttatcttttgcgatttctactagtatactaggaaaaaatgcttgtgcgttgcaattggaggtaaagatcaatggagaatgagtttattctttcacagatatctgatatatgtcaatacttattatccagtagaagccggttaatttaaaaccgtacctatggaccttttccccatcttcacgggatgaaaaaaatatagaactggaatctttcgtaactttaggtcctggttaaaaaccagcaatgtagatatcggttttctaaaaagaccgataccacaattaatttagttgtaggtatcataggtgctggttccagttaacaaaccgacacgatcttatctaattgagctgagcgaacctttttttttctccgcccatacgtctcctcttcttttttccctcccctcctttactccacccacacacctctttcttttttcctcctctttttctacgcctcctctctcttctcctcaaacctaaaaggtggcagcggctgctgctcccccttcttggcatggcggcggctgctcctcccctccccggcacggtggtagcggctgcgtctcccctccccgactgccccctccgctttccgacatggagcagatggcggctgctgctccctctcaccacctgccaacatcaaaatttggtaagccctgaagtcatcatcggcctagagtcagtatcggctttagagtcctagattcgcccaataggaattatcaagtcgccaatagtcagatctttgtagattcggctaaggaaattgatcaattaaaggaagtttatctagaggagaccgagttcaaggaggatgcggcataacagtttatctattaattaggaagaatatgttagtttccttttatctttaggaaagtgtgtttagtgttcgataaggactttatgttttccttttatctttaggaaagtttttttttccaagaaggactagtatctacccatgggaataaatatgtacacccggggtcattgtaaactatctctcgatcaataaaactactctcggcgcatcgctaccctcttttccgaggttttttatttatcatccagcggaacttggcacccgatgcgggctgcatcagcttttcgatctcctgcgaaggggtaagtcctacattccgctggccctagcaattgtatcggctacattggtgttgttcaaggctacatcgcttcgatctcttggatcgctctggttaggttgatatatttgcctacctatttatcatatgtcttggttaatctagtctggtagctcaatttacttgtatcggctggggtctgctttagggcttttgccggtatcggctaaattgcttttccagattagattagctaaggtatccaccaccttgaaaattagtcaaagacttgattgtttagactttatacttcttagcatactttgtgacgcatcatctctagtcatgcttagaatcataaagattaacctgtctttgattataataggaaaaaatacgaattcccccccccgaagtataatggtcgtccgaattacacccctgaaccacaaaaccggacttcacccccaactatgcaaaccggacgaattatccccctcaacccaatccgcggtggttttggtctacgtggcagtccagtcaacaatttttttattaaaaataggtgggccccacctgtcagtttctctctctcttctatcttttctctatctcactctctctctctcctcctttagacggtggcagcggaggcagcgagcgcggcgaggcgagacggcggcggcggcggaggaggaggtgagcgcggcagcgaggcgagcggcggggccggagtaggcgaggcggcggcggaaaggcgagcgcggc

SEQ ID NO: 43087 - DNA, 4549 bp, Oryza sativa
gtggggcccccctattttttaataaataaattgctgactggactgccacgtagatcaaaaccaccgcggattgggttgggggggtaattcgtccagtttgcatagttgggggtgaagaatatccggttttatggttcaggggtgtaattcggacaatcgctatacttcgtggggggggggggtaattcgtactttttccattataataagggtttcatcggggtttcagccgatgagttatctaaacgttgcattagcttacaaggattgtatacaagttggttttaggtgattgcaacaaaggtttcattgtttatctaatcatttggatttaataacatcgaaacaccagacgatgtatgctttaaccatcggatcacttattctatcatatcattattagccgattgatttatattggattatattattgtcatattacattatcattagctgattgtctttatatcgttatctacattggacatatagccgattgttcaaaaccctatcgacatcggctggaactactccatcggtttgtcaaccgatcggctatttaatatgttgtgtacatatcttgtcatttataggatcaaactgactggcacgtctgcgtctcattaatttttgaagctgcactggagctgagcagatctcccaagctgttgttgttatagatttagtttgcgccaacacagatccgacaccatcagtcgagcgcaaatttttcatcaataccaccatggcggctgcttccctccccggcatggtggcagctactgccccctcacctccccaacgtggagccgacaacggctgctcccctccccggcgtggtagcagcagctgcgcccctcccccctccccggttgctgtaaaatcaaaggtgtttttgattattactctgtgatgaacaattaggcattggagattattggttttattatttgaaatttattcacgaagtggttttggagatgattggatttcacaggtgaatctgcaggatttaatgtggaccggtcagaccgggctttggtagccggtcagaccggcgtgtaatgcgcggtcagaccggcgcagcccacggtctgaccggccgacgctgtgtcggtttcggtttcgggttgtttatttggatatccgagtttattccatgattatgacttctagatggatactatacgtgtgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggataagacgacgtccatggtggtcagagatcatgcgggatacttaggctagagttgatgcacgtggttgatggagattccaaatggcatacgatggagttattgtgtgcgtttgggatgcggagtcgaatttggaaggagtccaaatttggtacgtttggttatgtaaagtttctttcttgtactagtgggtttcctaaggtgtttaggactcctagtatgagtttggttcgtggctttaggctgcctacctcatgtataaatagagggggagcgtgaggcttcccggtatcgctttagagagcaattgagttgagttttgagttagggtttcgagtttagtcgaaattttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggcggcatcgcggcggtccgaccggcgggcacacggcggtcagaccggcggcttccactcggtcagaccggcagatcaatctcggtcagactgacttccgtcgatttcgagggtaacttttatttccgctaaaagtttttggtttttgggtaaaccaaccattcaccccccctctggttggcttagttcttgtgattcgatcctacaagtggtatcagagcctcgttttcttctttggatttttatcgatctaaagtttttgccatggctactccagctaggttttcaactaagcctgatgttttcgatggaactgattttcctcattggtgttgtaagatgcaatcttacattatggctgaaaattatgatatttggaggaaagtttctcttccttatgtgattcctgaagccattaatactgatgctttaaaaactgagtttgaaaataattgcaaagctcgtaatattcttttgagtgggatttctcgttctgattatgatcgtgttgcacatcttgaaactgctcatgagatttggaatgctttgaaaaactttcatcaaggaacaaataatattaaagagcttcgtcgagatctttttaaaaaggagtacattaaatttgaggtgaaatctggagaggctttggatgactatctttctagatttaataaaattttgagtgatcttagatctgttgattcttcttatgatgttaattatccacaatctgatatttctcgtcactttttgaatggtcttgacatgtctatttgggagatgaaagttacatctattcaggagtctgttaacatgtctactttgactttggattcactttatactaaattgaaaacacatgggatgaatattctttctcgcaaagttgattctaaatcgagtgctttggtttcctcttcttcctctttggttattgatgcttcttcatctatgccttcttttcttgctgcttttaatgccacatccgatgatcaactcgaacaaatcaaggaggaggatttggctttggttgctaaccgaattgctcgagctatgaataatgccaggaacaggaaaagaggtggtccaaatcgttgctttgaatgtggttcaattgatcatcttcgttcgcattgtcctaagcttgggagaggcaaaagagaagacaaagacggtgagaagaccaacaacaacaagcccaacaactacaagtcgaagggttctaaccaagggaggaagatggagaatcttaggaaggcctttcaacaagtttgcgccgctttcgagccactaagtgatgtagatggtgaaagtggagatgatgataagggaaagaacgtctccgatgtgtgcttcatggtgcgtggtgaatctgacacagagtatgaagataatgaggtgtgtgcttttgaagaagctattaatattttgagtgcaaaaaataaaaagtgtgagaagatatataaaaaacaggagtttatcattaatctcttaaatctgaaattaacaggttaaaatctcttattcctaatgatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaactaaaaagttgttacaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgccccaaatgtcgtaaaagcaaaggtgtcatggtagattgtgaaaattgtgctaatttgaaaaaagaggtttcttatttgaaaaattctttgctaagattttctgatggtaaaaataacctcaatatgattttggatcaatcaaaggttagcacaaataaccgtggtttaggttttgatccttatgctcataattctagacatcctcctgttgtgttaggtgttggtgctaaaagtggtgagattttgattaaacatgatactaataaaactgtgtttaaatctgctggtatcatgttaaccatgaatgtatcttcttcaaaatccaatgttgtgcatgcaaaacctcctgtttctgcttgtgttgctaaatcttcttgttctaacaatgtgtctaaacaacgtgaaaaatatacttgttctttttgtggaaaagatggacatattgttggtttttgtttcagattagctcataaacagaaaaaggagagagagattgcttttgcaaaatcaaagtggcaaaaatcgggttttccctcgaggaaaccggtcagaccgcagtggatctcgcggtcagaccggcgaccggtcagaccggctgcagagcctcggtcagaccagacaccggtcagaccggcggtacagaggtggtcagaccggcccccggtcagaccggccactgtacctcggtcagaccggcctcggaggaatttttctgaaaattccaaaattgatatgcctattgaatcttctggtcgtgtgtctcagtactggattcctaaatttttattatcatctaaccctagtactgaggcttcgacttctgcttgtgtgtaggctttggtggcaaggaaggagaa

SEQ ID NO: 43088 - DNA, 5461 bp, Oryza sativa
ggcggcttccactcggtcagaccggcagatcaatctcagtcagaccgacttccgtcgatttcgagggtaacttttattttcgctaaaagttttcggtttttggatataccaaccattcacccccctctggttggcttagttcttgtggattcgatcctacagttgccccctcacctccctgacgtggagccaacagcggctgctattcccccctcctcggcgtggcagtggcagcggctgctcccctcctcggcgtgggggcagcagctgccctcccctccctggctgcccactcacctccccgacgtggagccgacggtggttctctccagcgtggcggcaattttgatttgtgactattttgaggattttgtgaattgggatgttgatttgtaatcatcatacgatggggattaggtttcttggcgatgaaattcatgagctctagattaaatttgcctttttgtgttgtttttgttgtcttgttaatttattgatttggagatctaacttggggtttttttaaggactcgaactcaaacgacggatgaatcgaagccttaagatttttaattttttcattaacgatcacgagttgtgtgcactttggaaaaagttcgcatgacgtctcttatgttgtcaccaagttataaaatcgtccgtgaacccaaaaactagatatatgagatcccttaatgtacaaaactaagacactatgggtccttggatagtattgacagcggttaggtccttaggcagtattgtctgcgattaggtccttaggcagtattgattgcggttttatccaatgtgacagcttgagaattgcaatggaaaaggggcgagcgatcccgttggagacgtgagtacgtgacaccgtccctcgcattgcagtatagaaaaatatagtaacaacttatagcactaattagttcctttacatctaacgttgaacatattatgaacgaacctgcatagactgtaattaactaatactactacctaaccggtaattaactaagacatggtgcataactgcatatacttaaagttgctcatcgatctaatacatgtaagaataggatcagagccattgttcctcgtcctcccggcgaaactcctcttcttcctccggcgtgaagtcgttggtgatccccaacgtctgcctcatctgctccgacgtcttgcccttgatcatgtccgccaatcgctggcatgccaggtccatcagcccctggatgcgcatggcgtccgccgccgtgagcaagctgtacagcatgtggttgtccaccaggatgaactcgtcgtcgaagctcttcatcatcagctcctcctcctccttgctcgtcttcgccgtgtcggcgttgatggcggcggcggcggcggaggcgtgcttggtgcagtactcgaccaccttggcgaggacgtcgccggcgacgttggggagagggatgccgttgatggcgttgtagtcgtccttcttcatctcgtcgagcaccgtctgcgacagcctcaccgccgcctccggcacctcgaagcgagctccgtccgagctgatcagcgtgaccatctcaccggccgcggcgttggtctcctgcggtgctgcgggtgccgccattgatcggtcgaacacggacgacgctgagattgatggagaagaaaggttaattcctctcctcctggaaggctgtaattaaaggtgattgcgcgcggcaatcaggttagttagtggtctctatttatttcacgaattcggctaggtatctaagcggaatacgttgcgtatctccttgtgtatgaagaaaccacatcaatcaggattcgtagtagaattggttgcatatgcaacataatctcgattggactctgcactttatctgtaagccggttggtttcatggaattaacgtattttgatcggaattggcatggaactgaacctggtttttagaaagaggtagttatagaagattgacatacgacaacagcagcaactaaaacacatcccaagtattgaatcgttcaagtctcatcgtcacttaaaaattgcatagcatatacggcgtgtaatatctacagctagaacaaggtatatctggaattattgtaggtgggttcttcctgacacgtaaccgtaatctatctattattatatgctaaagtctattaaatttcctacaaatgcttaagctgccatgtgtcatcatataaacactctcaagtcaccacaggtcactctaataaaataaaaaaatctaaccgtcgatttttatttaaattggtggacccattagttcattagttttgaatggttagatttttatctttacgaggaaacaaaatctccctccgtccaacttacgtatagtacgatccctccgtagcagtgtacttcctccgtactcgtaaagaaagccgtttaggacagcgacacggtctccaaaacacaactttgacttcatgtttctataaaattatttattgaaaagtgatatatgtatacttttatgaaactatttttcaagataaatctattcatataatttttacatttccaaactcaataacttgagagttattcatgatttatattcctaaggtttgacttaattataaacattgtcctaaacgacttcctctacgagtacggagggagtacgtactatattttttcctcctcctttttataccatatatataataattaaaattgaaaataacgggcctaataagcccatcaacctactaatccccactccccacccatcgagccatttgtgtacgtacgcttttcttccacctctcctgcagcggataaaaaaaaaagctgcaagaaaaaaggaaaaaaatgcatatatccgtatgtacccaagaaaaaggcaaaaaaaaacacatacactaattgacagaaaaaatacgtacgtacataggtacatacgaataagatatagaaaaacaaactatttattcttatcgttatatcgttatagttatagatgactatttaaaacgtggcacatccatcttatctctaatattaacatattaattatattttaatttaaaaattatcacatagaaccatattatactcttttaggcctttcggatcgatctttatagatgactatataaaacatggaacatctattttatttattaaaaaaatattgtgtcacatattaattatattttagtttaaaaattatcacagcaaccatattatgaccctctttgtttaggcttataagcaaacttataagaaaaaaatccgggcctaaacaaacaatcagtgttttcgtttgtttttttaagccataaaccactctaacactattaatataataccccgtatattaaaagatatttaggtttttttagtttgggttgacttgttaaaataaagatgttaacagaaataaataaaagaaaaatatttttagaagtgggccaacatgagaaggcccataaacccagcccattagttctccccctaaaacctagagagaggaaccgaatccacctcccctcatagtgccgccacccctcaccctggcccgcgcctccttcctcccttccttccatctacagcaaattgctctccctagatctccaccttcatagcttggatcaagaagcgaagtagaaaaacggaacgaggaggaggagaggagtagaaggaggggttagaccggagtctcccgtattgtctcctcacaagttctctaaagaaactataggtgagacttatctccttgttgtatcagttgttctagcatggctttagtgcattaatttgtagttagggaaggctagagaaggagtttgggtagttgtggttcggtttgttgcagttctgcatgtgggcagatttgcagtgtttcagtatttcgatgtttcggggctctaaatgttattttctgtgaaagtgtataactaggaagttgtagataatgtttggatatatcttctagccaaagggcgtgattttatctcaagtggtttaggagatataatttttttagtatgactgttgttttttgtcataatctggatactagtagattgaactgtttttggaggggttaaacagtggaatcagccaggccgcctttagacaaagttgtagaggtttttcttagctttccatattggtaaagtacaccctgattgggcaagtagaactccagttatggttgttttagtgtggacagtctgaaattctagacagattctgaagcctgctttcaagcgcatattagtcgatttaaatggtagaataaaaatatgctttctacatgaaagttgtaggtattgttctgtagattttcaaaatgtatacattttcagtcatagccttttcatatttcaagatataaaggtttgaagcagcagttttgtgtatagtccaagcggcgttcctagttattgagttttgataggatggggcagtaggttcacctttttcattattttacacgcatgtttgaatatgtgtttgctaaggttttgtttgtgattaggtggtggtgcatcagatcgtgcatgataccaatcctttgttggaggcaactgcatgacgaactaattgtgtgattcatggattgtttactctatctatttatttctgatatatttcaacgtgataagtaactgcttatgttcatattattgttcacgccatttagatttcaagttgatcttatgcgtacgatgttattcttgttttaataatattgattctggttctgtttaaataattcaagttccctggttgccatggatgtgtttcaatttggttctttgattctggtttcaattattcaagtaccatgcgtagtcatgggaatgcaatttggttctttattcaagttcctgtgggtaagcgctgatcacgcttactcggctttgccggcaaatgctaggatgtattcactattgtccgggatggaaactactatttcaattcatgccagcccgggatgggaactactatcttctttgacttggtgtttgaaaatgtgtttcctatcaaagaaagaaagccttatgttcatgctttattgtcaatgatgtgtatatgtgttttctagttccatactgtacttgctgagtattttatgctcactcttgtgttttatttggttttaggtacgcattgagaccgacatgtatgggcgggaagtagcacccctatatacacatctacttgacactatcaaactatattgcttaggtccataatgacacttaaattatatcctggtttggtcttgtaataatcttttagatttctaatagtttcttccccatggattataaggatggatcgtattatgggaatgatattgctattagttcaacttataattgcctgttgtggatgtctgtatttataggggagactctgccaaaatttctaataattttggaagttagtggtttgagtgttctttggtggg

SEQ ID NO: 43089 - DNA, 11935 bp, Oryza sativa
ctcccatagccactttagatttatcttcatctaagcacttcaacaagacaccatctatgttttggcgatacaaatctccatcaagcaatgtatatttgaatgcttgccgccgaattttccgatcaaccttaagtgtgggatcttttagatattgaatcaaaggaattccccaatcctcttctgtatcttgggcacaaatgtccgaattctcaattaattcggcctccaaatccattgaagcgtgccccccagctttctgcccaacaccggtcagaccggccacgcagggccggtcggaccactcagggatgccggtcagactggcggcatgcggccggtcagaccgcccctggtcaccggtcagaccggccgtgcaatgccggtcagaccgcccttggtccccaattctgccaatttcgcacaaagatctaaaatcaagcaccggctcttctaatatcagaaataaccccttcttcacattataaccagatgcttgttgtgccaagtcatttgctctagaattatcacgcctagcaatatgtctaatagcaaaattatcaaaattggcaataatatccaaacatgaatcgaggtacctatttagtgacccgtccaagcatttatagattccggcgacttgttgtaccaccaattccgaatcaccaaaggcctccacatatttagctccaaccatctccataacttgtaagccgaacaataaagcattatattcagcttgattatttgtgcaataacattccaaacgaaccgatgcctcataacacataccattagctgaaaacaaaactactcctatgccttgaccttctttgcaagaagaaccatcaaaataaatcttccaaggtataacttcaactaagcaaacctctccctcataagcaacatctatatgatggtctactataaaatcacatacaatttggccttttatagtttttaatggttcataagccaaattatattctatcaaagcatatgcccacttgccaattctcccacttagaattggcctttgcaacatgtgtttaataacatcggcttgacaagtaactatgcatgtactagataacaaataatgcctcaatttggtataagcatagtataagcataaacaaagcctttctataaagacatacctcgtttcggcatctaaaagatggcggctcaaatatgtaatgatatattctttgccatcttcctcttgcgtcaaaacggtaccaatgactttgtcttcggaggcaatatataaccgaaaaggctttccggctttaggcgctctcacaacgggtggagtggacaaatacctcttcaactcttcaaacgcctcttgttgttttgccccccaagtaaaatcggcttcttttttcaagcgaagtataggaacaaaagcatcgattttacccgctaggttagaaataaacctcctcaaataattcaccttacctagcaacttttgaacctccgttttgcatgtcggcgctttgaaatcacgaatcttttctatcttcttaggatcaatctcaactcctctctcatgcaccatgaatcctaagaacttccccgccgacacaccaaaagcacatttaagtgggttcatctttaaaccataccggcgcatcctctcaaaagctaatctcaaatcggctgtatgtccttccataccatccgatttgacaacaatatcatcaatatagatctctaagataatacctagcaaatcatgaaagattaaattcattgccctttgatacgttgcaccggcattcttcaacccaaaggtcatgacaacccactcaaataaaccaacaaaacccaggcacctaaaagccgtcttgtacatatcctcttccgccataaagatttgattgtagccggcattaccatctaaaaagctaatcaccttatgacccgaggcatcattaatcatcatatcggctataggcataggatattcatctttgggagtggctttatttaaatctctaaaatctatgcaaactctaatcttaccactccctttcttctccaccgggactatgctagaaacccactccgcataacgacatggcctaataaaccccgccttcaacaaccgatcaatctcttctttgactcggtcatatagtaaaggattaaaacgacaaggtggctgtttataaggcctaaaacccggtttaattggaagccgatgctcaacaagctcacggctaagaccaggcatctcatggtactcccatgcaaagcaatcaacatactctttaagtagctcgattatcctaaccttataatcggctctcatgtttttgtttacaaaactcggccttggtttagttccatcacctatgtctacttcctccaatggataggccgatgtaaacccttgtccaagcttctccacttcatcaaaatcctcaacggtttctccaatatcgacctttgtagaccgatattcttgcaccctcttttgtaaccactctaaactagcctctttactcattatacaaatttatatggcttagccgtgctacactagccggctttacagagataggtacaaatttgccatcggagatactaataaaatcatagctagaaaaatccctccccggtaagcattggatattcccatgacgccactcaaaaatagcatcggccattgcaacctcggccgatgtatccgcttgaacaatttcaacatcatcgccgtcccattgtattaaacattgatgcaaggaagaagccacacaacaattggcataaatccaacaacgacccaaaataacattgtagttaccttgcacatcgacgatgaagaaagcggttggtaacgtcttgtttcccacggtgagctccgccgaaaagatacccctcgcctccgttggttcaccgttgaagccattgagaatcacgttagtcttcttcaactcatcatcctcgcgccccaacttcttgaacaacgagtatgacatcaagttcacagcggcacctccatccactagcatcctagagaccggttttccatcaacatggcctttgaggtagagaggcttcatgtgacggtttgattcatcgggcttctcaaaaaccgcgtctttaggacctaatgagagttgggcaacctcggcttcatccatagcacaaaactccataggcaacatacataccatgttgatatccatgtcttcttttggagacgattcactttcatcaaccgattgttcttccttcttctctacatcaatcggttttgccttctctatggacttaggcctccataccggtggtggtcgcaactcattgaaccttttatctctttgctcttcggcctttttctcccttaattcatgggcccgaagacgttgcaaccttctcttttgcgtagccgtcaaatccttaggcatccacataggattcggctctgttccagaaggtaaataatatcctctattaaccttgcttgaagacgatgaagccctcacatcgccctttgcagccctcccatcaaaccggcgctggagcccggtcagaccggtcgcagaccaccggtcagaccggccaaatgtgccggtcagaccaacacttggcgcacggtcagaccggcctgaggcgtcggtcggaccgctatcaagtcggcggtcagactggcctgatatcccggtcagaccggctacatggccgcggtcagaccggccagagggcctggtcagaccggtcgactgcgaggagctggtaccggcttcggattttttgcttggggactttccaactccatctccagaaggtataagcacatcatgggaccctactttgatagtaatcacctccgaagtcctttcttccaccatggtgcgctttccttctctcttctcttcattaacacgatttttaccataaaatcggcttttgtttggtgaagacaaacgctcatgaattggcatccgtggtccttcccacattggaggtatatgattgtacattggcggcattgccccccatggtatgaagtaaggataaggataacccggcggcggcattggataggaaccccatgacatattttgtggatgaaaatatggaagtgaacgcgatcgtcttggtgaatgaccaaatcgctccctaggaggtgatcttggtcttttccctttgttgtggaccctcccaccaccttgcctctcatacttctccaaaagcatatggaaggttactttggtcttcctaggagccttagaagttgaagccccacccttattctccttctaaacgccaacctccggtttctttagcaccatcatcttaggtcttggctcaccaatgaccacttcctttcccttagtagattcggcttgctccggccgaatcaacaccttcttagcattaaaattaattgtattcaccggaaaatgatcatgatcaagcttcatcttggagccatcggtgaatttcaatcgtcctttatctatggccgattgaacctgtcgtcgaaacacattgcaatcattagtagagtgagaatgagaatcatgccacttacaatatgctcgacgtttcaactcttcttgtgatggtatgacatggcctttaggtaatctaatttgtttctcttgcaaaagataatcaaaaatcttatcacacttggccacgtcaaaactatatttaacctcactttgccgatctttgcgaggagtcggcattaggttagaacaaacaaaaggtttatttttgttagtccatgaccactaggcaacataaatatcatgataaccctcttcttcactatcactagcatcagagtaatcaactacattaacattaggctttttgtcgaatggtctagcaaattttttattatccttaacccggctttcttgagccagaaccctttgcatgagttgactaacatcaagaaattgttggccatctagtttttctctaagaggaagtccggccaaatctctatcagttatattcaaagtataacatccgtttctaacatctctaaatctcttaatataatcaacaacatattcattatacttttgcttaaccgatgttaaatcacataacctaagctcagtttctctagtatagaaataatcatgaaattgttcttctaattgagcccaagtatgaatagaatttgccggtaaagaagtaaaccatgtaaaagcattaccggataaagataaagaaaacaagtgcaatttaaaagtatcactattagcctcaccacattgcgctaaaaattgacctacatgctcccatgtggtcttaccatcctcaccactaaacttgccaaattcgggaactctataatttctaggaaacggcacattatcataataatcaggatatggctttttgtaggctctatcacgattcctagtttcgatcccaaatctatttctcataatatcgctaatcacatcctccatgttattaggcccttgtggatttggtggtggatttggtggcctaataggttgggtttgtggcgcaatatgattatattggccttgcctagtatcaggaggatatcccctagaaacatcattataaacattaggaatatatgggggaatttgaggattagtggtggcaatagatacaggaggatcaaatgttctaaagtagtacaaataactagcattagtcattggatctattccctgtatcgggacaattgcgccggtctgaccggcccagggcccggtctgactggcgtcatattgcgcggtcggacctgcctgagagccggtctgaccagtgggataatacccggtctgaccggccatctggccggtcggaccgacgggataatacccggtccgaccggccatctggccggtcggaccgacggctgtgtcgcggtcagaccggccgtcaggcccggtcggaccggccgtgagcgccgccctgtcggttttaaaccctattggatctataggagattgatcaacagtggtataggctttatcttttaatgtataatcatccataaaagcacctagcctactccttaaaaacccatcaaccttttccttaaacattacatctaatctttctttaaaattagccatagatgaatctattatagatgcaatttgtttgttgatagattgcgatacctcgtcattacttaccacgtcgggagcgagcttgggacgtggcccgggcttgatgatcacgccttgacgagtcctagtagtcaatctcatcaacgcctcccgtgtgagctcgttgatgtactcctcaacagttttacgatcctctccttcaaagtcatccaatgtgaccggtatcacatgagatggctacacctccgtcttggatgatggcttcgtcatggcgaagtcgaagtcgagttgacgatgaacggatctcttccccagcggagtcgccaaaaatcatgttggcaactttcttgacaagttaacaagcacgatcgtagcaccttaagccttgcggtgatcctagagtcgccaaccacctcgatctagcaaagagctaaatctagatgggttttgataaataaaccggctagcggagccgatttctagataactacccgtctcgtgggcaaacggaaggttttcaggacaaacctacaaagagatgtcgcactctcgcagcggcggcggacggtttacggcgcaaaccgacaaagatggacaaactaagaggaaactaaaagcaatatgaaaagaacgattcgattgattgattgtagattgatttttacaatgaaccggccttgtcccttatataggggttggtcttgccctctacaggccctcctccacatccaactcggggtaaaaaccaaaggaaacccgaaacatgccttcccgagcaaggaaacctcgaaacctgacgaaacagggtcgaactcggacctgccggtcagaccgttcacacaccgccggtctgaccggccctcaaccggcggtctgaccgcccaacacatggcggtcagaccggcacactcggaggaaaccggtagatttctaaattttggcaatctttcctattttaatcctaggtgccaaatttaggtgtaaacacaatgtggattagaaaaaattaaattgatagttagttcttaaagtacggtcagatttgcaattgctcctattttaatctcataaacgaattaacgcaaaaaaatattggattgaattcgatcggactgcgcatgaccgcatcggagtaataatttcttcacgcaataaaaacagaccacctcgccctgatccaagcacgaaacgcgaaagatcccagaaacccagttagactcggatttacttcaacagattaaaacagactccgtctcggagtttgtcaatctctggcttcatccatatatacagaccgccaaaactaacaatttccaaaccatccagttgccgagaaacgcaaacaggtttttgatcaacaagctagggcgcactcatctgatcgatcagaagttcacgcctttgttcaacaagcgcgccaccgagatggcatcggcagcagtagcagcagacggcgccgccgacggcaagaagatgatcctgctcgtcagctcggacggcgtgaaattcgagctgtcggaggcggcggcgagcttgtccaagacgctgggtaacatgatcgaggatgactgcgccaccaacggcgccatccctctcgccaacgtcgccgccgacatcctcgccatggtggtcgagtactgcaacaggcacgccgccgccgccgcgaatgctagcgggcaggaggagctcatcaggaagttcgacgccgagttcgtcaacatcgacaggaagaagttgttcggcctgatcaatgctgccaacttcctgaacatgccgtgcctgttggagctgacatgccagcgcacggcggacttgatcaaagacatgatgccggagcaggtcagggaggtatttgggatcgagaacgacttcacgccggaggaggaggccgaggtccgtaacgagaacgcctgggcctatgagatgtaggttgccaaattaggcattttgtgcattagtaggtttattcatggtttaggtgattactgctggagctggatacgctcgtgtgcgatgcttaccttgtaacagtttgagctctgtttttattaatttgcttaattatgaagaatcgtttttaagtctgatgaactgcaaacttgcgtactcctccaagagttcaaaatatatcgctccacaaactttgcaacctctcattcgatagtgtccagtgtccaccaccggcataaagctcctggatccatgacgatagtggaatgtgttgcttctacgttgaccattgctgtcggagttacatgtcacaccctgaaaatttaaaattatataaattgttgtttaattggaatttctagaatttattttaaaagtcttgaaaagaagatctaagtttaattaataaattccaacataaaattgggccagataaaatttcattaaatactttgcttaattctataattcctagatttttctgggatttatttgagctaagaaagtatttttaataaatggaattgcatttaagaaataatttaaattgaaaaagttttaaaaagtcttcttttggctttgggccgaaagtcggcccaaaacctctcttttctctcctcggcccagtccggcccagtcagccgccgcgcgcgcgcgcccgctgccgctgacaggtggggcccgtcgtcttcctcgggccgaaaccctagcgcgccgccgccgagccgccgccgctgtttccttccaattcggccgcccctttccttctccggctgaattgttagaggggaaatgatctccgggatctcctctaccctttctcctttggaatctttggctaaatcgttttggaaagcgttggattcgagttcgtctcggattcgttcttcccgatctttccttcctcgtcgccggtcgccgtgggcctccgccgtcgcctccgagcccctttaaaagcctccccggtgtctcctctacccgtcgccgccttcgccttcgcctctcgtcgtcgggaaagccctagcgccgtgtgccctagctttgccgtgcgccgccgccgttccagccgtgcgccgccgccgtttcagccgtcgccgtcgctcgggaaggccgccgtcgtgttcgccgtcgcgtcgccgtcctcgtccgccccttcgttgccgccgaagaccgccggagcgtcatcgccgccgtcgacccgaaggttcccgccgcttcctccttgtcgccgtcgccgtccgttggtcttccgccgccgttttggtcgccggtgagttcgccgtgccgcccgcttcgtcttggtgccctccgtttgcgtcctagcgccgccgttcgccggcgagcgtgcgccgcccgggccgttcaagccgccgagccgccgccgccgtcggtgacgtcattgccgacgtcatcgggaccgttcgtcgtgagccgccgtggacccgatcgatctcggccgtccatcttggattggtttgatctcggccgtccgttcgcgtgaaccgccgcccgtgcgcccggtccaccaaaccctagcccgctgacgcaataaatccccttttccttttcaaaaataattcattattgcgtcataattcaattttaaccgatttaagtgttttaatccgatttaatctttaaaaattcataactaattcatcttagctccgatttatttggttcaagtctctaaatttttctaaaattgagatctacacattaaaaatatccatatgtactgttcatgcttgtttatgtgctgttttggtgattttgctcttttctgcttagattccgtcgtttccggagagtccgttttcgccggagaagagtttgaagaattccaaggccagcaaggcaagtcacacagatcccaaacaaccctttgagcatgttgaacccgtttaaagctattgttttgttttcaacttatgcattgttttcgaatgtcattgggtggtgaacctttcccatttaattatggccgaagatgactttattttcctatgggttataatttgactagcatggaccttatatattggattggttcagctagatgttgtttatagttgcttagccatgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaatcacaagccagcatgggcaacggctttatcttttgtatagcatagttcattgcggagcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacccttctcaccatagtaaatgatgctataattggtaataatttgattagctcctggtttggaatggtatattcctggtttggagatagaactgtacagccggtatggttgttcagaatggttgggcctatacaacagggtatgttgtatagtgttggattaatattgcttaattacctaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtttgcgccgtttatttattttccgctgcttagatctttattgattgagaggaactatcttcctctgtaatgacattttattcgcttattaattagagtaatagttgtactctattatcaatttgttattgtgtgcctcggctgattcctggacgagggttcacacacatgtaagcgtttggaattttggatagaaattccgggcgtgacattacactggtggagaaaccatctttcatcggtcgggctaatttcacaatagtcctggttgcaacaaaaaccgggaccaaagatgatcttttgtcccggttaaaaagggtaacgggtatatttgatctttagtcccggttcaaatgctgtcagggcctgtcaggccccccccccccccgggatcttcagtcccggttaataacaccaaccgggactaaagatcgtaactttagtcccggttggtgttaccaaccgggaataaagaccccggcgatctttagcccggttcataacaccaacttggactaaagtcccacccctatatatatgtcttcttcctcctccagcccgagcaagcttcaaattttcttaaaaaagaggggaggtcatgccaaaatttctagtgaatttattgtgttgattatatacaaatcggaggtgcctaaaaggttagcaacttcatcctccaatgtttttttttcatattacatttggagctaagttttgcacacttttttgtctccaaaattttgttgttagttgatgagagagaaaatttgtgtggagaagaaagaatatatagaaatttagtttatttggtaaagagggctgcaggaat

SEQ ID NO: 43090 - DNA, 838 bp, Oryza sativa
taaagatcttaaagtagtgtttggaaagaggcctggcagccagcctatagagagcgaagatggtcacgcggcgatgtagaaaaagaactctatattttgggagttaccctattgggaattcttgtatgtccgccacgcaatcgacgtgatgcacctcactaagaatctttgcataaaccttcttggcttcctaggtgtatatggaaagtcgaaagatacactagaagcatgtaatgatctgaagcatatggaacaacgcggtgaccttcacccggaacctaaggagaaaggaagccattacttgagtccagccagctacactcttagcaaggcagagaaggaaagtatgtttgaatgcttggagagcatcaaggtaccgtctggatgctccacgaatataaagcgaataaccggaatgctccacgagtaaagagatatctttactcccggttgttctcaccaaccgggactaaaaatccgggggtatgtatattccggttgcgccctcgtcttctccaccaacacttagccgtttttcgatctcggcttctccttcgccgccaccgtgcctagggcaatctcgcgctgacaccgccgtcgtctctcgccgtcgatcggtggtcctcgtcgcctccgctgcagacgccgccgccgcacttcttggtgagagccgccgcagcctctctctctctctcgatctctgatctcgatctcgatctctctctctccacggccgacgatcgacgcggccgccgccgccgccgacgacgtcgccactaccacgaacgccgccccccctcgagctcgccacgccgccgcgccactgcgccactccgat

SEQ ID NO: 43091 - DNA, 14764 bp, Oryza sativa
ccgggccggcccacggcgccccgacgctgccgccactgcacgccactgtcgcgcgcgcccgatacgtggacgacctttgaacgaacgcgaacgaacatgcacgaaacgcgaacgaacatgcacgaaatgcaaacgagcatgaatgatatgattacgaaacattaacaaacgcggacgaacgtaatgaaacgttaacgaacgcgaacgaacgtgaacgatacgatcacgaaacgcgaacgaatgtgcacgaaacgcttacaaacgtgaatgcacttgtactaaaagtgttagaacgaacgtgtttctacttatacgatttactggtaatacatatatgattatatatgtaacttggcccgtttagactaatacatttcctggtaatgttgcagagaagacgtcggcgtcgtccctcaagccgaagtggtagctagccatcgaaggaatttgcgcaggcaagtgatgtaattaaataagtgattgttagagatttaatataagattgttagacttagcatatataaatgattattacaattttaatatgagattagtagccatttaatataagattattagacttagcatatatatatatatatatatatatatatatatatatatatatatatatgactattacaattctaatataagattattagacttagcatatatatatatatgactattacaattgtaatataagattattagagattaaatataagattgttggagatttaatatacgattgttagacttagcatatataaatgattattacaattttaatatgagattagtagccatttaatataagattataagagatttaatataagattagcagagtttcaatattacggttagcaaatacatcctatatacctaacaaatattttttgtatgcatagatggctgatcgcgatgaggaacagatactatacgatacaatcgcaaagggaagcagccagtagtggaacgaagaagaggggaacgaggatccaaaccagtacttgaacgaggaggggaacgtggagagggatgcggaggggaacgaggaggggaacgatgcggaggaggctagtggaagtcagccctctgctggacagaagagggcacgcggacaacgaggtgccgcgaagaagatagagggtcggcacatcataaccgaggtggacgaagacggccgacctagtgcaccggcagaagcagccaagaattttgtacgccacagcggttggcttgtaagggacaacgtacctgtcagcacggtatactggcgcagaacaagggcacgcggggatgatgacagctttgtcccggactcagagaaagagatgttgtggaccacaatgcttgagacattcacgctacccgtgggtacagaaaacttagtgaaacagtggactctgaagaaaatggcagaacagttccagagcttcaagggagatctctacaagaaatacatcctgaagggactaacaccgaacttcgacgtattcccaaagctaagggatcattgggacgagttcgttgcttacaagacagggcaacaagggcaagcaatgatggccagaaacaaagaaaatgccgccaagaagaagtgctatcaccacttggggtcaggcggatatagcgtcgcgaagccgaagtgggaggagatggaggctagcttgcttgagaggggtatcgaaccggccaccgctaattggccggatcgatcgaagttctggtacaatgctcacagtggaacgcttaacccagttgatggctcccttgtcttcagcgattagatacgcgaggctgccagtcgactatcggacgcagtggtagcctcttctcagggcacattatgacccgacagagagaaggatgagctgtcactcgccctacagactcccgagcatccaggacgaacacgagggaaaggcgtgattccctggaagattggatttaaggaggacatccacacgtacaggagtcagatgaggagcaagagagataccgaggcgaagattgcaaatcttgagtacagggtatcgagctacgagctcagcatgcaagaggaggtgacaagcaaggtggatgaacgtatggccgcacatcggtcccaggatccccagccgtacattcatcctgcaatggtcagcccatcaggcaatcgtagcagctgcgcctcaacggggcaggtcggatcacagagcatggacgccatgcaaacccaggacgaaacctcctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacatgaaggtggggtcaggaatggccatcccaacggacccttccgggacttaccactgcaggccgattccagtaggatactcgagggtcgaagttgagctggtggaagccgcgtacgaggacctcgagttggactacccaggaggggacggtgagacgcatctacgagacacaagccacgccatcatactatggcgcaagtggtacatcattcttcctgggcgacaagcggcatttcgtgcaccatctcctccggctccgccatctcctcctgcaccatctcctccggctcctccgccacctcctgctgcaccatctccttcggctcctccgccacctcctgctgcaccatctcctccggctcctccgcctcctccgcctccaccgtgtctgcctacacctcccaagacaaggtctcgccaagctccaccgcctgcccgcacaagggcaacgaagaaggcgaaagttgacgccaccaaaaacaaggagccaccatacgattgcagtcaagaagagctcgatgcttatgtggcaggagaggtgaagaggcaactcaagcctcggagtcctgaaaagaagatgcctattgacccgagcgtgaagaacttcttcaagggaatgtccaaaacaaacaaggaggcattacagatatcggactatgaccgaacacttcagagagcctatcacaataagtccaaaccagtccctcagcttggagaacaaccaaaccaagaggtcgagccgttggtgaccggcgaagattttggcataacggatttcattgcagacaccggtctatctgtggatcagttggttggagccgcaccaatcccgaaggcggaagtggcatacaagtttgaactcggtaaaccgcttgtcaaacctgaacaactggagtccctaccgatacagatgtacaaattccatgaacggtacatggaaatgagcgccaacggtagagagatgttcggggcgaggatcagaaaccccgacttcttgcaaggagacgatgttctctggatccatttcaaggatctcttcgatctgtaccagttggacgccctcaacgtctctctcctgagcgcatggattttgtgagtatctttgagttcgatttgtttcgttcaataattagctcctggcatatatgtaagcaataatactttcctttcatcgttgcagaatggagattcaaagggcccgacggcggagggtctacgatactgggttcatcgaccctcagaaaatcaactccgaaatgatcgacaagtacgagaaagacacagaggacaatctcgtccatctcctaacgcagcagcatttcaagacgtacatactactgccgtacaacacagagtgagtttttattgtcattgtcaaaaatttcattcccatacatatagcatgtacattttcgattatatatatctcatctcacgcatattccagattccactgggtcctgttattcttcgacttggatgcatgcagagtcactgtgtatgactcaatgaataaagaggagaagatttttgacaaggtcttcaaaccgatagacaggtaatataatgccatctattccaaagtcgcggggaatctattgctattatgttgatctcaggtaataattaattaatcattgcttgcaactgcatatgtagggcttgtgatcggttccgtcaattggtccgcggaacttggaaagaaaaacttggacggaggtttcattttccagtgagtacatgcatgatccaaaattatattgaattgaatctctaattacagttaatataaagagtatattaaatctctcttcgtttctcgtgtagtgtgcaaagcaggaacagggaactaacttatgcggctactacgtatgcgagtatgcccactgcctatcaaaccaaatatgcacaacacgagagctcgatgtacgtatacataaaccattcaaaagttcattgcgtatcgatttgttaagttgtttattaatttcatatattgatacgtcattatttttggaatgatagcgtattcacatgagggataatctcccacacaaggattttatcacggctgttcaagaacaactgatgagattcatcaacgaagaagtccttaatcccgacaatgaattctactacgacggatcaacaattcataacgtcggtccttcctcttctgacataacgccggcgtcgaagtcgaagtcgtagctatagctaccgagcaaatgaattgtactatatatgcatgtatatatatatttatatatgtacacatttgcttttgtgttaatatatattttggtaacatatatatatatagcacataaaatgttaagtagctttaattaaacatatgtgtgtgtatatataatatatgtatgtatatatgtattgtaacatatgtatgtatgtatgtatgtatgtatatatatatatatatatatatatatatatatatatatatatatatatatatatatatatatatatataatcaaccatgcagcaaacagggccatgcaaaaaaaaaggtcagctcgatctttagtcccggttggcgttaccaaccaaaactaaagatcgatctttagtcctggttatttcacccgggactaaagatagctatctttagtcccggattcgtagtcccagttggacaactgggactaaatggggcttaccaaccgggactacaaacggtttctccatcagtgttacctagcagaattcctaattcgcgcatgcgtgccgtgggcgcgcacttccgacccacacggcccatgtgtacgctcggcaccgcagacgctgcgctagtttctttcttttttttctcctttttttggggaactcgggtgctagttttcgttttttttttcagaaatcgccccctttttctctccacacacacgcgtgattttttttttgtgatattttataaattgaatctttcaccttcaatattagttgagagttttgaatttaaattgaaagtttcgtaaattaaaattgaatgttttgaattttgagatgaaagttttcaaatttgaatcgaatattttgaatttcgaggtgagagtttttaaatttgagttaaaagttttcaaacgtaagataagttttaatatcttgacttgaatttttttaattttgggttgaaagttttcgaatccaagttaaaagttttcaggtctgaattgaaagttttcaaatccaaattgaatgtttgtaaatatgaattgaaagttttcaaatcctagttgaaagttttcgtgtttgatatgaatgtttttaaatctgagttgaaagtaccgagttgaatgttttcaaatctaagttaaaaatttcaaaaaatctttatttgaatgatccaaatcttgacttaaatgttttcaaaccttcgttgaaagtttgttgtagttaattctccatacttatcccaattttctgcgtactaaaaaatacaaataaaggtaattaacgttaatatgggtaattagcgtgatccgatccgctaatcacgcgggggcgtgggggtgggggtgggggcgtgtgcggctgcgcgagttaagcagccgccacgcacacggccattaggaacccccgttacctagtgatatataggggttacaagaaccagatcgatcgatgcacatttccggtattttactacccccaccattttattttataaaaacgttttggactctctttctctcgtctagattcactaacatctatataaacttggccacatatatgaaacatatgcatcaactaatgtatgaatatattcaaaatcaaaacccaaaatgtcttataatgtaaaagccaaagaaaaatcatcttaacatatttttctggaaaaataatctgttaatatacaactatctttctagttaacaccactgcatagatcaattaactatatgtggtggcctggcattaactttcttatttaaggtacaaattaatgaacgtgctggaaatttgtgtcacttttgctcatgttacagcatattatatagtcaattgaacagcgatacctgagaatttattttgtatcttccaattcgctatcttacatgaagtggtgatcaatggagtaaagttaattttcagtagtcatggttagttgaaggttgggtcagtaacaatattgtctgaaatagcgttttttagcattgtgttgccgctcacgtcatccgtttctggaatctgaaatctttacttgattaatggtttttcatcacaaatccatgaaagttgtaatctgaagtcttgaggcagaaaggtagagctttgtattgttctattctcgaacaccgctagtttgctttactaccgacaactacatagagttaatacatttatgtagttgtgttaactaaatgagtatatgttttcgttgatctcggctaaaagaatcacatagcttaattaactggttagattattgaaacctgctcacccatgtttacgactaagtactattttttcaatggtaggtgatgtacccgtcgattgcgaagcgtccgtactgatttcatatataagaagggaaggggcaccatgcaagaatgacgagctctcttgcacggtaagccaccttccatgtttatcatcaggacccattcatgatcaaccatgtgatttcataaggttgtgtgttaccgctacatcaacctatggatcgatcaccggcgacgctttagacatcaaacctagtgatgaccagtccacaactacaccgacaactctaccctacggggaggattcatctactacagggctattggcttcacaaaattagatgatcatgcgtgtttaggctaacatttcagattataagttttgaaacatacactatgtacataaatataaagttacatcgtaagtttgtaactatctagttgcagtttaagtatgatatatttacatttcaatgttttttacctcaaagaatttgtaacaattttttagttactcccatctgttttggttgatgaggtcttagaaatttttggtgatctctaatcttgttgtagctctcgtgatctagtaggagacacatgcacctactcggagtcttgattaatcttcatattaggtatatgtagggtaactagcaaaatgcctgtgcgttgcaccgtgtaatggtgggtgactgaagtttgatttcaattatttattgaagcaccccaagcatgatcataagcatcgatgatgtgtataatgaccaaaaagtcaagtttgttctcgaacaattaatttgctttacattttacaggatatggatgatgctcatgacacgaggtcgatggttgtagcatatggaggaacaaatgggtgcacaatgcaattgcttttgtactggagacgattgatggaaatctgtgtgatgaacgaaaaaatcgatattttcttaaagtaggtaagtgtaaaaaaaataagaggaattgagcggacgacacatccgaatcgcagcatataaaaattgtattttctatactcatgcattgctacatgatgaaagtgcctgagattgaactgatcgacacatctaaatcgtggcacatcgaaattatattttcttatattctatgcatggtggtcgtcattgattggtcaaatctaattataagccatgacgactcattagcaaccaaaatatatttcacggataaaacttttatatacatgtaaaagccaatgctgaacaacaaactacattaagaaaacttcaaaattatgttttagaaataaattaaaattcaaaattataaacgggcaaatacgattttttttcatttatattcctagcaatatatatgtgtagtagctagcttcattaattcaatattattttattttgatggtgccaaggcatgataaaacaatagcaattctggtaaaagagattgaacagtaaaaaatattctattatgtagctttcaagatttccatgcatccagccatccagtaacactaatatctatttagtcatagcaccatatgtcacagacggacatatccaactttatctctttctcttctcccttatctattcttcgctctcctagagccatgcaacacttctcccctcatctctttctcctctctcccacagcctctctctcctacatccacacacgagcagcacagtgtgagcaacagcaatggcgctggtggccccgactagcgagcagagacatcggcctcgtcgagcagcgggagaagcgacagcctccgcaccggcgacaagcagtggcctctgcctcgtcaagcggcgggagaggcaacggcgtcggcataggtggcgacgatcccgctgtgcagctgccttggcctcgggcaagcaacggcggcatgtcttcaacatgccgtggattttgttgacttaggcatcaatctggcatgttctgggtattgatttagacatcaatatatgatttggacagagtatgctcgaattgagcttcttccgattttgtgaaacagatcgaggcataggagaagttggcggtgcagttatgtcgacgtttggctgggttttggatgtgagtcatttttttttcactcaaacgccccgtggctgaaaaaaccggcacctatagcagtatataagtgccggtttataaaaaaaggcttatattatataatagatgatgtcggcgaatgatcaatcgtgtgcccagtggttaatgatgtgatctaacagatgtagcatgtgccggttttgttaataagaaaaggtgataaagtgttgaaaaaaatacagcaggaaatttttcacaaaaaaaaggttaggaaagggaagggaaaagaacagtctctaaccatagagattgtgggaaacgaaccaacgacctatcggtcaaatgtttcataggctaaccaattgagaatcatgaacattgtgctatgcggtgtagctacattttaaaaatatgaatattcagctgagcgttgctatgtccacccctgtatccgatgcatgttggagtgcacggcaaagaaaaatatcagtgtggacccggactcagtccccgtgtgcgggcggccgcctcctgctgcgcgccgcccgccgcagtccgcccgccggccgcgcgccactcgcgccgtccccgatgtcgcccgccgcctgccgccgtccgtccgccaaccgcgcgccgtccccgatgccgcccgccgtcaacctcgccgccaaccgcgcgccgaccgcgcaccaacccgccgcacgccgcccaccacgtgctgctcgccgtgcgccggccgccgtcgaccccaccgcccgacgtgcgccggccgccgtcgacctcgccaccaaccgcgcgccggccgccgtcgagctcgtcggagtggagagtgagggtgacggcctgatgggagggagagaggggtgagagatgagttaggggtagttgagtggcatttttgtgtaaatatgtaaaaaatttaaagggtagtgggtcttttggtttggagtggagttgtggagcagcaaaaacccagctccacccccgtagtacaaatttgtggagtagctctgccaactccgctcccaaaaatagaggatctggactgtttgacatagctcctgctccaggtaagttggagttaggagctggagctgtgccaaacggggccttagtataggcaagtcacaacgtgacataccatgcatcaaagccgtccaaaatggatcgaacgggagatggcgtttgggcccgcctgcaggtcgaaatatcgccgctcgccacccatccagccgtcccgcgtctggccgtcgccgggagcgcgagccaactgagaggctcgccgccgccgcgcctgcgccaggccgctgtggtcgccgcgagtgaggaggggaccggctgccgccgcgcgaggccaactccctgccctgccctgccgtgacctgtggagaggcgccaggccaggccggcgcgaccggggacacgtggaggcggccggccgccgggcctcacggcgcggtggtgcaggcggacggtcgcccaacccgagcccgtcgcgtggaggagaggacgtcatggaggaggccgtgctgctccatgcttgctgctccatccatgctgctccatctagctatattgttccacgcttgctgatgctagatgagcaattgtttttagttatgttttcaacttgtcccaattgtttctgaaaagcattgttcagattcagcatgttaccaagttttcctgtagttctacatttccattgttctacactaatctccagacattgctctgcttacagtatctgtttgttctgcatgtcagttttttagaagattatctttatttggtcagatatgtagccggagtgcccaatgttatgatatcatcaataaacacctgttttgtgcagtcataaaaaacatcataaatctctgttcagcatatcagaactgctgaatcatgtttcaccattttttttatgacaaaaatcaagattacataatcaatttgcccaaactcacaatgccaaacaataacaattcacttccaattaggagtctgcatcatcccaggcagcagggcaggactagggcattttccacaatacagaaccacagagcaggggcagggcatttcacaatacagaaccacacaacctcgggggcatttccacaaacacctcgcgggcacaggaaacagtgcagcgttctccattgtacgaagccatgcggcggtgtcccccctcgctggcgacgaagtgggcggccaaccggtgcgggctctgacgctgaactccatcaacgagtcgaggccaccgaaattggaggtgcggcgtgggcggagtgtattcccgacggccggcaagagcaccgcggcctcctccacgcgccgggtgcctccccactcgcggtggcgcgcctcccagccggacgaggccgaccggcgaggcgaagcgcggctgcgcgggcgggtcgcggcggcaacgctggttcctccccattcgcggcggcgcgcctcccagccggacgagggcgaccggcgaggcgaagcgcagctgcgcgggcggacgcggttctggagcgaggccgtctcaggctgcggggcctcctattaaatggcaattgttttgcctgcgtgcgggcccaactagagcagccgttcgattcgttttggacggctttgatgcatggtatgtcacgttgtgacttgcctacactaaagctgagtccgtgtggaccccacctcctctcgaactttatctccttctgtagaatcctccgcctccgcttctctctctcgtcgctctctccgtctttaccgtctctccttcgccactccccagcggcggcgcgccttctccctctcccagcgacggcagcgcgccatccactcccttcctcccagatccgactggatgaggggagggcagcggcgtggaggcggcgctcccctccccttactttctccccgctcctggatcaggctgtaggaggggagcgatggtgggggcagccaccgcatgcgacggaggtggcgctcctccctccctagctcccagatccggctggaggagggagcgatagtggcaaaggcggcgctccctcccctccctcccagatctggccgaagggggagggcagcatcggctctagcgacggtggcgcgccttctccactctccgactcctcggcgagcagcaggtgcgacgatcttaccatggatgagcagcgggagcggcggtggcctcggcctcaactagcaacaggagtgacaccgtccagtggcattggggcagcgggagcgacgtcctctaccttgacaagcagcgggagcggcagcatccacgtccttagctagcaacaggagtgacgctgtccagtggcgtcggagcagcgggaacagtatcgtcttcgtcctcgacgagcaaggaggagcgggagcggcgatagactcggcctcaggcccagcggcagtggcggtgtccccgacgagcagtggcctcgacatctggcgagctcagcattctgttagtatttaatttgttgtgatttcattgatgtagacattgttctttgattagtcttttttgctcgtcaacttttttttctggaaccgagttggacccaatgaactatatggactaacaaaaatttgtttggaagcatacctagggcgatttttgatttttgatttttggatttgtttttgtctgttctttttctgatattttctgatctgattgtcatggagacggataacgcgtacgcgggctcacatattacggacgaaaatcgtgtgtgaatgatgtgacgaaaggaaaaatacgaatagttatataagattaaaataagataagatataccgaaagaaaacaaactaattaattaatctctccaaaaataactcctacaggggtacgattaaactgagtaggagtagctaattaagctgtgttggcgttatggcaaagtaacgcagaagcaatcgaaaactaattagaatcagattggatttggagtacgaatcggagttgctcggcctggttctcgcaataaatacaaagagcaccaaacagctcgccaagcaccaataaacgtcgtttcaacagttgagctcaccgcgcaactagcgagcgagttcgtcccgtccgtccgtgttcaagctcaacagcaatcccccggccccgcgtgttcgacgagaaacaaaccaacatcaatggcggcagcaaacgacggagccgacgccggcgacagcaagatccttctgatcagctcggacgggcagcacttccaggtgacggaggcggaggcgagcatgtcgaagctagtgagcaacatgatcgaggacgactgcacggagaacggcgtccctctccccaacgtcgcctccaacgtcctcgccaaggtgctcgactactgcaagaaacacgccgccgccgccgccgccgctgccgaggacgtcgccgtgaaggatcaggagctgaagagcttcgatgccagcttcatcgatgtcgacaacacgatgctgttcggcctgatcttggccgccaactacttgaacgtaccgtctctacttgatcttgcgtgtcaacacacggctgacttgatcaagggcaagacggtacaggagatcagggacacgttcgggatcgtcaacgacttcacaccagaggaggaggaggagatccgcaaggagaacgaatgggccttcgagaactgaaccatttccttttatcttagaagaatttccaggctagtagggaagaagtttgatcggaataaatataaaatctttttcttaatactatttaatgattgacaagatatttagtcatttgttatgtgttgtttactattccctctgttttatattatactatcttcgtttttaaaatacatatcacctctgtcccctaatataacggatattcactattttcttgtaacgtttgaccactcgtcttattcaaaaaatttgtgcaaatataaaaaaagaaaagttatacttaaagtactttggataataaagtaagcgaaaattcttaggatcggtcgaccaggggagggggaaaatcggtcgcttccccttgccccacgcgcgcacccccactaggcccactgtcacatccttattttcgtcttaggatttataaattatttaataaattattattataatttatattaaatgttcattaatttacaagtgaagttaaatgtgggaaataaaatttcctaaatacaaagcatggctggatttaagttttattaaattctccatggttaattatactctctggaattttctcggatttttcggaactcaattcctaattttaataatacaaagaacatttcagtaattaatcacatattaaattaatcattaagtggtcttattatatttttttaaatatttatagtgttaaagtactttcaggatttttcttgaaattattagagcattggaagtatttttaacaattcaaagatcattttagtgattaatttaattggaaaagtaaattaaatccccttttccttttcgggctgaaactggaaaaagtctatctgtcatcctcggcctattcttcctctttgcctgcttcccgtccccaggacctcctctttcgtttccaacccctagctcgatctctgtaacgccccgattttcgttcgggattaaaaatcatttaatgatgcatttcctagaaattgaataaaaagttaagcaatttaatcaagtgaaataataggagaattaaaattttcccttaaaaatcattggccgggaatattttgtaatattctttgtgccctaatgtactctccggaattttccgtgaattttcggagctcgagaaatagttttaaagtcacg

SEQ ID NO: 43092 - DNA, 5926 bp, Oryza sativa
tgtccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgctgacgtcagcgaggaccttttcctttgtaaaaataaatagtaattgcgcaataaatcgagtttaattctagaaattcattcaaatggctcaaaacttctaaaattcatatctaattcattcgaactccgaattgagccattcaacttgcaaaattcatctaaaattgagctctacatgtttgtttactttttatgtactgtttgcttggtctttattagagtttttcctcgttttgcgtgccagcgtgtagtttctgtcgtttcggaagtccacggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatctgggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcatgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttctggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaggttgactgtaggttgagccaaatggtcaaaccctaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttctcggagatggcctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagttagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcatttttttcaaggacaacagttcaaaggttctcagtcaggtaaaagtaagactacccactgtaaggggggtaggtctcagagatgagttttggtttacctcgtcggcatttcacttgaatgttcaacccagtgcagcaatttgggtagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtgaattctcaggttaccaaaattgctaacctcaacagttcagtccaaactaagtaagtttcaggagcatccgcagtcctagactgggtcagttcaagcagaaccagtcggtccagttttggcaaagcaaaggaacagaaaggtcgaatccagccagttcaatcgtgcaggtttgatcaaccagtcaatcaatcagttcgaagcagaatgtggcagttcaaggtgtagatcagtcagaccgcccatcagcaccggctttctttctagccatcccagaatctcgggacgagattcctgtaaggggggtagatttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcattgcatcaattaaaataaaaagaaaacaaataaaatttcccccttcctctctttgggccattttcggcccaagtcttctttcctctcccgcggcccgcgcgcctcctccctctctcgggccggctcccttcttccttggcccgctcgcaaaagtctgttttgcgtccctccttctctcccttcgccgacaggtgggaccggcggtcccacccgtcagctcctcctcctacctctcgccggccgaccccaaccgccatagccgtccacgtcgccgcaaaatccggcgccctcccgcacccgagctcgcatccaacgacgtgggcacgatcccctccacgtcctccaccatttcccccactctccccgcgaaaatcggcaccggttaacccctccaccaccccacgtcggcgccccacttcgccggccgattccgccacgtccggcctcgatcccgccttcccgagcccataaagagcatccccgtgctcccctcgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgaccgccgcctcttggggtgcgtcgccgtccccgtgcgcgccgctgtcctccggccacccgccgccgttccacgtcgccggctgctgcagccggttgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgctgacgtcagcgaggaccttttcctttgtaaaaataaatagtaattgcgcaataaatcgagtttaattctagaaattcattcaaatggctcaaaacttctaaaattcatatctaattcattcgaactccgaattgagccattcaacttgcaaaattcatctaaaattgagctctacatgttcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatctgggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtaacttttc

SEQ ID NO: 43093 - DNA, 3577 bp, Oryza sativa
tttcagaagtgtagtgcttctgagctgaagacgaagttagaggaccaaggctcagaccccaattgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaatctcccgtgccttagccgtctctccccgcagccgccttctctctccgccgctggtagccgctccagccgtccctagcatccgctgtagtcgtcgcctccagtcgccatcgtcaccaccgggttcgcaaggaggagaagaagcccggccactggttcattttctccgtaacccactggaagtccctcgtcgacgtgaatccgatctactccaccttcgaccgagcctcgccgtcgacttcgtggttgctggacattgtcgtcgccttcttcggcatcgcagcgccaaagtaaagcccgtccgctggttttcctccgctaaagatcgccgaaataccgctgtcatcgtcgaccagtacctcgccgcccttcggagctcgtcgccggtcgtctcccgtcgtcgttcgtcgtcgtgccgcccctcagtgagttcccctcgtcgtgctctttcttctggtgccttcggtttgcgccgtcgtgccctaggtcaccggcaatcgttggaacccaagcctcccgccggtgatgacgtcatcgatgatgtcataaagcccttttcttttctaaaataaatcgtgaatccttttctgtataaggctaaaatcagtttaatcttgtaaaattcataactaattcatatgaactcggaatgaggccgttcaaatctctaaattcatctaaaatcatgatctacatgtttgtttacttttatgtactcttttatttggtttttattagtctttttctttgttttgcgtgttagcttgtcgtttctgtcgttgcgaaggttcgtgagtgcgtcggaagtgttcaagaagactaattgaataccgattattgcaaggcaagtcacacagatcccaaacactatccgttgagcatgttgatcatatatttaaattctctatttatttcaactgtgcatttatattcgaatgtcaccgggtggtgtgaacctattcctttgttatagccaatttgcattgaataccctattccttgatacctcggctaataattgattagcttgaaccttgtatattggtttggttcacctaaatgctatatatatataattgcttagccatacttagaaacattagctcattaatgggatgaatcatactatgttattatttatggttatatttaacggtagctcatgatggttaatcgtgttatgataattaattcataattaaaacttgacaatggtgggttgtgagcacatggttttgaaggttgtgctcatgacaattaaggactagttcacgagctactgttgtgagacattaaccgtaccaaccacaagccaacgtgggcaacggctttaccttttctatagcatggttcattacggggtgccaaactgagaagcggcgagaagtccgtggggtcgctagggagtccatgcctctggttattgagggggtgattatgatctaggaacggtgcagtgtggtgagttgtgttgtgtagagggtgttgtcatagcctctattcgggtactttgcagtatcgcgacacatggtagacatgatgttgaggctatcttgtgggtacagtgatacaactctggccagagtaaaactattcgaatagacgtccccgcggtcatgggtgagttgagcaatgtttttcgtgattagtctcatacctctcacaataattattgattctataactggtaataatttgcttagctcctggtttggagttagatctgtatagccggctatggttgttcaggatggttgggcctaagcagcatgggtgtgctgttcagtgattgattaatattgatgattaattactttattgttttactactcccaaatgttagctaaatgctgcttttgcaaataaacttatattatgccatcctttggtatctttgtgcacttgcatatttgctgtgtggcttgcggagtatttcatgtactcaccttgcaataattaatcaacctcagttgaagaaaaatgatccagaaggagaagacatttggtttataccctaattgatctgcctgtggaagtggagctgaagccatcgctagaccgttaattccgctgttgtttttcttttcttttgtaagttgtaacgatgttattatgatggatttgtatatttaattgtcagtttgtgtacctcggctgattcctggacgaggattttatgcacaaataagttcggaggcgtgacacccacacacctgtccctccccttgttccgtaaaaaatgtttcacctagttacttacaatgtttcactatgtatagatctaatattgcagtggattaaaatattcttttacaacagatcacccacatatttttgaaaccctctattaagggaattcgtttcattttttgttgcacaaaaaatgtttcacctaatgtactcacaatgtttcactatgtatagatctaatgttacagtgaacgggacattcttttgcaacaaatcacccatatattttggaaaccctctattaagggaattcggggaattcgtttcattttttgttccaccataaatgtttcacctagtctactcagaatgtttcactatatatagatttaatgttgcagcgaaatgaaattttttttcgctatttgctgaaacattgtttcattgtttttatataaggtgaaacaacacccgatttaaacgattgaaatattttcgatctacttagtgaaaattccgatatacttggtgaaacatcgtgcaacatttaaaaataatacaataataagctaattttttttcatcggaatatatgtatgtgtgatcttgttttgaagatttaattgcaagaaagttaatggtgcaatcggatcatgatttggataagtaatttaagagaaaaaatagtttaaagtggttttgcacgtatgagtgacgccgatttgactccctctcgatcgggcgcccgaccaggagtcgtgtcctaaagtaagtcacaaataaaattaataataattctaaaaattttttaataagacgaaaggtcaaacagtgtaaacaaaatatcaaaatctcttatattatgggacggagggagtaacttattagttaccttttcacataaaatttaaccatttattttattcagagtttttttgcaaattaaaagaaattaagtcatgtttaaaaatatttgatgataaatcaagtcacaataaaataaatgataactatgtatatatatgttaaatgataactatctttagtcccggttcaaataaccgggattaaaaatcgatctttagtcccggttgtta

SEQ ID NO: 43094 - DNA, 1149 bp, Oryza sativa
tactaaccgggactaaatatcatagggccctgacacagcctgacatggaatcaaccgggactaaagatgaactttagtcccggttggaaactccaaccgggactaaagatgatttttagtcccggttggtaacaacaaccggggactaaagatcttcctcttattaaccgggactaaaaatcatttttagtcccggtttttaatggaaccgggactattgtggatatgggtcaaccgaccaaagatggtttctctaccagtggaatcataataggaaacggaaggagcggagtacctacttagcacttttatgattcagccatttaggtgcacttaggtggtttatgcattcttaatcactcggtgcattagttgcttgctttgtaatagtgttcgagtcacggttattttatttttattttgctaagtctgggtttagaataaatcaagtctcggtttaagcttcgtcgatcgatttgattgtttgctcttcctggattaggctggtcctttggcatacatcatggagtatcattctgacatgcaagagaaagcaattggattgccaattcataaaagttatctcaccaacaattcgtaaactttatctcagatgggttctcaaataattaatcatttctcaagtaactagctaacggagtctaagtggacttatttcttcaggggatcgatctcctgggcttggcgggaagaaggaagagggaggcgttgacgcgtcgtggactttagaagatatttttcgtgctgggcggtacgatgggtggggcccacggagagggttattggagtgggtcccactgcaggtcccagtcccacacgtaggggtggacgttcggtctgaccgaaaaattcggtctcggttttcggtctttgaaaactcaagaccgaatttcatccaaataaactcaggaccggcaaattcggtctcggttttttttgtctcggtctcggtctaaccgaattcgctggagacttagatggcgcaggtgggcagcgagagctggtggcgactagcgaggccgcggctatggctgcagcaacggcgaaggccacgctgccgctcgccaggcgtaccgcggacggcggcgctcgtcggggccgcggcggaggctggaggcggacggcggc

SEQ ID NO: 43095 - DNA, 1131 bp, Oryza sativa
ccttagaaaaccctctagtacaagaaagaaactttacataatcaatcgtaccatatttggactccttccaaattcgactccgcatcccatacgcacacaataactccatcgtatgccatatggaatctccatcaaccacgtgcatcaactctagcctaagtatcccgcatgatctctgatcaccacggacgtcgtcttatccccaagccgactcccggtccatcaccgcaaatactctcccgagacatcgagtcacctacacatggaacaaacaaaaaaaccatattccgagaccaagctatctccaacttgactcattagtagcaaacaatagtattacatacgtatagtatccatctagaactcataatcatggaataaactcggatatccaaataaacaacccgaaaccgaaaccgacacagtgtcggccggtcagaccgcgggctgcgccggtctgaccgggcattacacgccggtctgaccggctaccaaagcccggtctgaccggtccacattaaatcctgcagattcacctgtgaaatccaatcatcttcaaaaccacttcgtgaataaattccaaataacaaaaccaataatctccaatgcccaattgttcatcacagagtaataatcaaaaacacctttggttttacaatctcccccttgatgaacacattggcaaactcacaaaaatgttttggtatttggtggtaaaaagcacacttcgtacaaatgttcacatcgtgctcaaaaatccaaaaaaaaacttctcccccttttgaaaagaaagaaatacccaattgaacaaaaaaacatgctcttcaactctccaaaaaatcaccttgcttctcaaaaaaaaatccaaaaattttcacattacttctcccccttttgacaatgatttcatcaagcataggaattatattcattaatgttcaagagcttagcatacatatagcatatcaagtcatgtgttgcaataaaaagaagattaatccatctataacagaacaagcatgcattaaagtataaccatgaatcaaagattttacaattaagcttgaatcaacaatcaaaattcatgatttcatacgatttataatgcaacatcttaacaagcacataggt

SEQ ID NO: 43096 - DNA, 907 bp, Oryza sativa
tggattgcactctagccgaaccaacagtgtccatgtgtaacagctgtctcggtgcatccgtcatcacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcagctttaaacactcttgcataacgagaaatattcggcatagaatcaccacgagaatcaaaaactttacttccagttttcttaaaatgaacctcaaacttttcatcaacaatttgtgaaaccgaaagcaaattgtactttaaatcctcaaccaaagcaaatttgtgaatcctcaacaatttgggatggagtcgtctgcgccgtttattttattttccgttgcttagatctttattggttgagaggaactatctacctctgtaatgacattatattcgctttattaattagagtaataattttactctattatcaatttgttattgtgtgcctcggctgattcctggacgagggtttacacacatataagcatttggaattttggatagaaattccgggcgtgacaagttggtatgagagcctccttgaccctaggttatgccaaatggttacccatagaagccctctaaaaatattgaaaaagtagaactgttctcctctctctcttttaattaaaccaagctaatggcacatgcagttatagtccctttaattgttctcattcaaaatttatttattattcctgtcttattagtactatacatctatta

SEQ ID NO: 43097 - DNA, 7456 bp, Oryza sativa
  unsure (1)..(7456): unsure at all n locations
aatctatatacaatgatttaatccgatttaatctttaaaaattcataactaattcatcttagctcgggtttagttgggtcaagctttctaattttttctaaaattgaggatctacatgttaaaaatatccacatggtattgttcatggcttggtttatgtggctgttttgggggattttggctcttttctggcttaggattccggacgttcccgggggaggtccgattttgcaaggagaagactttggaaggagttataagcggctagcaaggncaaggtcatatcaggattctccataacaaccctttgaggcatggttggattcctcgtttaaaggctttattatttctattcaacctattgcgatttcattttctggaatgtctactggggtggggaataacccctattggctttgtatagcccttttgatattgattatctattctttgtcacttggttaataattggattagctagaacattatatggttttagctaaagtgaataggatgcttagccatgcttagagacactagctcatataaaggggatacttatgattcactattatttaatgatggcttaattatagttcacgatggtcaatcgtgattggttaattaattcatgtgccaactaaaacatgataatggtgggttgtgagcgcatggttttgatggtcgtgctcatgacaattaaggaccggttcacgattttcggttgtaaaacattaaccgtgccaaccacaagccagcatgggcaacgactttactttctgtatagtatggttgatagtagagcacgagactgtgaagtggctgagataagcccacgagggtcgttggggagttcatgccttgtttacaagggggtgattatgatccaggagcggtgcactactttgaattgtgttatgtagagggtattgtcacaatctctattcgggtacttgttaagtatcacgacgcatggttgacatgatgttgaggttgtgtcttgtgggtacagtggtacacctctggccagagtaaaactattcgaatagccgtgcccgcggttatgggtgggtctaacaatgtctatcgtgattagtttcacacttctcatcataaaaaaaatgatgctgtacttgttaataacttgtttagctcctggtttggaatggtatattcctggtttggagatagaactttacagccgagattggttgttcagaatggttgggcctatgcaacacgggtgtgttgtatagtgtggatttaatattgcttaattactcaactgttttactattctctcaaatgtttattaaatgttgtttatgcaaatgagcctatgttatgccatcctttgttatccattgcacttgcatatttgctgcgtggcttgctgagtatgtcatatactcaccttgcaatcattcatcggaggaggagttctacagtgatgctgaaggtgtggatgattaggcgtagccctggtcaagctgcttgtgggatggagtcgtctgcgccgtttattttattttccattgcttagatctttattggttgagaggaactatctacctctgtaatgacattatattcgctttattaattagagtaataattttactctattatcaatttgttattgtgtgcctcggctgattcctagacgagggtttacacacatataagcatttggaattttggatagaaattccgggcgtgacaagttggtatgagagcctccttgaccctaggttatgccaaatggttacccatagaagccctctaaaaatattgaaaaagtagaactgttctcctctctctcttttaattaaaccaagctaatggcacatgcagttatagtccctttaattgttctcattcaaaatttatttattattcctgtcttattagtactatacatctattactgtactgatggcccaattacgagcaaaggttttaaaacattgttttaattaatcttgttgcaataaacttagcatgttgatattataactctcttttatttcatttcttttgaaacctgttattcaaaagtccaaaatttgtactcttgttttcaactgtttcatcttatcttgcaaagattggtttactttatttatttaccttttactttgattttctaactttattcaaattaatctaaaaacttgtgctattaattggataaatatcttaactccctcctttcacttgtctttagatgccacgcttcaagcctgagtacttgttcggtactgagggatttgtcctggagttgcgtacgatgtctttcctcataggattcgggactgcccctttgtatgcccagattcctcatgatcgtgatgaagagaagtgtcgggtcaaggtcaccttgaacagtaatcgtgaagatatcccatcagtgatgttcgaggctggagggggaaactgtattcatgcttgtcaggaggtggcaaggattaccataggagagctccgcgaacgctacaatgatcagttggccgacaccgagtatcgctaccatcctcgtcaaccccagggaagtggtcgtggcagctaccttgaacttgcaggaattgagaatgatgctaccacaaggcatttggttgagatgctgtgggccatggatgagacccgcgctgagattgtgttagcagcccaagatcgcgaagaccggaatcgtggtaagatttgcaagctggaggacaaggtggatcgtttggagaaggaattagccgcattgaagggagaagcaccaccgcagaaggccagggttcgtcttaccgcaaggaagagagctctttttgtccctcgctaccagttggcatctaaggttcgtgtggtggaagaagaagaagctgccccagccccagtgaatcttcccgtcattaatgtaagtgatgatgaaggagaagagtcaaagcgcacccattcgaaggttgagtggggagctacccaagatgatgagatcgagccttcaatcaactccgatgcccggaagacctagaacgccttgttaagtctttgccttagatcgttgtgttagtttgcttgtttaagtttggttgtgtgcgtgggtctcgcttgtagtttacatcattggtgggatataaatgcatgcgtttgtttgctttcgagtgttaggaagcttgtgagttagtggtgtaagagctttcagttataatgtaataatgaaactcagttaagagtttttgagggaggagaaccaatttttatcgccggtcatgtgccgcgaacaaccggaatccacgatccacacgttctccttcctttccaccaaggcctacacacaatcagaagtcgaagcctcagtaccggggttagacaataataaaaatttaggaatccagtactgagacacatgaccagaagatccaataggcatatatccacgtgcaaaatcaattttagaattttcagaaaaattcctccgaggccggtctgaccgaggtacagtggccggtctgaccgccactgcaccgcccgtctgaccggtgtcctcgagggaaaaccaaatttttgccactttgattttgcaaaagcaatctctctcttctttttctgtttatgagctaatctgaaacaaaaaccaacaatatgccatctttgccacaaaaagaacaaatatatttttcacgatgattagacacattggtaacattagaagatttagcaacaatagtactaataggaggttttgcatgcacaacattggattttgaagaagattcattcatagtagacatgataccagcagatttaaacacagttttattagcatcaggtttaaccaaaacctcaccacttctagcaccaacacctaacacaacaggaggatatctagaattatgagcataaggattaaaacctaaaccacagttatgtgtactaacctttgattgatccaaaatcgtgttgaggttctttttactatcagaaaatctttgcaaagaatttttcaaataagaaacctctttttccaaactagcacaattttcacaatctaccatgacacatttgctttcacgacatatggggcaagaaagcactttgttgtttttcacaacatcttccatgtactcaacatgacctgaagcatcttttagtttcatcttattcaaattacatgttgagcaatccaaaacatcatgaggttgttttcactttttagcagaaatcatgttaaacatcaaactagcatgaaaagtaatttgatatttttgcaacaactttttagttaaaaacaactcatccaaagtgcgtgtacgcaaggcaaaactacgagcaagagaagatctatttttcaaatcatgtgcagcattaatatctctaatttttgaaatctcattcattaaaacctcacaatttgagcaatcatcatcattaggaataagagattttaatcttgcaacttcagatttaagagattcaatgataaattcctgttttctatacatcttctcacacttctttttttttcactcaaaatattaatagcttcctcaaacgcacttacctcattatgttcaaactctatgtcagattcaccacgtgccatgaagcaaacatcggagatgttcttccccttatcatcatctccactttcaccatctacatcacttagtggctcgaaggcagcccaaacttgttgaaaagccttcctaagattctccatcttcctcccttgggatgtacccttcgacttgttgttgttgggcttgttgttgttcgtcttctcaccatctttgtcttctcttttgcctctcccaagcttaggacaatgcgaacgaagatgatcaattgaaccacattcaaagcaccgatttggaccacatcttttcctgttcctggcattattcatagctcgagcaatacggttagcgaccaaagccaaatcctcctcctcgatttgttcgagttgatcatcggatatggcattaaaagcagcaagaaaagaaggcatagatgaagaagcatcaacatccaaagaagaagtagaagaaaccaaagcagtcgacttagaatcaacttttcgagaaagaacattcatctcatgtgttttcaattttgtgtaaagtgaatccaaagtcaaagtagacatgtcaacagactcctgaatagatgtaactttcatctcccaaatagacatattaagaccattcaaaaagtgacgagaaatctctgattgcggataattagtatcataagaagaatcaataagatcactcaaaattttattaaacctagaaagatagtcatcgaaagcttctccaggtttcatctcaaatttaatgtactcctttttgaaaatatcacgacgaagttgttttatgttatttgttccttcatgaaagttactcaaagcattccaaatctcatgagcagttcgaagatgcgcaacacgatcataatcagaacgagaaataccactcaaaagaatgttgcgagctttgcaattttgttcaaaagcagttttttcagcagcagtattaatagcttcaggaatcacataaggatgagaaacttttctccaaagatcataattctcagccataattgtcacaccctaaaaatcccaaaaatataaattattgtttaattggaattattagaaataattttaaaagcctagaagcaaagatctaattttaaataataaattccaatataaaagtggcccagataaaattttattaaatacttctcttgattctatagttcctagatttttctaggatttatttgagccaaggaagtatttttaataaatggaattgcatttcatgaataatttaaattgaaaaaggtttttaaattcctccttttgactttgggccgaaagtcggcccaaaaccgccctttctctctccccggcccaagtcagcccgtagccgagccgccgctcgcgcgcgctccctcccgctgacaggtggggcccaccagtcggggtcgtcgtcttcctcccaccgcacggccgcgccctagccgccgccgccgcccttccaattcagccgcgcctttccatctccggtcgaattgattgaggggaaacgatcttctcgatctcctctatcttttctcttttggaagcatcgtctattctcctttggaaatcgccgaattcgatctcgaatcggattcgtttttcccctccgaaccctaatctttccttcccgtcgccggccgccgtgggccttcgtcgccgccctctagcccctatttaaggacacccgagacctcctctctccgccgccaccctcgccttagcccgccgccgtctgtagcgccgcctccgcgtgagctcttgcgccgccgtcgccgccgtttgtccagccgtgcaccgccatcgctccggtcgtcgtcatcgctcgggaaggccgccatcgagatcgccaagccatcgccgtcctcgtccacctctccgtttctgccgaggattgccggagcaccgccgtcgtcgtcgtccggttgccgtccgccgccgttcgtgcctcggtaagattcgccgcgtcgcccgcaacccgtaggtgccctccgtttgcgccgccgcgccgtcgttcaccggcgagcgtgcgaggttgagccgccgccagtggtgacgtcaccgctgacgtcatcgacgccgtttcccgtggaccgcgatggattagatcgatctcggccgttcgttttgaatcgattagatctcggccgttcgtttttgtagaccgtcgccgtgcacccggtccaccgtgaacccgcgccgctgacgcaataccttttttcttttcaaaaataattcattattgcgtcataattcaattaaaatctatataaatgatttaatccgatttaatctttaaaaattcataactaattcatcttagctcggttttagttggtttaagtttctaaatttttctaaaattgagatctacatgttaaaaatatccacatgtactgttcatgcttgtttatgtgctgttttggtgattttgctcttttctgcttagattccgacgttctcggagagtccgattttgcaggagaagactttgaagagttccaaggccagcaaggcaagtcacatagatcccaaacaaccctttgagcatgttgatcccgtttaaagctattgtttctattcaactattgcatttatttttgattgtcactgggtgggaataacctattgcctttgtatagcccttttgatattgattatctattctttgtcacttggttaataattggattagctagaacattatatggttttagctaaagtgaataggatgcttagccatgcttagagacactagctcatataaaggggatacttatgattcactattatttaatgatggcttaattatagttcacgatggtcaatcgtgattggttaattaattcatgtgccaactaaaacatgataatggtgggttgt

SEQ ID NO: 43098 - DNA, 10851 bp, Oryza sativa
aagattgcaagctggaggacaaggtggatcgtttggagaaggaattagccgcattgaagggagaagcaccaccgcagaaggccagggttcgtcttaccgcaaggaagagagctctttttgtccctcgctaccagttggcacctaaggttcgtgtggtggaagaagaagaagctaccccagccccagtgaatcttcccgtcattaatataagtgatgatgaaggagaagagtcaaagcgcacccattcgaaggttgagtggggagctacccaagatgatgagatcgagccttcaatcaactccgatgcccggaagacctagaacgccttgttaagtctttgccttagatcgttgtgttagtttgcttgtttaagtttggttgtgtgtgtgggtctcgcttgtagtttacatcattggtgggatataaatgcatgcgtttgtttgctttcgagtgttaggaagcttgtgagttagtggtgtaagagctttcagttataatgtaataatgaaactcagttaagatcaataaaagttaagttagtaaaaaattaattccctgtcctaagtagttttccgctgtttctcttcttgtgctcctgtctatgctagatggtgcttactcgcagcaatgggaatggtcccaacaacaacaacaacaacaacaacaacaacaatggagagaatcccacgcttgcccaagtcctggctcaacaggcacagctcatgaatatgatgatgcaccaactacagaaccagcagaaccagggaaacaatcatgcacctccccagaacaagttagcataatttcttcgtgtgaggccgcctactttttctagcactaccaatccagtcgaggctggtgattggctgcatgccatagaaaagaagttggacctgcttcagtgcacagatcaggaaaaagtctccttcgcttcgcatcagcttcatggccctgcctctgagtggtgggatcatttccgtctcaacagaactactgccgaaccaatcacttggcttgagttcactgctgctttccggaaaactcacataccctcgggagtggtgtctcttaagaagaaggagtttagggcgctcactcagggatctcgctctgtcaccgaatatctgcatgaatttaatcgtctggctcgctatgctccgaaagatgtgtgcactgatgatgggcgtcaagagaagttcctggaaggactgaatgatgagttttcttacccattaatgactggggattatcatgatttccagaagttggtggataaggctatacgccaggaggacaagtacaaccatatggagcagaagaaacgtaggattgctcacttcaaagctctacaggggaatagtcagaggccgcgtcttgctatgggacctcaggcagtgttgcagggagggtcttcgtctgttgttcgtccgcaacgtcagttcttcaacaacaatgctggcaacaacaaccgcaaccaagctccacgtcccgttgcaactccagtccagcatcagcctgccaagagggagcaaggcagcaagcctggggtgtgcttcaactgtggtgaacaaggacattactccgataagtgtccgaagccccgccgcgtgaaggttgtccctgcctagagcaactccaccgcaccagcgacaaaggctcgtgtcaaccatgttgctgctgtagaagcccaaggtgctctagatgtgattttgggtacgttccctgttaactcaattcctgcaacagtacttttcgattctggtgctacgcattcttttttgtctatgagttttgcgggaaatcatgggatgcaggtagaagatcttagacgtcctttgatggttagtactccgagtaagcaagcactcacatcacaacgtagcccctctgtcagaatagagattcaaggagtaccatttctagccaaccttattctgttagaatccaaagatcttgatgtcatcctagggatggactggttagccagatataaaggtgtgatagactgcgccaatagaaaagtaactctcaccagcaatgatggtcaagttgtaactgttcatgcattgccttctgagcctttatggtcaagtctgaaccaaataactttggaagagattcccatagtacgggagtacccggacgtgttcctggatgatttacctggtatgccgcctaaaagagatatagaattcagaatagatctggtaccaggaacaaccaatccataagagaccttatagaatggcagccaatgaattagcagaggacaagaggcaagtagatgatttgcttcagaaaggatacatcagaccaagttcgtctccatggagagctccagtcatctttgtggaaaagaaagatcatacccagaggatgtgtgtggactatcgtgcactaaatgatgtgactatcaagaataagtacccattgcccagaattgatgatttgtttgatcagcttaaaggtgccaccgttttctccaagatcgatcttcgatcaggttatcaccagttgaggatcaaagaggaacatatacctaagacggtttttaccactcggtatgggttgtttgaatgtacagttatgtcttttggacttaccaatgccctcgctttcttcatgaacttgatgaataaggtgtttatagaatacctagacaagttcgtggtagtctttattaatgacattcttatctactcccgaaccaaagaagagcatgaagaatatcttcgccatgcactagagaagctacgagaacatcaactgtatgccaagtttagcaagtgtgaattttggttgtctgaaataaattccttggtcacatcatctcagccggaggagttgccgttgatcctagtaatgtggaatccgtaacgaactggaaacaaccgaagacagtttcagagattcgtagtttcatgggtctcgcaggttattactggaggtttatagagaatttctccaagattgctaagcccatgacacgactgcttcagaaaaatgtgaagtacaagaggtcagaagaatgtgagcagagctttcaagagttgaaaagtcgcttaatatcagcacccattttgattttgcctgatccaaagaagggtttccaagtgtactgcgacgcatctaagcttgggttaggttgtgttctgatgcaagatgggaaggtggttgcctatgcaggttgcctatgcatctcgtcagttacgtccgcatgagaagaactaccctactcttgatcttgagttagccgcagtggttcatgcgttgaagatttggcgtcactatctctttggtactcgtacggaggtgtacacggatcacaagagtttgaagtatatctttacccagccggatctaaacatgaggcagcggagatggttggaattgattaaggattatgacatgggaattcattaccaccccggaaaggccaatgttgtagcagatgctctcagcaggaaaggttattgcaatgctacggaaggacgacagttgccgttggagttatgcaaggaatttgaaaggctgaatttgggaattgtcagtagaggtttcgttgcagctttagaagcaacgcctactctcattgatcaagttagagaagctcaagtcaatgatcctgatattcaagagatcaagaagaatataagaagaggaaaagctatcagtttcttggaagatgagcaaggaactgtatggttgggcgagagaatctatgtcccagagaacaaggagttgaaagatgtaattctgaaagaagctcatgacactttatactctattcaccctggtagtaccaagatgtaccaagatctcaaggagaaattttggtgggcaagtatgaagcatgagatagcagagtatgtagctgtgtgtgatgtttgtcagcgagtcaaggcagaacatcagaaacctacaggtctgctgcaacctttaaaattaccagaatggaagtgggaggaaataggaatggatttcatcactggtctacccagaacgtcatcgggccatgactctattttagtgatagtcgacaggcttaccaaagtggctcatttcatcccagtgtggacaacatattccggaagccgtttggcggaattgtatatggcaaggattgtgtgtttgcatggcgttcctaagaaaatagtatccgatcgaggtaaccagtttacttcaaagttttggaagaagcttcaggaagagatgggttccaagctgaacttcagtaccgcttatcatccgcagacagacggacaaaccgaaagggtaaatcagattttggaagacatgttgagagcttatgctttagacttcggtggaagttgggataagaatctgccttacgcagaattctcgtacaacaacagttatcaagccagtcttcaaatggctccttatgaagcgttgtatggtcggaagtgccgcactccgctattctgggatcagacgggtgaacgtcaggttttcaggactgatattctgagggaagtagaagagaaagtaaagatcattcaaaaaagattgcgtatagctcagtctcgtcataagagctatgctgataatcgccgtagggatctgagttttgaggaaggagatcatgtgtaccttcgtgtcacgcctcttcgaggggttcatcgttttcacaccaaaggaaaattggcaccgtgttttgcgggaccttacatgattgtcagtagaagaggagaggttgcttatcagttggagttacctcaatcattggcaggtgtttataatgtgttccatgtgtcacaattgaaaaagtgtttaagggtacccactgaagaagctaatcttgagcaaatagaaatccaaaaggatctgacatatgttgagaaaccaatccgtatcctggagacagatgagataaggaccaagaatcgggttattcgtttctgcaaggtccaatggagtaatcacacagaggaagaagctacctgggagcgagaagatgaattaaagtcagctcatccgcatcttttcgacagttcttccgaatctcgaggacgagattctgtttaaggggggtaggtgtgtcacaccctaaaaatcccaaaaatataaattgttgtttaattggaattattagaaataattttaaaagcctagaagcaaagatctaattttaaataataaattccaatataaaagtggcccagataaattttaattaaatacacctcttgattctatagttcctagatttttctgagatttattttagccaaggaagtatttttaataaatggaattgcatttcatgaataatttaaattgaaaaaggtttttaaattccaccttttggctttgggccgaaagtcggcccaaaaccgccctttctctctccccggcccaactcagcccgcagccgagccgccgctcgcgcgcgctccctcccgctgacaggtggggcccacctgtcggggtcgtcgtcttcctcccaccgcacggccgcaccctagccgccgccgccgcccttccaattcagccgcgcctttccatctccggtcgaattgattgaggggaaacgatcttctcgatctcctctatcttttctcttttggaagcatcgtctattctcctttggaaatcaccgaattcgatcttgaatcggattcgtttttcccctccgaaccctaatctttccttcccgtcgccggccgccgtgggccttcgtcgccgccctctagcccctatttaaggacccccgggacctcctctctctgccgccaccctcgccttagcccgccgccgtctgtagcgctgcctccgcgtgagctcttgcgccgccgtttgtcctgccgtgcaccgccgtcgctccggtcgtcgtcatcgctcgggaaggccgccgtcgtgatcgccaagccgtcgccgttctcgtccacctctccgtttctgctgaggatcgccggagcaccgccgtcgtcgtcgagccgattatcgccgccacttcatcctcgtcgccgtcgtcgtccggttgccgtccgccgccgttcatgcctcggtaagattcgtcgcgtcgcccgcaacccgtaggtgccctccgtttgcgctgccgcgccgtcgttcgccagcgagcgtgtgaggttgagccgccgccagtggtgacgtcacagctgacgtcatcgacgccgtttcccgtggaccgcgatggattagatcgatctcggccgttcgttttgaatcgattagatctcggccgttcgttttcgtagaccgtcgccgtgcacccggtccaccgtgaacccgcgccgctgacgcaataatccctttttccttttcaaaaataattcattattacgtcataattcaattaaaatctatataaatgatttaatccgatttaatctttaaaaattcataactaattcatcttagctcggttttagttggttcaagtctctaattttttctaaaattgagatctacatgttaaaaatatccacatgtattgttcatgcttgtttatgtgctgttttggtgattttgctcttttctgcttagattccgacgttcccggagagtccgattttgcaagagaagactttgaagagttataaggctagcaaggcaagtcatacagatcccaaacaaccctttgagcatgttgatcccgtttaaagctattatttctattcaactattgcatttatttttgaatgtcactgggtgggaataacctattgcctttgtatagcccttttgatattgattatctattctttgtcacttggttaataattggattagctagaacattatatggttttagctaaagtgaataggatgcttagccatgtttagagacactagctcatataaagggaatacttatgattcactattatttaatgatggcttaattatagttcacgatggtcaatcgtgattggttaattaattaatgtgccaactaaaacttgataatggtgggttgtgagcgcatggttttgatggtcgtgctcatgacaattaaggaccggttcacgattttcggttgtgaaacattaaccgtgccaaccacaagccagcatgggcaacgactttactttctgtatagtatggttcataggagagcaccagactgtgaagtggcggagataagcccacaggggtcgctggggagtccatgccttgtttacaagggggtgattatgatccgggagcagtgcactactttgaattgtgttatgcagagggtattgtcacaatctctattcgggtacttgttaagtatcgcgacgcatggttgacatgatgttgaggttgtgtcttgtgggtacagtggtacacctctggccagagtaaaactatttgaatagccgtgcccgcggttatgggcgggtctaacaatgtctttcattgtctttcgtaattagtttcacacttctcatcataaaaaaaatgatgctgtacttgttaataacttgtttagctcctggtctggaatggtatattcctggtttggagatagaactgtacagccgggattggttgttcagaatggttgggcctatgcaacacgggtgtgttgtatagtgtcgatttaatattgcttaattactcaactgttttactattctctcaaatgtttattaaatgatgtttatgcaaatgagcctatgttatgccatcctttgttatccattgcacttgcatatttgctgcgtgacttgctgagtatgtcatatactcaccttgcaatcattcatcggaggaggagttctacagtgatgctgaaggtgtggatgattaggcgtagccctggtcaagctgcttgtgggatggagtcgtctgcgccgtttattttattttccgctgcttagatctttattggttgagaggaactatctacctctgtaatgacattatattcgcttattaattagagtaataattgtaatctattatcaatttgttattgtgtgcctcggctgatttctggacgagggtttacacacatgtaagcgtttggaattttggatagaaattctggcgtgacaataatgtaagattgcatccaactacaccaatgagaaaaatccgttccatcgaaaatatgaggcttagttgtaaacatagcgggagtagccatggcaaaaactctagatcaataaaaatccaaagaagaaaaaaaggctctgataccacttgtaggatcgaatagcaagaactaagccaaccagagggaggggtgaatgattggtatacccaaaaacaaaaaacttttattggaaaataaaagttaccctcgaattcgacggatcgcggtctgaccaaaggtattgcgccagtctgaccgcctgatgaacgtcggtctgaccgagatcgaacttcggtcgaaccgccgagattgcctgtcgccgactcctgtcaacgccggtctgactgccgtactcccaccggttggaccggcgcggtactgccggtctaaccgccggtatgtcactggttgaaccgccgaaactcggtgaaacacaaatcgtagaactcttaaagtggatgacgactttattacttctctctatgtttacgaagtgcgccaacagcactccttacaaaaatttcaactaaactcgaaaccctaactcaaaactcaactcaattgctctcaaaagcgataccgggaagtctcacgctccccctctatttatacccgaggtaggcagcctaaagccacgaaccaaactcatactaggagtcctaaacaccttagaaaaccctctagtacaagaaagaaactttacataatcaatcgtaccatatttggactccttccaaattcgactccgcatcccatacgcacacaataactccatggtatgccatatggaatctctatcaaccacgtgcatcaactctagccttagtatcccgcatgatctctgatcaccacggacatcgtcttatccccaagccgactcccggtccatcaccgcaaatactcttccgagacatcgagtcatctacacatgaacaaacaaagaaaccatattcagagaccaagctatctcaatcttgacttattagtaacaaacaacagtattacatacgtatagtatccatctagaagtcataatcatgaaataatcacggatatccaaataaacaacccgaagccgaaaccgacacagagtcggccggtcagaccgcgggctggatggtccgaccactcgatcaccgccagtctgaccggcaacacctgcccggtctgaccggtccacataaaatgataacctgtagattcacctatgaaatccaatcatccccaaaaccacttcgtgaataaattccaaataacaacaccaataatctccaatgcccaattgttcatcactgaataataatcaaaaacacctttgattttacatttctgaataccacaacctctagttttccgaacatacttccttctactcggattatgaaaatcaataattcccatagaatctagccaaatattgacaaacaaaaaaaaatcttaacttataatcttatatatcttattaactacttcctccgtattttaatgtatgacgccattgactttataatcaacatttgaccactcgtcttattcaaaatttttatgcaaatataaaaatacttatatcatgcttaaaaaatatttgatgataaatcaagttacaataaaataaattataattacataaattttttaaataagacgaaagatcaaacgtttgtcaaaaagttaacggcgtcgtattaaaatatagagttaacggcgtcatattaaaatatagagagcactacttaaaaaactgcaattttctaatcatcacacgtcgatttttgtctgtccacgtgacgattttcgtctgtaatcgattttcatccgtccacgtgattttcgtccacgcgacgattttcgtctgtaattgattttcatccgtccacgcgattttcgtccgtagtcggtgagaccgcgtatgcgtttccgtcttcttaagctgcggccaactcagtgtcatagccggataaaaaaacagaaaaatccaaaaatccaaaatctctctaggtagacttgctcaaacaccctagagttttaattcaaattcagaagatagcatcgcaaattgcattttggctcattcatttgcccaaaacaatcatagcatctatcagattcagatcggagcatatagacgaaaaaaaatccggtatcacaaccctcttcaacaccgatccggattctatcttataaaagaaagaaaaggaagagcgatgcgtccacggaccacgaatcatgtgcagcaagcccaccagttacagatcgatgctcaccacttcgagattgaaggagtggcgtggggaaggaggtcgtctccctgctgccaatgggccacagctaagcttgaggacgacttcaaggcgcgatggacgatgaggcgaggagccgacgccgccccatcctcctccctgctcctggacggcacgcgggcgccgagctcgctccacgccgtcgcacgaagccgcgcccgcagagaacggccgctctcgccgcctcagctccccaagcgcgccggcacaccctccctctaccccgggcgccctcctgcctgctcctcgctgcaccgccaccggcgctctcctcctcctactcggaggcagatgagagaaagagagaagaaaagatcgagataatgaagggaaagagagagaaaaaagaaaagaaagagaacgtgtgggtagaggtgggcaaaataagaccgaaccgaagaaccgaaccgaaaaaaccgagatcgaaaagaccgagaccgagaaattcggttagtagttcggtcccaactattaaaagac

SEQ ID NO: 43099 - DNA, 20251 bp, Oryza sativa
atcctgatgaagatggtgaagctgttgatcaaaaggaatatagaagtatgattggatcttttttgtatctaactgcttctaggccagacatacactttgctgtgtgtttgtgcgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgaatttggtggttgtagaattaataggaaaagtactagtggaacatgtcattttcttggtacatcattgattgcatggtcttctaagaaacaatctaatattgctccatcaactgctgaatctgaatatgttgctgctgctagctgttgttcacagattctttggcttttatctactttgaaagattatggtcttacttttgagaaagtacctctcttttgtgataatactagtgctatcaatattgctaagaatcctattcaacactcacgcaccaagcacattgatattcgttttcactttttgagggatcatgttgagaaaggagatgttgagttgcagtttttggacacaaagttgcaaattgctgatattttcactaaacctttggattctaatcgctttgcttttcttcgtggtgaattgggcgtcattcatccttttggcatggtttgaggggtagtttgtacctcatggttttatcaagcaaaaatatgataatgaaaaaattgagaaaagagagctttgtttatgcatatggtattttcttgtgcatgctagcaatactttgaaggtttatttgtctctagcatagcttgtatgtattctagtcttttcatgagatttagattttgcttttaagggagatgatgcattacacttaaattctatacttgaattaagaaaatatgcaatgttgatgctagcatatggtttgatttataaatgctctatatatatgctctattgacttgttattcctcaaatacctttaattgctcattgtgaaaaagagaataaaaaatataaaaaaaataaataccgaatccttggaaacagtcttgacgacaagaacgtattcgatgtgagcaaaataatgggtgccgaatccctggaaacagtcttgacgacagggacgtacccggaataagaaagagaaaaatatgagaacaaaggctcaagaaaagaaaaagttaaaaaaatttctctttgttagttttgtgcagaatgcttatttgagaaagagtgataaatgcaataggtatatgtgtttagtgtttattctttaacctatgtgcttgttaagatgttgcattataaatccaatgaaatcatgaattttgattgttgattcaagcttaattgtaaaatctttggttcatgactatactttaatgcatgtttgttatgttatagatgggttcatcttctttttattgcaacacatgacttgatatgctatatgtatgctaagctcttgaacattaatgaatataattcttatgcttgatgaaaatttttggatattttggagaagcaagatgaatttttgaagagttgttgagaagagcatgtttttggttcaattgagaatttctttcttttaaaaagggggagaagttttcttttagatttttgagaacgatgtgtacgtttgtacgaagtgtgctttttaccacttttgtttttaattttccaaacactaaaacatttttatggatttgccaatgtgttcatcaagggggagattgtaaaatcaaaggtgttttttattattattctgtgatgaacaattgggcattggagattattggttttgttatttggaatttattcacgaagtggttttggagatgattggatttcacaggtgaatctataggttatcattttatatggacaggtcagaccgggcaggtgttgccggtcagaccggcggtgatcgagtggtcggaccggccagcccgcggtctgaccgaccgactctgtgtcggtttcggtttcgggttgtttatttggatatccgtgattatttcatgattatgacttctagatggatactatacatatgtaatactgttgtttgctactaatgagtcaagttggagatagcttggtctcggaatatggtttctttgtttgtttcatgtgtaggtgactcgatgtctcgggagagtatttgcggtgatggaccgggagtcggcttggggataagacgacgtccgtggtagtcagagatcatgcgggatactaaggctagagttgatgcacgtggttgatggagattccatatggcatacgatggagttattgtgtgcgtatgggatgcggagtcgaatttggaaggagtccaaattcggacgattgattatgtaaagtttctttcttgtactagagggttttctaaggtgcttaggactcctagtatgagtttggtttgtcgctttaggctgcctacctcgggtataaatagagggggagcgtgaggcttcccagtatcgcttttgagagcaattgagttgagttttgagttagggtttcgagtttagtcgaaatttttggaaggagtgctgttggtgcactttgtaaagacagagagaagtaataaagtcgtcatccactttaagagttattctatttgtgtttcactaggtttcggcggttcaaccggcgacgtaccggcggttagaccggcggtatcgcggcggtccaaccggcgagagtacggctgttgtcacatcctgatttttgtttcaggatttataaattattttactaaattaataatataatttatattaaatgatctttaatttacaagtgaagtaaaatgtgggaaataaaatttcctaaatctaaagcatggatggatttaatttttattaaattctccatggttaattatactctctgaaattttctcggatttttcagagctcaattcctaaatgaaacaaagaacagttcagtaattatttgatcattaatgatctaactataattgttaagagcttttcttgtttaaaaatccttaaattataaattgttgtttaaaaggaattattagaaatgattttaaaagtctaaaagagaagatctaattttaatttgttaaatctcaatataaaattgggctagataaaattttgttaaatactttgcttaattctagaattcctagatttttctgggatttttttgagctaaggaagtatttttaataaatggaattgcatttaagaaataatttaaattgaaaaaggtttttaaaagtcttcttttggctttgggccgaaagccggcccaaaacccctctctttccctctctctctttccctcggcccagccggcccaatccgccgagccgccgctctcctctctctcgctgtcgctgacaggtggggcccgcttgtcagggtcgtcgtcctcctcgcgccgccgccgcccgcaaaccctagccgagagccgccgccgtctccttccaaattcggccatgtctttccttctccggccgaattggttgagggcaaatgatcttctcgatctcctcttccttttctcctttggaatcttcgcctaattcggtttggaaacttgtggattcgaggtcgaatcggattcctctctttcctccgaatcttcaacctttccttctcgtcgccggcagccgtgggcctccgccgccgccttccaacccctttataaggacccccgatgtctcctctacccgtcgcccccttcgccttcgcctctcgtcgttggaaaagccctagcaccgtgtaccctagctttgccgtcgccgccgccgctccagccgtgcgccgccgccgctccagccgtcgctgtcgctcgggaagaccgccgtcgggttcgcaaggtcgtcgccgtcctcgtccgccccttcgccgccgccgaagaccgccggagcgccgtcgccgtcgtcgacccgaaggtttccgccgcttcttcttcgtcgccggcgccgtcctttgctcctccgccgttgttttggtcaccggtgagttcgccgcgtcgcgctctacccgttggtgccctccgttcgcgtcgtcgagccgtcgttcgccggcgagcgtgcgccgcccgagccgtctgctccgccgagccgccgccgctgtcggtgacgtcattgctgacatcatcagggtcgtccgccgtgagccggtcgtggaccgttcgatctcggccgtccgttttggatagggttgatctcggccgtccgttcccgtgaactgttgccgtgcacccggtccaccgcaaaccctagccgctgacgcaataaaccttcttttccttttcaaaaataattcattattgcgtcataattcaattaaaatccatataaaggttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagattataatcttgtaaaatttataataaattcatttgaaatcggaatgaggccgttcaagtctcataattcatctaaatttatgatctacatgtttgtttactttttatgtactgtttatttggtttttattagtctttttcttcgttttgcgtgttagcttgtcgtttccgtcgttgcgaaggttcgcaagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcactggatggtgtgaacctattcctttgttatggcctgtttgcattgattaccttattccttgataccttgggttattataacttgactagttgggctttatatattggttcagctagatattagatatgattgcttagccatgcttagaaacattagcacacaattgggataactaatgtttcactatcacttatggttatatttaatggtagctcaccatggtcaatcgtgattggttaattaattacttgccaactaaaacttgataatggtgggttgtgagcacatggttttgagagtcgtgctcatgacaattaaggaccggttcgcgagctactgttgtgaaaaattaaccgtgccaaccacaagccagcgtgggcaacggctttaccttttgtataacatgattcattgcggagcaccaggttgagaagtggcggagataagcccacgggggtcgctggggagtccataccttgttttataagggggtgattatgatccaggaatggtgcgctgcggtggattgtgttatgcaaggggtattgtcacagcccctttccgaggtaccgtggtggtactgaggcacatggtgacatgatgtggggccgtgtcttgtgggtacagtggtacacctctggccagagtaaaactattcgaatagccgtggccgcggttatgggcgagttgagcaatgtttttcgtgattagtcccacacctctcaccataactatggatgttacctggtaataatttgcttagctcctggtttggaatggataattcctggtttagagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccggaaggagaagacgtttggcttataccccagttgagctgcctgtgggagtggagccggagcttcgctaggttttattttccgctgcagttttcttcatggtgaggactaagtgcctcttaagtaagtatatatttgtttagttaatttgatgaatctgtatattaaattgtcagtttgtgtacctcggctgatttcctggacgaggattttatgcacaaataagttcggaaattactagtgaatttccgggcgtgacagctgtcagaccggcggcgacaggagtcggcgacaggcgatctcggcggttcgaccggagttcgatctcggtcagaccgaggttcattaggcggttagaccggcgcaacacctttggtcagaccgtgatccgtcgaattcgagtgtaacttttcttttccgctaaaagttttcggtttttgggtataccaaccattcaaccccctctgggtggcttagttcttgctattcgatcctacaagacattgatgctcgacacatgtttttattttccaaaagttacttttgactcttaatagttagtacattgaaaggtcaccaataaataagaaaaaaaatatcagtcatcgcttaacaagttaacaaagtttggtcaggccgccgctagacttcaacgaagtaattaacagcaatcagcaagtggcctaattgccaacctagatgatgcgacattccagcagcaattaagtggcctcatcctcccagcagtaaggatatgattggagcagtttttgcgaattagtctttttattcaaaacaaattctagaaatggaccactagcaaaacattttgctgaaatgcatcattcaaaatagcacgaagacgtgtatttgggaagttgggaatattaaaataaaatcattgtggtctgtctgtaagattcgttgaaaaagaggcacactaactagtacaaaggattatgcgtgacgagctggattataataagctgacataaaataagctgtgagttgattatattttttattattgaaggtatttaggggtagtgggtctttagtcacccaataatataaagaaatctcctctagaggagattattagattatattaatctgggcttactctattataactacacctatcactaataaatctactctgtttatctactagttatctcttcaacaatccagattataataatgctaatctgagtctagctaactctcagcctcatgtatagatatatctatctcctaactcaacatttccattcggctctcgctccttttcttggcgcttatatttttcttttcacatcaaactagcttctcaagctgtttagctacatagaattttttttcctctgtactctcggattactgattttcagcttggacaagtactgcttttcttgatcttttgctttacatggaggaattatagtttttctccatactatccctaataatcatatctcatcttccaataggagggtattactattgattctgcatctctcttctacccgctccaacaatttgaagctagtaaacttgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttgaagaaaatcaacatctgcccctagaggcacccgaaccccccttatatatgggaaggagtccgtgttacaaaagataatctatatccctaacggaatatacaaatacaggtaaaatacagtcgtaaccgactaagtctcaaggtgtttccttgatgtacaagttaagaaacaaacccgagatacaaataagatattctatatatattcggtatcctatatccagtccaaatatcatcgccatgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcataatcatgcatcatatgacaaaagcatatgcggcgcctaaagaggcattctagccgactgctttttagccataacaaaagaaatccgagtggttaacactctaaaaggttcacgaatgaacacacttgacaggcatccgaataaaaactctaaagattacccaccaagtattataaaaattatggtaataaataagtctaatagcctaggccatgactatttaccataatgaaaacaggcatataacataccagggaaacgactatggtaaaaacaagtcattccaagttaacccagacagcttttgtagcctaaaaaagcttacaaaaacagcataacgcctttctgtcgggcaccttttaatttgcattgcaataattccaaagaattatatgaccgcgtaaaaaggattttatcagcatcgggcaacactattgtgcacataaattgccaaagcaaaaaatgcctaagtccctaaggaacacaatgggccacgctgttaaaagtattgggctgaggtactgttcaggcctaggcccatttgcacctccgatacccttaacaagaaatccgagatccaagcgacgcttcgtcttccccgccggaacgctcgccattttccccactccccgctacagtaaagagctgcgccggcgaactagggttcaccaatccacccaaatccaccttcaaaacgtgatcaaaatccttctcgtgatccaccgcctcaattcctcatctctcccaagccatccctcgaatcaaatcagcgcatttgagaaaaatcgatggcggaagagagagaaagcttcgaaagccaatgggcgccgtccgacgtgacggaagagaacctgaaggagatggtggcacacggcgttctccctgtcaaggatatcatcgggtggcggccagcgtgcggtgaggcctttccaacccccgatacacacgaggtcgtggtcttctctcatttcttttatggcggatttgctcttccaacctcaaagttcttccgtgggatactgaatttctatggaatcagcttacatcatttgaatccgaactccatagtccatattgcaaatttcgtccatgtctgcgaagcttttttgggcattagacctcattttgctctgttccgccgaatatttttccttaagcctcaaccgaacaaaaacaaaccatgcgtagttggaggggctggatttcaactgaggggcactctgagccaaaagtatttctccatgcctttcaagacttcgaacaaaggatggcacgccaactggttttatattcaaaatcccgagcccgctcttcctgagtactcctgtcttcccccagtataccaagatacatggaactctctccccatgggagatgaagctgcccaagccttagaactgatggaacgcatgctgaaactcaaagagcaaggcttacagggagagcaaatcactcggcatttcattaagtgccgattagctccaatcaaagaaagatcccgcacagcatttgaatttgacggcaagcatgatccaaaccgtgaagacccagattctctggattttaagatcatgaaggagaggatgtacaagatattctcgaacgctattgtcgtcagctactcacatcaactgccagtcgtaccatacaacgcattcaatccgcctccgcaggtatgcatctgaaatcttcaacccatgagcaaaataatatcttgtcttcatgttgagttaactaaccacggaggcatctcattcaggaatatgtattgatgaaatctgatcccccaattgctcagcgccgatctcctcgccagcacaccattcaaggaagtggggggccgacaatcaggtcagacccacaacctcaaacctccaaaccggctgggcagacaggtcctcgcaagagaaagctggtgcttaatgacgacgagggcgatgacagcaacaaatctggggacaagggctcgcccaacaaactcccaaagcataccatgcccaggaaaaaattggctggccgtcaaatgccaaagattagaacatcttccaggtataaacctctcgataccattttatttcggcatgcttctctcatagaaattatgctaaatatcgaaaggacactttgcaggaaaccgtccgacatagatccaaccggaaaagaccctgatccggctgtgacagagccaaatatatccaaggatgctgagccgactgctgaaagccagctgactgccgaaagccagccgactggcgcccatgcttcggatgacaaggccaatccgagtgaccagccgccgactggaaaccagtcggcgacaactgaaactgcaacaacccgagagcccccaactggaaaccagtcggatgtaggtcctgatcaagaaatccctgaagttgaagcgcaagcgacagcttctcaaggaccagaagctggtaatgactcgatgattgggtctccagataaagagcaaggatcacctcgcactcagccaggcacatcttcaggtaactcatcttctcaagtgatgccgttctgaataactccagcttgttcgtctaatgtcttgggaatacatcaggtccactaggcgacgacgaagaagaaattctccgcataaaggcagctaatgactctcgtcctcctatcttactcaaatggtgggacgagaactctcaagtttccggcattgttataaatcgccaaaaagaagatgaggaagtgtgccagctgaagaaagtacttggagaagccactcgcattgtgaatgtaagtcttctaggtgactgcctttgatgactttgttttctcgttagcaaaactaatccatgaaccaccgtgcagagaatccatcttcgtaatgaagccaagactgcaaccttagaaaagctggttccacacttgggaactcttgaagccgttagggaacagctacacgaggccaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggacttcaaacagcgcaagccaccaggatggctcaaatggagaagcaaatagaagccttgaaaaaaaacaaagcagaactggctgcggaaagggactcagccttgaaggaggttgaaggtactgccaactgacaatttgaactttcctctcttgaatgcagcagattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaataacagtggtccgagtgcacttgacgcaaccgaaatctttgacaagctgagagttgcaccggatgtatacttcaagaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcggctgacaagattgcaagtgatgttgtagagcaattccacaacaacgaccttcagccgagcaataataactctgatgatgaaaggactgattctgactgagtataaatgtagcaaatggaggctcaatttgtacaatactggtgtatttatgctgtgcttgatagttctaaccaagtctttgatttcttaaaagcttttatcaagctttgttgagcctaaaacccaaagaagctattaaaaactttcagtcctcgcagactatgtagaaaaaatcaaacaaggcaatgatagaccaagtaagcaaattaaattgataaaaaatcacactccattattatgatgatagcccccgactgacaacggcaagaagaaaacttggtgttgacagtcaaaatagggaaatacaatgataagcttaagcatagaaacggcgaagatgttcaatattccaagagttgtcgacgagagtaccgtcttcgcgcttgagtcgataggaacctggccgggtaacttcagagatgataaacggcccctcccataaaggagataacttgtgccgatctcgtgtagtttgaattttccgcaaaaccaggtcgccgactaaaaaggcacgggatcgaacattgcgattatgataacgccgcaacccttgtaagtatcgagccgaccgaatcaaagtttggtcaggccgccgctagacttcaacgaagtaattaacagcaatcagcaagtggcctaattgccaacctagatgatgcgacattccagcagcaattaagtggcctcatcctcccagcagtaaggatatgattggagcagtttttgcgaattagtctttttattcaaaacaaattctagaaatggaccactagcaaaacattttgctgaaatgcatcattcaaaatagcacgaagacgtgtatttgggaagttgggaatattaaaataaaatcattgtggtctgtctgtaagatacgttgaaaaagaggcacactaactagtacaaaggattatgcgtgacgagctggattataataagctgacataaaataagctgtgagttgattatattttttattattgaaggtatttaggggtagtgggtctttagtcacccaataatataaagaaatctcctctagaggagattattagattatattaatctggcttatctattataataacctatcataataatctacttgtttattacagttactcttaacaatccagattataataatgctaatctgagtctagctaactctcagcctcatgtatagatatatctatctcctaactcaacatttccattcggctctcgctccttttcttggcgcttatatttttcttttcacatcaaactagcttctcaagctgtttagctacatagaattttttttcctctgtactctcggattactgattttcagcttggacaagtactgcttttcttgatcttttgctttacatggaggaattatagtttttctccatactatccctaataatcatatctcatcttccaataggagggtattactattgattctgcatctctcttctacccgctgcaacaatttgaagctagtaaactgttcagtttacaggtccccttgactgttacaggtatgcatcgtttcatcaaatttgtacatatgattttcttatttacctcaagcctcaaggtgtgttatacaacacaattcctagattttctatatgcatatgtccacagaaaagataatactggtcatatgtttgttttttacgtctggttaaacaaacaatcctagaaaaactattattataggcggtcaataattcatttgcacaagtttagctaaccagcatgtagaaattaaataatttgtattggaggattccacaacggtatgtggatatcaatttccagttctattaagaacccacccacggaaatgaattttcaactttttgttaatgtaggcgaaagaaaaacacattttaccaggcaactatacactgtcactggtcgcaaatacgaagtcacagtgatttcttacacgaaatatgcattttatcaaaagtcacaggtcgcaaatcagaagtcactaatacctatttcatattacaaatattttaaaatggaattatcaccaataacaaagttgttgatctcggccagctctttagtttttaatatagggcatatctcccgctgaggctgtttgaaaactttttttaaaaaaacatttttagagttgtttctatttctagacacggtttgttaggttagccgtcagcactaatcatttattccgttagtttttcagaggttctcccgtggaaacaagttgctttaaaatattaaataaatctatttttcaagtttcatataattaaaacttacttaatccagtgctaatgattttctcgtttttgttcgcacttctctccggatcaaacgtagctaatagtgtagacagttagttacagggtctgcctgtcaaaaccgttactcattatttgaaaatgccaaaactttgaaaattgatagaaatttgattttaagtccagtattagtgaatcaaagttctagctctcaacaagatctatctctttgagactgtatagagtccaaatattcgttataagctcttagatctatatttggaaacaaatttatgaattttttgaatgcccttaaatggagatgtgttctgtaatatgtattgaatttgtaaagctcgatgagattctacaactttataactttactggtgataattttttatttgatgtcatttatcctcccaaatatgctaaatgacatgaggtaaggttatgagaggtaatcctctttaccgcccatgtgcatgcttcacgtgaaaaattgcgtgactcgttgttttgtgaaatgtgaattattttattggtttttttttcatacaacatttaaaaactagaaatacatttttctcacgtgactggaatttatctgtacaaaatcgttgatttctacttgtcttagtcataggcggttggctaaacgcctgtaggaataatgggttaccgtcttaccgacctcctatacaatttttttatgtaccaatcattatttcgactattcttcctgaactggagctaggttatactaaaatgataatttatttaacagaaaatagtagtcactataaattgatatgttccaagttgataaaactacattcatttttgttttttattaaattatactccttgtatcccaaataaggtttaaccactttttacttatgtctcatcatataagacaggcaggcatgcatacattaattatcacctcttagttctttaaatttggtttactttaaattctccaccattaaacccccaatcacattgtttgcatgtatggatgtgatccaatcaaggaggtgattaaattctttcttgttctttgtggtagtagtggttgagccttatacttttagatggagagaataaatatatactataggcaccattagtttttttttgtctgtactatgttccacatttttctgtaactctatggaccgaatcgtcttcacgcttgagtcgatatgaacccggccgagtaacttcagagatgatgaaaggtccctcccataagggagataacttatgtcgaccccgtgtagtttaaatcttcctcaagaccatatctccgactagaaatgcacgtgatatgacattgcgattatgataacgactgaattaatgttgcctcacgagcttcttccaattggttgagatcatccactcggtcttcctcgtagcgttcctctttaacattgcgaaatctcatggactcaaactccacttcgcttggcaacattgcttctactccgtaaactaagaaaaacggcgactagcccgtagcccgactgggcgtagtgcgcaaagaccaaagtactgacggcagctgctcaacccatttgccagcatagggacgcagtcggttaaaaaaccgtgccttgatgccttgaagtaccacaccattggcgtgttcaacttgaccattgctcataggatgcgctacagaagcataacatatcttgatactaaagtcttcacaaaaatctttaaaaactccaccagtgaattgggtaccattatctgtaatgattcgattcggcaccccaaaccgatgcacaatgttgataaagaagtctcgagctttgttggctgtaatagttacaactggtttggcttcaatccatttggagaacttatcaacagccacaaaaagttgattaaatcctccggtagcccttttgaaaggaccaaccatgtcaagcccccaaaccgcaaatggccaggaaagagggatggtttgcaactcttggtccggcaaatgaatttgcctagcaaaaaattgacaactttcacacgttcgcacaaccttctcggcatcagacaccgctgtaggccagaaaaaaccctgtcgatatgctttgccgactatcgttcgtgctgccgcatgatttccacaaatgacagaatgaatatcttacaacaattgcctaccttcttctagagaaatatagcaatgtaggattccagatggactctttttgtataaatcggcctcaatcatgacataaagcttgttgtgtcgagaaatccgctcggcttcattcttgtcttgaggcaactcttgctgagttagaaatttgatgattggctctctccagtcggcatcaattactcctacttcattagcctctccatctccgactttatcctttcttgatactgtcagctcatagagatgctcgacaaaaatatcagaaggagctgcttctcgttttgacccaaaattagctaatctatcggctgcttcattgttgtgtctaagcacatgagttaactctcgaccatcaaatttatcttccaatttgcggacttcttgtcgatatgcaaccatattgtcgtcgagacaggaccaatctttcatgacttgattgacaaccaactatgaatcaccacgaaccactagatgtcagatccctagggatacaacaatcttcagcacatggagtaacgtctcatactctgccacattgtgggatgcagaaaagtgtatccacagcacgtagcttaacctttctccagtcggaaaaatcaaaacgacccctgctccggtgcccgatagtctctttgacccgtcaaaatgcatagtccaatactccaatttctccacaggtgtgtcttcttgacactcggtccactcggcaacaaaatctgctagtgcttgagatttgattgaagttcgcagcttgaaagataaatccaaagacatcaactccaaggcccacttcgcaatacgtccagttgcctctcgattatgaagtatgtcaccaagtggaaaagatgtgagcaccgtgatcgagtgactctgaaaataatgggataatttcctgacggtaattaagacaccatataataatttatgtacctggggatatcttattttggagtcggccaagacctcgctaacgaagtaaattggtcgttgaactttttgaacatggccgtcctcttctcgcttgacaaccaaaaccgtgcttaccacttgcgatgttgctgacacataaaacaacaatggctcttgcgggtgtggtgacgctaggattggtggagttgagagaaatcttttgaaatcattgaaggcttgctgagcttcgggtccccattgtaaattgtcagtcttcttgagcagtttgaagaagggcatccctcgctcgtcaagtcttgaaataaaccgactgagcgccgccatgcatccagttagcttctgaacgtctttctaggaactaggcggtttcatgttgaggatggcattgattttctccgggttggcttgtatgcccctatgggacatcataaagccaagcagcttccctgacggtactccgaaggtacacttttcagggttcaacttcatcctgaaagcacggatgctagcaaaggtttcctccaaatcagcaattaagtcatccttctgcttggtcttgatgactacatcatcaactacatcatctgagttgaaaaacatctctggattatgtgttgataagttgctctagcattcttcaatcaaaacggcatggtaatgtagcagtaagctccaaatggtgtgatgaatgaggtcttcgagcagttggattccttcaacctgatctggcggtatcccgagtagcaatccaaaaatctgagtaactcgcagccggttgttgagtcaactacctggtcaatgcgaggtaacccaaaagaatctgtaggatatgatttgttgagatctgtatagtcaacacacatgcactattgttctattttcttccgaactaagactgggtttgccagccattcgggatgtaagacttctttgatgaagcctgccgctaacagcttggttaattcttccttgattgcatccttcctatcctgagcgaatcggcggagtcgttgcttaataggtttagcatcgtctttgacatttaaagagtgctcaatcacctctctaggaatactaggcatatcagatggtttccacgcaaaaatatctttattagcttaaaaaaaggtgatgagcgcgctttcctatttacaatctaactcggcgcttattacagcaattttagatggattagatggatcaagggggatctttttggtcttggcatcgccttctccggaaaagcttgaaggttcatcactgacagatagcaagagattgctacaatcgacaggtcgacaactagaagtaggcatctcttgatcacctgaaggcaactggtgagagatcgctacaaccgctggtcgacaactagtagtaggcatccctcgatcacataaaaacaaccgaaaggtggcgagagatcgctacaatcggctggtcgtcaatcaggagtaggcatctgtcgatcacttgaaggcaactgataggtggcaagagatccctacaatcggctagttgacaaccatgagtaggcatctctcgaccacctgaaagggtgctagtgttggctattatatgtgcatctcatgtagccagcatgactcacatacccaacttatagcatacccggatgtccgttcgcaatcatgtcaggtgatcaagccgacaacgtttgcgaggaattatccgttaacaacctattctcaaatagtgcagccgtggcctgcactatacgtgagataagtcgttaatctttgctggtaggattggtccgacaactccgcatttgtcgagaatgttctcgataatgagttgtactcgaccacaacctactctagtgctcaattgtttctgaaaaatattttctataagaaaagacatatatggcagagaatatcgagtacgtactaaaaaaaactgcatgaatcttctagtattatcaggatataactggcagattcagattaaatatcgcgtactatgtaaacgtaaacaagcatgacttataacatgaacatagcgagcccccaatattagaccatagttagtctagtataggaaacactcgcacaatagatatcgtataaaaaacatgctctaggtaaacagaataagttatggatctgacaatatcgcatcgaactgaaaaataggtacattaaattgtttataaaatattacgtacctttgtagataattgccatatgtatctacgaaattagtagattaatttaaaaaatcaatctaccaattaccttgatgcgtaatcgttcgacatcatatatatttgaaatcttctggtacggtgcgtgcctaggacctttggatgatctcgatagatcaaatggttggcgatgacgattccgagctagttggggggcgtactctggccgggtcagatctcccaaggtgaaagtcgttgaagtatccctcgttgaaaaatccacggtggcaatgacttgatgaagctttaggtgacgagggtcctgatacgtcatagaacacacttcgttcgggtcgtatacccctacagccaaagtcgtcgagtaatttattgtcggagaatccatctcttgaacctatctcgccgaaaccttgaagcaccaaaatcccctacctggcgcgccactgtcgatgttgtagatcacgactacggtatttgcatagtatggggatcgttggtgccagattgtgcgcgagattgaggtaaaagatacgaagacaaggatttttatacaggtccgggccccttaactaacaggtaatagccctacttctgttggttgaagccagtgttgctcttatccatcagagtcacacaagtataatatttgggatagcctatccagttgtcgtcaactcggcggcatgaaccaacactcttagtcgacgacagggtagtcttcctcctcgaatatggacttggcgagattagagatagtgcta

SEQ ID NO: 43100 - DNA, 3072 bp, Oryza sativa
aacactgtagttttgtacgaagttattttcatgttttttcaacctgctaaggctacttcattgatacttatgtaagggaaatcttattttctttatagtttatagaaagatacttttctggagcagaactgcaatgcactgcaaactcattgtttaggaatctgagtatacatatgttgcccagagtgacttaccttggaacatgttatatctgcaggtgtgcataattaaaaatggcacaaattttgggtggtctagtcaacattgttgtaacaccgatctataatgctatattcaaacatgcattgtatccattcaaagttaccagaaatgtggagaatctcgagaaggctacaaagaaattgattgctaaacgtgatgatgttgagaacaagattagtaacgatgagagaagcggcatgagaataaaaagtgaagcaagaagatggttggaggacgtcaataccaccatatctgaagaagcggatattaatcagaaatatgaaagcaggggaatgactttcggcggatgctccatgaattgctggtcaaactacaaaatcagcaagcgtgcatcgcagaagctccttgaagtgaaggagcattatatagctgatatgagtgtcgttggagatcaaccatcgccagaacctgttcaaaagatccctattccctgtgatcatgtaatggacaatgataacaatcttcgtgaagctctggactatatcaagaacgatccagttgggataattgggatatggggtgtaggtggagttggcaagacccatctcctgaacaagatcaacaattcatttcttggggactcttcctttcattctatcatctatgttattgcctctaaagagtgttctgtgcagaagatccaagctgagattgtcaagaaacttaacctacggaaagatgacgatgtaaaattccaagcccacatcatttctgaatttctcgacggaaaaaattttctgttattgttggatgacctctgggagaggattgatcttctggaagttggcataccaacactaggaattgaaaacaacctcaagaggaaggtggtcctcacaacaagatcacaggatgtatgtggtcaaatggaggtgaggaaacagataaaagttgcttgtttacgagatgaggaagcatggaaactatttctggagaaggtcgatgaagaaactctcccttccagttctctaattgaacttgcaaaacaagtagtgaaggaactcaagggcttgccattggctcttgtaactgtcggaagggcaatgtacgccaaaagggacccggtgctatgggagcataccattgattacatgaaaggggcatgtcgtgataaggacggtcccctctctatggaaactgttttcaggcaacttaagttcagttatgatagtttacggaatgacaccctgaaacgttgtttcttgacttgtgcattgtggccagaggatgtgttcatagctacagatgaactcgaccaatgttggatgggcttaggtctggtggacaaggatgatatacaaagttcctacagagaagcatgtaacgtaagaagtgaacttcaatctgcctgtttgttggagagctggcatacttctcgtgtaatcacaatgcatgatgtggttcgtgacatggctctatggatctgttgcggttgcagtgaaaagaacgacaactgggttgtccatgcacaagttggcaaaaatttatcaagaagaaccatcccatggagcaaagctgaatgcgtctccttgatgtggaatcgcattgaagaattgcctcccatggattcaaattattttcccgcaaaactcaggacattatgtcttcaaggcaatcgtttggatggaaggatagttgaaactcttaagaatttcactgcactcacatatctggatttatgctcgaattccctcactaacataccaggggagatatgtgccttggccaatttggagtatctcgatttgggatataattcaggaatatgcgaagtccccacctgctttagagaactcagtaagctcaaattcttgtatctgtcatgcactaacgtatggagaattccagaggatgtcatatctagccttaaagcactgcaggtcatagacttgacgccaaaacccaaaccttggaatcggtacggtaacagagaaaaccacgcggatcatatgccttcagtagtactaatccaagagttaaccaaactaagtaagttaaaagcagttggcattactgttgaaagtgtttctagttatgaagcacttaaggaatatcctaacctacctattaggagacttgttctaaatatagaggaacgagagtcagtgttctatctactgactggtcctttgtcagatcacttggctcaaatgaccttacataagttggaaatttatcgcagcagcatggaggaaataataatagagagacacgagagtggtggccatttggaacaaaactatagttttgacgctctgaatcagctggacttacaatttttggaaaacctgaaagttattacgtggaaaggaatacgtccggaattgcttttccataggctcaccgttctgtataccattgactgcgaccagctggaagatatctcgtgggcgctgcatttaccttttctggaagaactatgggtgcaaggttgtggcaagatgagacatgccattcggaacatatcaaagcaagagagctcaatgcaatcgattgatacattcccgcgcctcgtttctatgctatttgcaaataacgatgggttggtcagcatatgtgattcagatgtgacattcccatccctaaagagcctgagggtcacaaattgtgaaaatcttaagaggcttccttttcggcggcagcagagcttgccacccaagttgcaggttatatactccgatagtgttgaatggtgggataatcttgaatgggaagaagaaggtatcagaccaatgctggagccccttcttaaaatcgtgtcataatgattacgctgagcagtcctgtgatgtgtttcatccatggttagtatctccccccgtctctctc

SEQ ID NO: 43101 - DNA, 814 bp, Oryza sativa
cctcgtgcccccgcccggtgtcgtcgtcggatggcgtgtacgaggaaggcgaggccagcgggcagggcgaggcggcggcccggtggtgtgcgaggtggtgctggccagacacgcggccttggcccaatggccggtggcgtgagactgtggagctggtgcgcgaggagcaagtcggcggtggtgaccgggtcatcaggtggctggctgccattggtgacctcagtggctttcggcagcacgcaggaagcggtttggcagtgaagagttcatcctctgtattgccagcttgacctgcggggtggtagactgagcttgggtgttgaagggatggcatggtggtccggcgatggtcgttgtgcaggatagttgtgtggggttttgatgggaaaccgctggcgaaagccttgccaggccatgggccagcatgacgacggcgacgccatttggcgccgttcccctccttggaggtgtcgtcctggcgttgacccctcataacaccaagaaccctctgcgcgcaatggtagccttggtggactcctgcaatgtccccgaagctcttcaggtctagggtgtttgacgaggcctcacttccttggcttcgttccttgctacagcgggtgttcatcactcttatctggttactgtggggtagtgtcggagctgctttgctggggacgaagcttggcaacgatgacacactgcaatctctttataggattgctgatgctagctgtgtgtaggagtggttccttggtagcttgggctgatgtccttcgtgggtgtcgttcttgtttgttcattttggcgttaggat

SEQ ID NO: 43102 - DNA, 780 bp, Oryza sativa
  unsure (1)..(780): unsure at all n locations
nnnnnnnnnnnnnnnnnnnnnnnnnnnnnnnnnnnnnnctcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactcattagtagcgaacaacagtattacatacgtatagtatccatctagaagcccataatcatgacataatcacggaacaactcgaaaccgaaaccgacacagagtcggccggtcagaccgcgggctgcgccgatctgaccgcgcattacacgccggtctgaccggcaacacctgcccggtctgatcggtcacatgaaataatgaacct

SEQ ID NO: 43103 - DNA, 11809 bp, Oryza sativa
ggtttaactataaatacaacaatatttatattagaaatcaaatgtatagcttaaaattcatgtatgcttgaatatttttgattatttctcgctataaaaacaggaagggtagatggagagctcaagcgaagtagggaggtttcggtagtgccatgttgtgcatatgtgtgggggagggcgaagtgcaggggacatgagcggtttttttcttttttttctaaatgatttaagtgaaactgatgatccagtttttctcacaacttttgttattcattttttctaatttttaatatgtaacacatggtggcttaagatttttctaaaaatatatctattggctaaaaataaggatatacctatttaagtagaacttgatggatagatggttttcttccaatctgtaaggttttatttttatttaatgcataactcgtaacgccttcagtgcacttcagaggatatacaatgatttccattgatgtaatacttattttaattttattattaggttctctttcctttttgctatttggttacaattcgaaggatcagtgtctacattcaaatgatgtatttttaattttatagagtggaatgtgggtaacatgggtcttaaaatatttatttaattataaataaaacacaattcagataaagtaaaaattggatttaacttaagaactataatcatttagctttctaattattggactgtttttttacttagttaaaaattaggagatgaaggaattaaatgagataggagaggaagagagagttgaagagaagaagattacgccgcatataattataatatttctttttatgggttatattgttttagttggtattacttttttagctaaaaattgataaatgctttattgtatgattaaaatctatctttttttacttgtcttttcctatggtatattcgcagtagatattaaaaatataaacactatattctaataacgttattttgacttattgtaatgttagaatggacgagtaattttttaaaaacattactcagagttaggttcattttgcttttatccatatagatataatttaattattctgacatcatatacgatgataaaatctatatcactatttttctataattttgtattttttcgaatgatatacaaaaataaaatattgttgcccaaattgacagatttcttctcaaagatgaattaccgtggatatgggtctttaaatgtaaaatagtctgattaaatattagttgtgtgatacttgtcttttcctatagtatattcgcagtaggtattaaaaatataaacactacaatctaataacattattttgacttattgtaatgttagaatggaggagtattttttaaaaacattagtcagagatagctcttttgcttttatccatatagatataatttaattattctataattttgtatttgttcgaatggcatacaaaattaaaaaattgttgcccaaattgacatgtttcctctcaaagatgaattaccatggacatgggtctttaaatgtaaaataatctgatcaagtattagttgtgtgaattagatgttaatgttgcttacttttagcataagttttgcttttaaactcacagaatattcattttacttttatcattatggacatagtttaattattatgaagttatatacgatgataaaatctatattattattatttcatacttttcacaattgcttgaatggcacgtaaaagtcacaaaatataaaccaaaatttcatttcttttcaaaagctaaattgtgaaatatgatcttcaactgtaaattgagttataaataatttaaagatttaacgtgtaggatcgaatcacaataactaagccaaccagaggggggtgaatggttggtatacccaaaaccgaaaaattttagccgaaataaaagttgccctcgaaattgacggaagtcagtctgaccaagattgatctgccagtctgaccgagtggatgttgccagcctgaccggtatagattacccggtctgaccgccgatgtcgcctgctgcgcctgtcgccgccgctggtctgaccgccgccttgtcgccggtccaaccgccggtgagtcatcggttagaccgccgaaacccgatgaaacacaaatcgaagaactcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactcattagtagcgaacaacagtattacatacgtatagtatccatctagaagcccataatcatgacataatcacggaacaactcgaaaccgaaaccgacacagagtcggccggtcagaccgcgggctgcgccgatctgaccgcgcattacacgccggtctgaccggcaacacctgcccggtctgatcggtcacatgaaataatgaacctgtaatcacctctgaaatccacttcgtgaataaattctaaataacaaaaccaataatcttcaatgccaatttttcatcacagaataataatcaaaaacacctttgattttacataacggatcaaaaattatttatatgatgtagatgctttattgttttacacataattgttgcttttctaactaataaagcatgcaaatagaagaaggaatgggtaaaaatgtagagaaaagaattgagggaagagggggcatacatacatatattcgtttgttttttccttaaaaaaaatgaaacttatacgtactggtttaggtaggcccgggttaaggagatgattttctaaaaaaaaataatccaatagttataaataatgggtccatcaaatttaatgaaaatttgctttgtttttttctagatttcttaagtatttcagtaatttattagactgacacgtgatgaacatagtatcatttgtagaacaacacatgacaacataggagcacttttaggaagtttaatggacttttagtatataatgtatacattatccaatgttctaaagaatcgatcgggcctatcaatttaaatgaaatcaacagtgatatttatggaaatttatagagtgatacgttttatctttaaataatagaaaatcatattttaaatatcgtcatttttctccaatggtactaagtacgtatgttttttttatgctttattgatctttatagtaagtctgtgcgtaagtttatttgtttctttagatgaacagtaggtaaagcttcattgtttttttcagtcgtacgtatgtatggatacttctccactattataaaaattaaagaagttttttgccgatattttggtacgtcattcttgtttgagtcggttattaatttcgttcgtttttgaaaatattgattcttgtttgagtcactttttatgttcgttcatttttggaagtacaaaaatagttatataaaaaatatctttaaacaaactcgcatgctaacttgagatgaaagtcagactcctaattgcagctaatgattttcaaaaaaaaaaaagcgaatttccagagtaaatttcatcctagttaaaccgtataataagaataagattaaaatagccttcatccgtagcaatggacaagtattttttttctagtacagttatataattctcccatatacatatatggattaaggaattagtttttaaaataaaatacatctaatataataatataatggtttaaaatatcggatccactgctaaagtgaaaatcatcggtgagatttgacagttccacgtggcagcttaggagcgttcgtataagtgtcacatggcgatttgagagctttcatagaaaatttaatggatgatatttacgtaaatttatacaatgacagtgtcacgtggtggtctagtagtgtttgtacaagtaacacatgatggtttgagatcatttataggacgtttcatgaatgatatttacgtaaatttatagaatcgtatgttttatctttaaataatagaaactcatatttaaagatcatcaatttttttcaatggtactaagtacgtgtttacacccaaatttggcacctaggatcaaaataagaaagattgccaaaatttagaagtctatcggtttccttcgagtcggccggtctgacagccgtgtgttgggcggtcagaccgccagttgagggcctgtcagactggcggtgtgtggcctgtctgaccggcaggtccgagtccgactgtgtttcgtcaggtctcgaggtttccttgctcgggaaggcatgtttcaggtttcctttagtttctatcccaagttggacatggaggagggcctgtagagggcaagaccaacccctatataaggtacatggccagttctattgtaagaaaccaatctacaatcaatcaattcaatcgtttttcatattgcttttagttttctcttagtttgtccatctttgtcggtttgcgccgtaaaccgtccgccgccgctgcgagagtgcaacatctctttgtaggtttgtcctgaaaaccttccgttttgcccacgagacgggtaattatcttaaattggctccgctagccggtttatttgtcaaaacccatctaggtttggctctttgctagatcgaggtggttcgtgactctaggatcaccgcaaggcataaggtgttgcaatcgttgttgtcaacttatcacaaaaagttgccaacacgattttggcgacttcgctggggagatccgttcaacgtcaactcaacttcgatttcgccatgacgaaaccgccgtcatccaaggtggaggtggagccggcctatgtgataccaatcacattggatgatttcgaaggagaagaccgcaagtccatggaggagtacatcaaggagctcacacaggaggcgttgatgagggcgtctactaggactcgtcaaggtgtgatcatcaagcccaggccacgtcctaggctcgctcccaatttggtaagcaatgaagaggtaacacaatctatccaacaccaagtagcatctacaatagattcatctatgactatttttaaagatagattagatgcaacttttgaggataaatttgatgagtttttaagatttaaagtcggccctctcttggccgattttgtgggtaaaaataaagcctctagcactgctagccaagcccctatagatcaaacaaatagagaaccgatggagtggcgcacacagctggtctgaccgggcctgatggccggtctgatcgcgacttcaccgtcggtctgaccggccaaatggccggtccgactaggtattaccccggcggtcagaccgggactcaggctggtctgactgcgcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccaggagtccaggttgcccttcgttctgatcatcggcaactatttcgacttcattggcgttgacgagagacatgcgtgcacatcagaggtcaggacacactgcactgtcatctgatgtttgcttgcatgcgcacaagttctggccgggtttcagtgaggaaggcgaaaggatatccatttagtgatggctgctacctgatcaattaatcatggccacgatgcttcatctcggattaagctttgctacaggatccgggatgatgaagatttcttattagattttctgataaaaggaaaagataacatatatattgatctatgcttttccgaataaaaactggcaactaaataatatgactatagatttcaggtgttgcgatgttgttcctctaaccgaaagttcactctttcctgcatgcacggaagatttatacaccgtcatcgcttcaaggaattcaagtaggttacttacatattgtatgtgacctatttgaagtattcttgatttctaattttcgtagaataattaatgatcatgttataataagtgttaggtaatcaggtccctgaatatataattatgtttatcaataagtgtgtttacgtagttaggtttatacagagcaaaactcccatagttcacaaacgaatttgatctattctataataattttagaactgagaactcacgttaatctctattttttcaatagcaactaataattagttttccatgtatgtcttatcatgtttcaaaaactgtatgaagccttattgttgacgttcatgcagttaaatatcgtgactaattccaatttttacaattattatatatcatgaaaactgtactcatgacctattaataacgaatttcaaaaatattaaatcagaaaaaagttataattcagtctgtcaaattggaaatattaattataccacgacgaatctacaaatgagactccaacatttttttttcttaacggaacatcacaatagttacttatcaattccaaatcaataaattaaattaaaaatactaaattgagattccaacatgagaagaaaatgagtagtgaatgattccgatttttataattatcaaaatagtggaaaggctattagtaatatcccgaatgtgtacatcttgatcaacatctattagttataaatctcagaattattaaatcttaaaaaaggctatactgagactcagaccagataaaactcaatattttaaatacaaaatttacaaatattaaattaagaaataatataatttggaattaacagctgagtttcctaaataagtataaaatgctacttgggatggatcttatgtttatactttttaattttggttttttgaacagtcaatacaaaatatattgttttttctttatagctataaaaatctacaaataattttcaaaacaatatatttaaaattttaatatttaataattctaccaatgatagccgtgcatcgcacgggttggcgactagtgttcctaatgcttataatgatgttgctagggagtatcctcctgatactaggcaaggccaatataaccatattgcgtcgcaaacacaacctattaggccaccaaatacaccaccaaatcaacataggcctgataatatggaggaaataattagtgggattattatggataaattcaggattgaaactaggaatcgtgctaaggtttaccaaaagtcgtatcctgactattatgataatgtgctgtttgctgtaattatagagttcccgaatttaccaagtttagtggtgaagattgtagaaccacatgtgagcatgtaggtcaatttttagcacaatgtggtgaggctaatagtgatacttttaaattgcgcttgttttctttatctttgtccggtaccgcttttacatggtttacttctttaccggcaaatttctattcatacttgggctcaattagaacaaagatttcatgattatttctatactggagaaactgagcttaggttatgtgaagaaaaaaatataatgagcctgtcattgattatattaagagatttagggatgttataaaccgatgttatagcttgaatataactgatagagatttggctagtctttaattgctcctcttagagaaagactagatggccaacaatttcttgatgttagtcaacttttgcaaagggctctggctcaggaaagctgggttaaggataataaaaaaattgttagaccatatgagaaaaggcctaatgttaatatgattgattaccttgaggcgagtgatagtgaagataagggtgatcatgatatgtatgttgctgaatggtcatggactaacaaaaacaagccttttgtttgttctaacctaatgccgactcctcgcaaagatcggcaaagtgaggttaaatatagttttgatgtggccaagtgtgataagatctttgattatcttttacaagaaaaacaaattagattatctaaaggccatatcataccatctcaagaagaattgaaacgtcgagcttattgtaaatggcatgattctcattctcatccactaatgattgcaatgtgttttgacgacaggttcaatcggccatagatgaaggacgattgaagttcaccgatggctccaagatgaagcttgatcatgatccttttccggtgaatataattaatttcaatgacaagaaggtgttgattcggcccgagcaagccgaatctactaaggaaaaaggaataatcattggtgaatcaaggccaaagatgatagtgccaaagaagccggaggttggtgttttgaaagagaataaaagcgaagcttcgacttctaaagctcctaggaagaccaaagtgacccttgatatgcttttggagaaatatgaaaagcaaggtggtgagagagcttgcaacaatgggaaaagaccaagatcacctcctagggagcgatttggtcactcgccaagatggttgcattcacctccatatcatcattcacaagacataccatggggtccctatccaatgccgccgctgggttatccttatccttattacatgccatggggggcaacgccgccaatgttcaatcatatgcctccaatacaattcaaccaaaggtggggaggaccaaggaggccaattcatgaacatttgtcttcaccaaacaacggctggttttatggtaagagccgggccagtgaggaaaggagagaaggaaagcgcattaaagtggaggcaaggacttcagaggtaattaccatcaaagtagggtctcatgatgtaccaataccttctggagatgaagttagagagtcctcgagaaaaaaatccgaagccggtaccagctcatcgtagtcggctggtctgaccgggccttctagccggtctgaccgcagccatacggccggtctgaccgggccatcaggccggtctgactgccgacccgacaatggtccgaccgacgcctcaggccggtctgaccgcccaccgaatgttggtctgaccggcgcatctggccggtctgaccggtggtctacgtccggtctgaccgggctccaccgccggtttgataagaggtttgcaaatggcgatgtgagggcttcatcgtcatcaattagacctaatagggggtattatttacctcctggaacagatccgaaacctagttgtcacgcccaaaaatttagcccaaatcttcagactattttgtgtattaaatccctatccaggaccagccagggtacacaaaacgacaagtgatatacagttccaaacgtaaataaagcgtaaaatacttacaaaagaggcacttagtcctcgcaccgaaacaaaagcagcagcagcggaaaaaggctatcctagcggggcttcaagctccactccacaggcaaaactcaactagggtctgagccttggtcctctaacttcgtcttcagctcagaagtactacacttctgaaaagggggaataaaagcaagactgagtccaaccaccgtactcagcaagccacaccaacgatacagatgtgcaaggggatacaaggatggtttgtggctatttgcataaaggcggttgtaaaacattttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaggccgtcgcagggcccgccccgctccatcacgcccacccttgcctggatgcgtcagctagaggtaagctacactacaagcccagccgttgcccacgctggcttgtggtaagtacgataagttcttccagggcatcccgcgaaccggtccttaactaccatgggtgcgaccagcaaaaccatgcacccacagcccaccattcagtcgcattttagttggataattacgaccatgaagcatggccagatgtctcgagcacgcagcttactctgatactaaaaaggtctaatactgtaattatcccatcaactgagctagtggtaattaagcatggctaatcatatagttctaggtaggtcacataagtaacatgagcggcgaagcagataggtaatacctggatcccatgtaattagcaaaacatgcatatttatttgtaaacggtaaaacatttataaattgggatcaacatgctcaaggggaatgtgtgacttgcctttcttcttcacttggatcttctgaactcttatccttgcgaacgcgaacttccgaaacgacggattctacacgctggcacgcaaaacgaggaaaaactctaataaaaaccaaggaaatagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgatgtaattattatttatttttccaaagaaaaagagggttgctggcgtcatcaaaggggaggggcggcgccggcaagcgggccccaccggtcaacggcacaagggggagggcggttcaccgtggaccgggtccacgcgggtggtccactgccggtccacggaaccgacggcccagatcaccctcggggtcgatcggacgggcggcggcgacctggctcggctcaaggccggtcaagcggccacggcgacggcgacggcacgcgcgaacgcgttg

SEQ ID NO: 43104 - DNA, 1181 bp, Oryza sativa
ggtgccaattccggcgacgaaactcgacggggaaggggcggccggggtggagcttagcctcgcgaacccgacggcggcgacggcgcggtgcggcgcgaccctagcggcggctagcggcggccggagtaacggaaacggcggcggcgggtggttgcacggcgcgggagcgatggggagcacgagggagttcggcgagatggggaaaaagcgagagggggcgacggggaagcctaaataggggaggggagccccggatgtggccggtaggggcgggatttcgccggccaacgtggggagtgggggaggagagaggggcgggattcgaaaattgaatcccggccatctcgggcgcggggcgcgggtgcgggcgggagagagagaggagaagtgggtgcgggagatgcggcacacgcgcgggcgtggctgacgtggcctggagaaggcggagacgtggacgcggcggcggttgcgggcgcggcggcgccggctggaggaaggagacgggcccgacaggtggggcccacctgtcggcgtcccggggagagagggaggggcggcttgggctggcccacaaggaggagggtgcgcgcggcggggtggactgggccgacggcccaagaagaggaaaaggagatttttatttgttttctttttattttaattgatgcaatgatctttgtgctattaaaactatttcttgagctccgaaaatttgcggaaaaaatccgcagagtacattagggcacaaagaatattacaaaatattctcggccaatgatttttaaaggaaaatttaatttcctctataatttcacttgattaaattgatttaaattttaatataatttcttgaaatgcattattaattgatttttaattccgaactaaaatcggggcgttacactagtgtcatgaccagaaataacccaacgggcgttccttacgtgcgtgtattattccttgtcccaggaggcaaggtacaccaaaagttgatacaatacagagtttaacaagtggaagcgtaaatagttaatttattacatgggcggcgaaggaccagcacacatgaagacaaacaaaaaacagcggaagactagggcgacgaccacaggcgcttgacggcaggcacgagctagataccaaagcctacatcttataggaactcctcttctgggtttggg

SEQ ID NO: 43105 - DNA, 2618 bp, Oryza sativa
aacaagtggaagcgtaaatagttaatttattacatgggcggcgaaggaccagcacacatgaagacaaacaaaaaacagcggaagactagggcgacgaccacaggcgcttgacggcaggcacgagctagataccaaagcctacatcttataggaactcctcttctgggtttgggaaaaattgagcaagactgagtacaaccaccgtactcaacaagacacacccacgagtgcagaataaatgcaaaggagtacaatggagttataatataggggggttagggtttgcagtaaacagcattaaaagacacttagttgctcaaagctattttgttaatacgatcctagagctatacaatattattaatcaaggccgtggacccacacgaacctgccttaacccaaggcctgcgatgattcaaaccgaactagcaacccgacccagggtcccaactcgtcccaagtcaacccaggccatccattccatattttagttgttcaacaggtgttaagaatttaaaacactaacttaggtacattgctaggcttgcccataaccaaggacgcggctattcgaataggtgatactctgatcagaggtgtacatctttacccacaagacatgtcttcctcacatataaccacgtgccacataccaccacggcatacggacggaagacatgacatagtttccaacccatcctagccatagacaagagtaccgacccaaccccacctacggccggaacctccgggacaggcaggcaggattgagcccctagcagcaggacacccgccctgtgccatgacatctcgactaccgagccgcagctcgtgtagccttcatttgtcctagagatgtccatcgacccccgacttcgtccatctccatccgtgtacttttgtttataaccagactgagtcacaaactaagccttacccactagacatgtggaagtacggtattgctttgcaacagaggcccgaagaccggtccttatgtggccgaggtgctactatcaaaaccatgcaccccgagcccagcctaaaactattttgagggttttgaatagagggggaggtgtgaatccaattccacaatagtccaaccattccacaatgtccaagtgatatgagaattcccaaagtctaaggttataaaaccacctaatgttgcctaattaatcagcgaagcatctacctaagttcatactagtggaaccatgaatagagtacccactagttggggttttgtttatcctagggtgaataagctaataataacaataacaataataataaggtcataacaaaggtaaataggcatggctaaataaaacagtgataacgcgggaatttaaataaagcgataatgcattaacttaaatcaaaataattttataaactgggattcaatatgttcaaggatgatgtgacttgccttgctcgctttcccaaatgtcggcttcaacctccacgtagagcggatcttccgaagctgcagcgtctacacgaccaacggaaaggaaaaaggcttttactctaataaactccatataacaagcaggaacaaagcacaaaaatggttcttgacttcttaaggaaaaattagagacttgaacggtccaattccgagttcaaatgaccaagttatggccatttgaagtatatatgctctttaagtgaatatttgcgaatttctttatttaaattttaatttaaaaaagatttattgcgtcaacccaggggagggggcgcgcggcccgggtccacgggggggtggcgcccacgcggcagcctcacagtccacggtggaccgggcgcacccggctcgcaccggccggcgccgtgggccccacgcgtcagccacacacgaggacgcgaccgctgacggctgggccccatgcggcggccacacggcgcgcccgtaggtggccacgatggtgcagccggcgggaggcggcgcccgcgaccctatggtcgccggcggcggccataggcacggcgaagcggcggccgagagaggggaagggaagggggaaaagaggcggcggtccacggctcaccctaggtcgacggcgacgacgaaaaaggcggccggagcggaggaaggcggcggcgtggctcgggtcgatggggtcggcggcgttccagcggtcggcgagctcggtgagggggtggacggggtcgacggcggtgcggcgaagccggagaaggcgacgccgaggcgggagacagtcccggcaagcggagagggccggccggaggtcgtcggcgacggaggagagagagggcgacggcgcgagctcgtttccggcggggagacggcgcggcaaagggtggaaacgggcgaaggaggtgcggagagggtttaaatagggttggaagggggagagggcggccaggagaggaaggaaaccggccgggaggtccggccgccatcaatggcgccggcgagatttgcgggagcaaatccggccgtttgaatgcgagaaagagagggaaaaatgggggggaaagggggaggggatcacggggagtaattccccccacttaattgcacgcggggacagcgggatgcggcggattcggcggcggcggcggcgcttggtgcgagcggg

SEQ ID NO: 43106 - DNA, 1473 bp, Oryza sativa
aagggataaaaggtccaatgagttgcgaccaccaccggtatggaggcgtaaaaccatagagaaggaaaaaccggttgttgtagagaagaaggaagaacaattggttgctaaagatgagtcatctcctaaagaagacatggatatcaacatggtatgtatgttgcctatggaattttttgctatggatgaagccgaggttgctcacttttcactaggtcctaaagatgcagtttttgagaagcccgatgaatcaaaccgtcatatgaagcctctctatctcaaaggtcatattgatggaaagccggtctctaggatgcttgtggatggaggtgccactgtgaatttgatgccatactcgttgttcaagaagttggggcatggagatgatgagttgaagaagactaacatgattctcaatggcttcaatggtgaaccaacggaggcaaagggtatcttttcagcggagcttaccgtggggaacaagacgttaccaaccgctttcttcatcgtcgatgtgcaaggtaactacaatgttattttgggtcgttgttggatccatgccaattgttgtgtgccttctaccttgcatcaatgtttaattcaatgggacagcgatgatgttgaaattgtttaagcggatacatcggccgaggttgcaatggccgatgctacttttgagtggtgtcatgggaaatattcaatgctatgattttattagtatctccaatggcaaatttgtacatatatctgtaaagctggctagtgtagcatggctaagccatataaatttgtataatgagtaaagagactaatttagagtggttacaaaagagggtgcaagaatatcggtctacaaagaacgatattggtgaaactattgaagattttgatgaagtggagaagcttggacaagggtttatatcggccgatccattggaggaagtagacataggtgatggaaccaaaccaaggctgacttttgtaaacaaaaatatgagagtcgattataaggttaagataatcgagctacttaaagagtatgttgattgctttgcatgggagtaccatgagatgccgggtcttagccgtgagcatgttgagcatcggcttccaattaaaccgggttttaggccttataagcaaccacctcgtcgttttaatcctttgctatatgactgagtcaaagaggagattgatcagttgttgaaggcggggtttattaggccatgtcgttatgcggagtgggtttctagtatagtcccggtggagaagaagggcagtggtaagattagagtttgcatagattttagagatttaaataaagccactcccaaagatgaatatcttatgcctatagccgacatgatgatcaatgatgcttcgggtcataaggtgattagctttttagatggtagtgctggctataatcaaatttttatggcggaggaggatatgtacaagacggcttttagg

SEQ ID NO: 43107 - DNA, 6680 bp, Oryza sativa
ttgccaattttgataattttgctattagacatattgctaggcatgataattctagagcaaatgacttggcacaacaagcatctggctataatgtgaagaaatgattatttctgatattagaagagcaggtgcttgattttaaatctttgtgtgaaattggcaaaactagagaccaggggtggtctgaccggccacatgccgtcggtctgaccggcgaccccgagtggtctgaccggttcaatcaatttagaggccgaattaattataaattcgaacatttgtgcctaggaaacagaggaagattggaggattcatttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtacatgaggaatttgtagagctcatcaatcggcccacaagatgaattggttgcttaggagagctggattttattggccaaggatgattgatgattgcttcaaatattatagaggatgttaagcttgtcaacagttcagcaatgttcaattggcgcccgccgccatgttgaatcctataatcaaaccatggtcgttccaaggttgggctttggatttcattggtcaaatttatcattcgtcattaaaggggcataggttcgtgctagttgctacagattacttcaccaagtgggctgaagctgtgccgttgaagaatacgactcatacggaggtatttgactttattttgaagcatgttatccatagattcggtattccacaaacattaactacggatcaaggtgcttcttttatatctaaggaagtgaagaattttgccgaatcctatggtattaaattgttgagttcttctccttactacgcttaggctaatggacaagccgagtcgagtaataagacattgttgaaactagtgaaaaagaagattgaggaacacccaaagaggtggcatgaagtgctttccgaaccattttgggcgcataggatatctaaatatggtgccactaaagtcactccttttgagttggtttatggtcaagaagccattttaccggttaaggtaaatcttggttctcttcgttatatcaagcaagatgatttgtgaagtgaagattataagacgttgatgggagacaaccttgatgaagtcatcgacaagcgcttgaaggctttggaagagatagagaaagagaagagggtggccaaggcgtacaacaagagggtgaaagcaaagttgtttcaagttggagacttggtttggaagacaattttgcctttggttactcgatccagagagttcggtaagtggtctcctagttgggagggtccttatcgagtatgcagcattgttcgaggaaacgcatattttttggagacacttcaaggggagtgttttcagcgagcaatcaacgggaagtacttgaagaaatacttcccgagcgtttggcaaaacgcttaaggaggtactatggccagtacttggattatcgtcctaagaccaaaacatgttctacgcttttagattcacgttgttcatcaaaaaggcaggggggcatgtgtttacacccaaatttggcacctaggattaaaatagggaaaattgccaaaatttggaagtctatcggtttccttcgagtgggccggtctgaccgccggttgagggccggtcagacaggcggtgtgtggccggtctgaccggcaggtccgagtccgactgtgtttcatcgtgtctcgaggtttacttgctcgggaaggcatgtttcgggtttcctttagtttctaccccgagttggacgtggaggagggcttgtagagggcaagactaacctctatataagggacatggccggttctattgtaagaaaccaatctacaatcaatcaatcgaatcattttttcatattgcttttagttttctcttagtttgtccatctttatcggtttgcgccgtaaaccgtctgccgccgctgcgagagtgtgatatctctttgtaggtttgtcctgaaaaccttccgttttgcccacgagatgggtagttatcttaaatcggcttcgctagcctgtttatttgtcaaaacccatctagatttagctctttgctagatcgaggtggttggtgactctaggatcactgcaaggcataaggtgctgcaatcgttgttgtcaacttatctcaaaaagttgccaacagtacgtatgtgttttttttgctttattgatctttattcatagtacgtctgtgcgtaggtttatatatttttcttcagacgaacagcaggtacgtctttgcgtacgtctgtacttctttgtttttaagtcgtacgtacgtatgtagtacttgcagttatggcagttatagttctaccgtatacatatagagattaaggaattagtttcttaaaataaaatatatcatattaggtaatttaagtgaaaatcgacgttggatttgacagtgccacgtggtagttttggagcgtttgtagaagtgccatatggcagtttaagagtgtttataaaaagtttaatgaacttttagtatataatagatagatattttttatataacaaatagattttgccttcatagcgcaagaaagcagaggtatcaagcagaaacaagaaccagagtatagttaagcttgtcgatgaatgtcatttttttttaattgtatgcccttcatgacctgatctgcagagatgggataaactcaagattgtatatgttctattgaataagaattacatgatctattatgtatatttgtgattaaagtattcttatttctcatttgagcaatatctaatcaatgattttgtataaatgttgtaaaaaatcttagacatatcctttgtttgaaatttcaaactgtacatttgacctttaattgtcagtgtatacaaacagttagtcttgttttgatgcataactccttcaattgacatatataatttatttctataataaaaaggggtattgcatattaaataaagcatcttatcatataatttttggatttctatttttgacttcttgaatacataataacatggtatttggatcttcgaaacatttttttttctgtgtttatcaccactgtgttcatatgaaaagtcaccatagcgttagcacgggcattttactagtaatataaaaagtaccagttatttagttggattaacacagtgattgcgattagcactggattaacactgtgatcagcacacgaagcaaaatcaacattatcaatggtaaaatcaggtacatattcatgtgtccattgtgcatatagaagtgcaataagaattttattgcacatctcattcattttttcaagaatgttggactgattttcaaagtgaccaatacattttaactctataccattgtttctgtctatagtaccatgcttcttagtgctatgcctattttcatatatcgttctcatattatatacagcattccattgtataacggttcatttttcattttattagtggctgccaaactgatggacaaccttcttgtggtgagcaacccatatagtctgataagctcaatctgcctcacacttcttccatggccacagaaacagctagccaggtaggataccaacattttcgtgtttaccaacattttgttcagctttcactgatatagctaatatatttgttgtcacttcctgtagatgaaagaaactgtatctgctgatgctaaaaagaaaaggtatgcttctatatactgcagagctagctaagtcatgtgtgttctttacctttcacgcacatttcctttcctattatcattgctgaatatcctttttcccttttcttcagcgctgcttcggctcctgcaaccacccgcacccctaaaatccaggcacagaagcgaacctaaactctgaaatggtactgggtatgcacctagcacccataagttcttaactcattggatgacatattattgacaaggaaactttacactaatggcatgttctatttagcactttaaatatgcaaatgaaaaaactatcagagagtgatgatgacatgtatttacaaactgtttgcatttaatttcagaagcaaactaagtataaggatgctccacccactgcaattgatcttttcaaggagtgccattgcaaaagcaagatgggttttaatgagcctgtaaagaatgttattgtgagttacttttttcttttatcttttgcaattatattttaatgagaatgaaatgtgttttgtgatttcttatcttcctgttgctaggctgtgatagaagttatcattgataatcctgcacaagaagggcaagatatgattggactttgtagatatggtcagtgatgtagaactttgttttgctatctaggatatggtggtactgttgttttgctcaccgactgaacctagtttgctctcatactgtatttggaatgtgtctggttttggatgttaactaggttgtaagatttatgttgtattggatgttcgtcgggttgtgctatatgggttgttatcgtgtttgattgttgggcatatatgggcttagcccacttattatttgatattaatataaatgaatatattatgacgggctcaaaatggtgtggtacaatgtttgggcctttatgggcttttgcaatggacttgtcacattttgcaacgtgacgaaaaattcaatgtttgtgacgtaaatgaagcgtcatctatcataagatctctagtactgccacctttagcaacgatgccatcatcgtggcaatataggggatttcctatagcatccaatatgtttcggtggcaatagaagtacccacctatagcccctgttgatatttcttacccaaattactagaaatatattttccagcaatgacgcataaatattcctggtatattatggttatagagtttatccgcaagcgcacggatataccattgtagcatttcacccgagagtattccaagggtatcatatttattttatcccgtgggaagatcatatagagagaacttgactaataatttatatattacttgtaataatcatattctaagcaggggttaaaataatccaagggtagagtgacacacaagcagtagttactcattctcataatatattatctaagctaagtggaaagaaaagagaaagataatctattcctatacttctaatatacatagtatacatacattctagctaacctatatactagctaataccctctattcgatgccctcctggtactccgagaagccacccctaacagccgagttccttacgacagcccaccatgaccatacaaccggggctaaatacggaggaataccctccccaggaaattaacttaggattatatacacgcgcggaggaatacccgtactgagctgtcaccatcagcggcccacctctcatccgcagcatataaccccaaataatgatatcccgtaatctagacaccatgtctaaactaccagatactactctaatatcatcgtaatgacatagagtaattgcataagcaaacattatacccgcaccaaagcatctcccagataagctagccgtatatttagtataacatgaacataatgtaaagtaggcattcatatactcggaaagtatttcaataccataaatgtatatagaagagtattctaataaaattacaaagcttagaaaagaggaaaggaaagctactagagccatacccgaactcttccgaagacttccggactcctgatttctactctattcctattccactagctagatactactaaactaaacttgagagaatatgagagagctcttgcttgaggtgtgtgagtgaagttagaaggtcagggtttatatagccttccaatgacggttgtgatggttggaatggtcggaaataccctccaaccgtcattgggagctaatccacaccgtccagaagaaaccctgcatccagcggcccaaccagcccatggtttggctggcggcctcctctgttgttagacatgtgaattttggcctagtttgtcgtgtcaattctaagttcttggcccattcatatataagtctggttctcgacatcgtccgatcgatttatcgtttgagttgatgtcgattctcctccactttatggttattctctgtaaaaaggttagtaaacctaatactagtggaatattattattctaacatgtatatgtattgcaagtatcaatagttctcctttattttggtaatattgacggtcgaaactgatcgataatgaccgtcaacagccactaaaactttaatcgtggcaatagcagtgcccacttgcagcaataacaaaaaaaatatagtggcgatagaagtggccacctatagccaccaaaccaataagcgtagcaataccgatgcccacctatagcaaccgaaaaaattcaagtggcaatagaggtgcacacttgtagcaaccaaacaattctagtggcaatataggtacccacttgtagcaaccaaatattttgagtggcaatagagggtccaactatagcaagagacatgtgtagcgtggcaatagtgggatctatc

SEQ ID NO: 43108 - DNA, 878 bp, Oryza sativa
  unsure (1)..(878): unsure at all n locations
nnnnnnnnnnnnnnnnnnnnnnnnnnnnnnnnnnnnnnnnnnnnnnnnnnnnnnnnnnnnnnntgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacgaagaacacaactcgtagagggcaacgtggcgaact

SEQ ID NO: 43109 - DNA, 1136 bp, Oryza sativa
atgcattaggactttctcaaaaggcatatatagaaaaggtgttgaagaaattcaacaagtacagatgcgatgcgacacctgctcctatagtgaaaggcgaaaagtatggggcatcccaatgtcccagaaattagtatgagctcaatgaagggaaaacaaagccatatgcgtcagctataggaagcctacagtacgcgaaagtgtgcacacgatctgacttggcatttgttacctggttacttggcagatttcagagtaatccaggcccagagcactggaaattggtaaagaaagtcttgcgttatttgcaaggaacaaaaggcctcatgctgtcttacagaagatcagaatcactccagatagtggggtattcagattttgactttgaaaagataatacaaagtcaacatcgggatacgtgtttaccttggcaggaggagctatttcatagaaaagctcaaaacagactatcactgcagggtctactatgtatgccgagtttatagcatgctatgaggcaaatgaggcaacggggcaggtgaactggctaaagaagttcatacccggtttaaaggtggttgacagtattaagaaaccactaaagttatactgcgataacaaacccgcggtaatgtatgctcacaacaatcagtcaagtggtgctgccaaacacattgacataaagtactatgttgtgaaggacaaagtctgggatcaaacaatcagtctcgagcacattagaacagaaaggatgctcgcggatccgctcacgaaaggcctaccacccaacatgttcaaggaacatgtagctggcatgggtttaagggaagccttatgaatcctggactacagggcccaaaagtaaaagtatctgtttctgaatagagatatgtatagtggctgtcgaatccatcggtgattgaccgtgacgatgaaacatgctctatttacaaatctgtgatggaatagaaaaagctaaaagaaatagtgagatcaagggggagaatgttagatagatctcccatccgtcgggcccaacggcacaacggaccttgaccgcgccctgttcgggggcggccagtccaatagctggtgggcccccgtcacactgagcgccatataaaaggggtggaggt

SEQ ID NO: 43110 - DNA, 1431 bp, Oryza sativa
cctctcccttttcaatctctattgttcaaacatcaacccaaatagaaccacctgacctagatctaacctaggtgatcctagagcaaagtttaacaggccatagttctcggatatactacagggtgacggagtcacaggccgccgtacgcgttgagctcttcctgggccgatcgacctggttgggctgatggaatctgggatttttggttttctctataactgtgttgggttgtatgcccatatcacctccattcgagttgtatgcaccgggagcgtacaatgtttaccagaaataactgtgttggtctttcttgtccggtcagtcgcccaagatgcttagttcgtccatttggttctgtatggtcgttagactttttaacatggaatttattttctgcctcttagagcatctccaacagatatataaaattagaaacataaaaatcctattttggggacagcccaaaataaaaaaggcccaaaatacaatccttctccaagagatgcctaaaatattggttctcaaaattttaaaatttgccacatcatcattagtgggccttttcaactaattttctacccgctcgttaaaattgcctgcgagcgcggagggggcgatcgcaatgcgcacggaggactggacctggactacttggtcgatcgtgatcctagtcgcgcgggagatcacgagttagcaagtacaaattaaccagtcagcaacagcgagtgagatagtcaagcagggtacggcagcgagcagcaaggattggtgacaggcacaagcccttgtgcgtttgaaccattctagcacaggtagcaaaattttgctaacaatgctttgttgtatttcatttttttatgtttctgatctgacaatgtttttatggaaaaaaacttaatttgatatgatgaataaatatttggaaaaaaacgaaaagtctagctgatcctctacatggcagtgtcatcaatctgcaggttaaaattatagacgaccatcatgttaggattttcttctatcaatcacgttttttttttatattttgatctgacaatatcgctaggtgagaacttatttagttgtgatgtttaatggttggccagttgatttgatccgtgatgagtcgtcctcgctcctcgtatcaacggcttgtggatgaatcatcgtccgacgatgatgattttctttggggggcgcaacactaaacctgcatcgctattgacactttgatgatgcaccaaaacactgtgtgtctatgatgggacatgaagtggttgatgcaaaagaagaagcacgtcaattgagattataccaagaccatttttctgataatcctacctatagcccagttttattcaggcacaggtttgtattaagccaatttaatttgatctatctttattatatgaatagatacgtatgccttatta

SEQ ID NO: 43111 - DNA, 746 bp, Oryza sativa
  unsure (1)..(746): unsure at all n locations
gatcattcttcggcgcaaagatcatcggggcgattctgaaagaaaatccagatcctaattctggtgtcggttcttcagagagatattgggggcctgtcattgttgggtgatggacttggctacattgctgatttagtggaaattttgctgccaagtcgcctatccgtgaaggaggtcttcgtctccaagaactcattgtcctctgagacagagttggctaggctgcagggtctgtgcttgccatgtcctagctctgcccctctagccactcatagcagtgagctcagcttagcaaaagcaaccagctatgaaagagtgttgctgtgcaaggcagtgttgccattctactccttgtactacactgctaagtgtgctgtggactctgagactgttactcaaagtttagtgttgtttagttcatttatagggttgcatcttattgcctaattcaaaaatttctgttttgttccatgtttgatgtaaccagtgctcttctcttctatacaagtactaattgaacttcacagttctctctttgttgcatcttgcagacttttcgcatgacgcttttcttttattcttgctatgctgttcgccctttcttgtccatatattttatttttaattatttatatagtttttgagtagattacaatactttggtagtattgctcctttcattttgagatgtttaaggggtgctcggctnnnnnnnnnnnnnnnnnnnnnnnnnnnnnnnnnnnnnn

SEQ ID NO: 43112 - DNA, 1525 bp, Oryza sativa
ttcaaatatcgaatcaaatgaatcctccaatcttcctctgtttcctaggcacaaatgttcgaatttataattaattcggcctctaaattgattgaaccggtcagaccactcggggtcgccggtcagaccgacggcatgtggccggtcagaccacccctggtctctagttttgccaatttcacacaaagatttaaaatcaagcacctgctcttctaatatcagaaataatcatttcttcacattatagccagatgcttgttgtgccaagtcatttgctctagaattatcatgcctagcaatatgtctaatagcaaaattatcaaaattggcaataatatccaaacatgaatcgaggtacttatttagtgatctgtccaagcatttataaactccggcgacttgttgcaccaccaattccgaatcaccaaaagctttcacgtactaggcaaaactacccctatgccttgaccttctttgcaagaagaaccatcaaaataaatcctccaaggtataacttcaactaggcaaatctcttcctcataagcaatatctacatgatggtccactataaaatcacatacaatttggcctttcatagattttaatggttcataagccaaataatattctatcaaagcatatgcccgcttgccaattctcccacttagaattggcctttgcaacatgtgtttaataacatcggcttgacaagcaactatgcatgtactagataacaaataatgcctcaatttggtacaagcatagtataagcataaacaaagtctctcaataaagacataccttgtttcgacatctaaaagacggcggctcaaatatgtaatgatatattccttgccatcttcctcttgcgtcaaaacggcaccaatgactttgtcttcggaggcaatatataaccgaaaaggttttccggctttaggcgctcgcacaacgggtaaagtagacaaatacctcttcaactcctcaaacgcctcttgttgttttggctcccaagtaaaatcggcttcttttttcaagagaagtataggaacaaaagcatcgattttacctgctaggttagaaataaatcatctcaaataattcaccttacctagcaacttttgaacttccttcttgcatgtcggcgctttgaaatcacgaattttttctatcttcttaggattgatctcaactcctctctcatgcaccatgaatcctaagaacttccccgccgacacaccaaaagcacatttaagtgggttcatcttcaaaccataccggcgcatcctctcaaaagctaatctcaaattggctatgtgtcattccataccatccgatttgacaacaacatcatcaatatagatcactaagataatacctagcaaatcatgaaatatcaaattcattgccctttgatatgttgcactgacgttcttcaatccaaaagtcatgacaacccactcaaacaaacccacaaattccgggcacctaaaagccgtcttgtacatatcctcctccgccataaaaa

SEQ ID NO: 43113 - DNA, 5308 bp, Oryza sativa
  unsure (1)..(5308): unsure at all n locations
nnnnnnnnnnnnnnnnnnnnnnnnnnnnnnnnnnnnnnnnnnnnnnnnnnnnnnnnnnnnnnnnnnntatgaactcttcattatatgttctcccagggatagcaatggctgtagcggcctcaagagtattcccggagcgtccaatgggaacgtgcaatctgcagggtgtattctccttgaggtcatcgaaggggtaatctggctcaggttctttggtttcggggcgaggtaaaagcatgtgcttgacgcagaaatccatcatttgcctttgaaaatccgcagccccatcatctctaagtttatccttgtacgcatcacgcttcttgtgggggtcatgtttgaacccttccttccaactcatcttggacgacacacctcgaaccctacccccatgctcaggagtacccaacaccgtacttagcacatctttctccctcttaggcttgaaaaatcctttcttctgtgaactggataaattctctattttatcggcaacaccctgcagctccggatcttgaaacgatactttgccttcattcgtgatctttggagttcaagctcttacccaattccttgatctctgtgtccattcctccattggtaccggaagccccgccttcctcatttcctcctcctcttttgtccactgctccacctttggtgcgtatcccgtggagcctaagtgatgaggaaatttgtatttcttggccaactctgaatacttttggctccttcgaatttcttccggggagtttttcaacgtcagaaagtcctcccactgtttcggggttatgttggcatacgtcgaaaacggtgtacgtcccgtcttcacaaatttcttgttcaaggtggttttccaaccatgccaagacttggccattgtttgcagagcacaattcctcactgctgcctctaatccatccggggactggaagattttctttaactctttccataggacttccttatccctattcgatacatgatcccagtccttgaccctgatggggatcttttcccttactattatgccgcactgtgaactgaatttcgcatgtgctgtcttagaggcgagcggctctccttttggcgaaacatgggtaacaacatggaacccttcatcccttctattcacgcttctctcgcccttccttttctttgcctttgctgaccgctcgcttttctttaagccggttgtgttagctggtacctcgtcgtctttcgacggatcttttttcttcggctgcccttttgatcgccgtggcgccgtttcctacgagaaggtatatatcaaagtttcgaattagctcgggctaatagttatcatggtgaactgtttacatattaagtttatttaccccttctatagggggaatgtagtccttgtcgccttcttcaccgttgccctttttccttctcttcgggcttgggctttgacaaggatcgcttggcaatgagtactcattgtcttcatcagctacgtcgctgtcggaactatcttccggtgggaccgttggttctggagcaaccacaacagcaagcgactgctcttcctcccctaaactcttctcttcagtccctttattactatcggccatcgtttcaaacttctaacataaaaaataaactgtatattaacaataggccatatattaacactcagcaaaaatagtttaaaaaatttataagtactgtactatgacatattgcaaacatatcctccacattttaaattactcaaattagtacaaacaactttgtataaaatttgaaatgttattattaagtagtgcactaattcacaataacatttcctcaacatgttgtttaaataaaaaataaattgtatattaacaatatacaatatgcacaaatttaagtactgtactagtttgtgtacataattgcgaaatgttattaattagtacaaactaatttgctaaattaattagtacaaacatatttgtacaaaatttgatttgttattattaagtagtgcactaattcccaattacatttcctcgacatgttgtttaaaaaaaattaaaaaggcaaacatatcctccacattttataaaaaaaaattaacatacccttgcacatgttattaaacaaatttgacaaattcacatatcctgcaaaatagaacataccctcccaatttcattcacatatcacccacattcccaaattcacattcacaatcaacatataacccctcattcacatttctcccacccctcattcccattcacacccacatgcacacacatatatacctctcacacccacatgcacacacatataaaaagaaacacccacatgcacacacgtctgtggacgacgaatggccgacgacgagcttcggtcgtggacgacgaacgaaaggccgacaacgaggttcggccatggatgacgaccagccgatgaagccgttcggccgaggacgtcttcactcgtgtacgatgaaaggccgatgaagccgttcggccgtgagactgctactgcgagagagagagagagatggtggcggcggccgtggagcggccggcggcggtggagagaccggcggcgtggtggaggggccgggggggggagcggccggcggcggttgatgggccggcggcggcgtagcggtggagcggcggcagaggcgcgcggtcggtggagcacggtggtggagcgtccggcggcggcgatgcggccggcagcgggagcggttggtggtaaagctggatcgacggctagcggcgcggtggagcgcgcgcccggtgcgagctcgaaggtcggcggcgcgcggaggacgacggtcggagggtgaaggtcgcaggcgggcggcggcggaggacgggggaggcgaaaaaatttggcagcctgacggtgccaaaatttctagggttcccgcctggacttagaaattttggtgccgcgagcttgtccttctatagggaaacgatcttcgtaggcggacggtccgcctgcgaagatgtaaaccctattcggcataactatcttcgtaggcggaccgcccgcctgcgaagatttttacagtgttgagtatatttatttcataataattattaattaatttttgtgatttgaaattgtctacagtagttttaataaaaatggtaattgtacatacaaatagacaaaccttaggactactacttttcaaatgtaaatattacttcaatgtttgaaacattaatattactactttaaaaaaaacatatagtagcaattttttatgtggtaagtgaacataaaaaattgctcgggctaaatttttaagcctcttttaaataaaacttttaaaatataaaaaaatgtaaatgttaccctacaaatggtaattgcacataaaaaatagtacaaactaatatgcaaaatgttgagtgcaaatgttcgtcaatttgcgatataatcacacatcaccttatataccactattacataactactaacttcttagatgcttacatgcgactcaacaatcattaccctttaacattttttcccacaccgtccgtgcgcatgtaaggcttcatggtcttctaagtagatgtctcaacattcttaatcttctgtacaaactgactataaagtggcatactatcatattgattgtaatcttcgacatcttcaaccccatccactcccaatatcttttgtttcccgggtagcactatatctttcttaaaatttgaagggtctttcacataaaacacttgtgccacgcgattggcgagtacccaagagtcatccttgtaacccacactcgctaggtcaacaacagtaaggccgaacttatcaacattgaccccgttcgggtattttacccactggcacatgaatatggtgaattgcattgtgtgcccatagtcgatttcccatatttattcaataaacccaaagtatgattgtttttccccggctttatcaattacctccacacggacaccgctattttgtgtacatgttttattatctcgggctcttgtactaaacgagtatccattaatgtcatatccctgccaagaatttactgtagttgatggaccacaagccaaccgcttcatagttatttcatcggtagtttgtccctcaagcaagtctaggtctcgcaaccaatctatgaagagtcgcttgtgttctttcattatctactcggtggtgcgacccttattgttagctcgtattagttcgatatgttgttcgatgtaaggctcaacgatagcaaactgatgaaggacgctgaagtgagcttcttggaatgatttgtgatcatgggtgatgaatctcttctttcctatcgttcccttgccactcaatctgccctcgtgtcggggcacaggtactccaattgcatatccatctttgaggtaatcgatacagcactcgacaacctcttcagtattataaccctcaaccattgatccttctggatgtgcacgatttcgaatataacccttcaaaaccaccatgtaacgctcgtatgaccacatttgatggaggtacaataagccaagggcaaccatctgcggcactatgtgaacaatgaagtgctccatcatatcaaaaaatgacagagggaaacacatctcaagttggcactgtgtctcttgtgcgaatgcacggagacttcctaactctttgagactaatgaccttctgtgacactgcgttgaaaaagtagcacaatcttgtgatagcaacctttaaatgctccggttttatggcctttattgcaattgcaagaaacacagtgagcaagacatgacagtcgtgtgaattataaccagatactgacaaatctttcatggaaactagtcgactgatgtttgatgagaaacctatgggcactctgacatcacggagtgacttgcaaaatgacttcttcaccgcaggagttagtgtgaaacaggccggtggaagatatactttgccattcttctctccttctttagggtgtaactcttccctaattcccatctcgactaggaccatccttgattgcagaacatctttagtcttcttcggcatgtccaacaatgttccaactatgttgtcaaacacattcttttctagatgcataacatttatggcatgccgaacctccagatctttccagtacgggaggtacttaaagaatatggaatgcttcttgaatgggggagggagtttatcatctggcttcgaactatcatcttacttcttactatcccctggtttcatagttttctcgggtttcttgcgctttgtcccctttgatggtttcttagtcacttttccaaactcgcaaacaa

SEQ ID NO: 43114 - DNA, 1311 bp, Oryza sativa
aaaaaaggaaatataacaaagaattgttagcaaaattttgcaacctgtgctagaatggtttaaaggcacgagtgcttgtgactgtcaccaatccttgcagctcactgccgttgcctgctttgagtatctctcactcgccgtcgttccctggtttatacttgctcacacgtgatctcccgcgcgactaggatcacgatcgaccaggtccagtcctccacgcgcattgcgatctcctcaccacgcgctcgcgcgcgattttagcgagcgcctagaaaattagttgagaaggcccactaatgatgatgtggtaaattttaaaattttgggaaccaatattttaggcatcttttaaaggagtgtattttgggtcaaatatttttttttctgtccccaatataggatatgtggggttttaattttgtacatctgttggagatgctcttagggtgggatcattttcccctctttattcttcttctcttctaaaagaaatgaagcgcaattctcttgtgctttagggggacaaaaaaggtttatcagaaatactatcccaacgcgcattatactctagtttagaggctaagagtcaaacatgggctttatctaaataaaaattaatctaactgtctaccgacttggaacctgcatgatacttttttaagaaaaaaaaaactttagggtctgcactaaagctcaatattttgcacaaaacaggtgaaaaataccaccatgtaatatttcaagatgaaccaacacaatatgtgcttggatgagccagtttttagataaaaatctattggagaaggcccattaggcgtagaaaaatagtacccctccattttaacttttcgcacaacgtttgaccatacgtcttattaaaaaaaattaaaaccgagggagaaactcccattgagcccacacccaggagtcctcagccaacaaggccgatcaatgagcactccactcttcccacttccacggcgtctactggtgttcgttcgcccttccacttgttgatctattttgattattatttctgacgctttgacaaattgatcaattttgagttctcttttcctgctaggtagctatcatgatctctctctctgtttttttttggaaaatacatattttcaccggtaatccatgcatctcccaaacaatcaaaattaccggggttttctatcttcgctggtatttttcgttaacacaaaattatagttatcttacactggcagcgaatggccgtccccttctgcgttcgttgctactgatgggaactaatctgtattgcatgtaaaatagagcgac

SEQ ID NO: 43115 - DNA, 9406 bp, Oryza sativa
ataccgtttaggaagcgtgcgcatgtgaaaccgagagggagtgagttggattacggaagtatcggacacagcccagggtactgcggcaccagatcaattaagcttgacgccgtggcaatgttggctcgtggaggcttgcttcccggcccgtgtcccatctactgctcccagtgtcccatctacagctgagccctgaagtttcatactgtgctggcgtgtgaaaaagcacacaagagctctaacgatggtgtcgagctgtgaaaacaagctaccatgatcaagacgttttccagatacagctcattcctaggcctcaatttcacacatggtactagacacgtagttttggcatcgaattggtcttgctcgatcatctccgcgatgttaatttgtgtgcatggcgtatgggacgagtgataaactgatcatgttgagagggagcggaagatgggatatatatagatacatgggtaggtgaactagtgaatatggctatgtgaacgactgatcgttgatgcatcacataaatgagcttctggaaaaaaagatgtcttccatcacaacattaatttgtccttacaggatttgtacagaaaagatgtttcttcccatgaaaaaaaaagactaatattatcgatagaacatggaaaatctatattaatggcataatatatgcaaaatccaaaaataaattggtggagacggagctaaagctgaagctagagccgtctctgccaatgtcaatccatgctggtgctgccatctctattgtcacatgacttttcatgcctgcgtcaattgtctgtatgcccaggatttggttggaatctattgctgaattcctgtacccgttgatctattttgatcactgtcgatgcaatactcacgctttgatcaattgtttttgagttctcgatccctgctaggcaatcattttttttttttgaaaatgcatgtttcactggtaatccatttcccaacggctagattaccagggatttccattccactggcatctttctagacaacgaaaattatagttacactttaattacgacggtagagatattgagaattcccaagccgtctctcagtctgtaagttgaaattggacctccattattaaaattatttccctccaatgtgatccctatgcatagcaatgaaattaactatataagttaccatagttcataatggacatacactcatacaacttccattatctgcattaatgggataaattgtctgcatgaaggaatccttatcgagtgagggtctgatggagtgcacaccacatggcatgagttgcaggcttgtctccttaacccattgtaacttataaaaaacagataaaatttcaagattaaacaaattacattaattgagtgtcactcttagccaatgtgtgcacgtgggcgcccctgcccatggcactgaggcaccgcttcaagagattgatgcaacaactacatgagctcgatgtcttagaggttcaatcccaggtccagcacactgaggagccctggaaggtcactaagcaggcacgcgaaacaacacaaacgaagtgaaaccaccatagcaagctgtgcagataaactatcacggtgaagacgttttcctcatacaactcattcctagccgacctttatttttttcacttatactcatgtcgcttttgcatcactcggtatgagactgtgaatgtatgatcatcatgttgagagggagtggaaggtggatatatatatatagatatatgtgaacacatggttaattaggtgaatcggtgaagggtgcgcagctcaactggttaggtttttgtggcggaaccagattcaaatcctagattttacatgtgtgctcgtatttacggctaattattctttcagtggttcaaatcctagatgttatatgtgtgctcgtatttacggctaattattctttcagtggtaagcaacgtatccgttgacaacacttgtagtgacttggtcaatctcaagatatgccggcccaatttttcagaggtactcatatagatagggtgaacatgtgtgcgttcatatgggtgagcgggcacctgcgtttgtattgtgtttctattaaaaaaagtgaaccattgaatatggttatgtgattgtgcatggatgacataaatatatataatcagcttcattgaaaaaggttgcgtatgtccatcactgcattaatcgctttttcgtggctaacacaaaatcacctaatgatttgcggtgtaatcaacagagtcgccaaaatcgatagatcaaaacctgactttgagaataattcactttcgtagaataacacgactaatttacaagtaaattagcaaagataaatattgtacttacacgatgacgaacgactagtttcggagcaaattagcaaaggataacctcctcactttcgtggagaaacacgaccgtttttcagcgcaaaacagtaaagattaactaaattctagggttgtcagaactcagccgtaaaaacaaaatagaaaataacaaaatagtagattgataatttttgggggttctcaatctaatcagcaatgcgctatatatatagcagtctggtctttggtgtcctatccaaataataggaatattaacatatctgtaaaatacgttgcctaccgcgtgaagatccgcctggcgttttttggtcttcatcctggatgcagttttaccaatccggttgtattctctgcacacaaattccagaccatgtcttctgctacgttctcatcgtctcgtgcgatcagccggtcagatgtaaccaacacaattcgtcgtcaaccaccactgccgctccggccgcatataatctacttgcacacaactgcataccatctacttgcatctccatcgaggcgtcaactccaggcaaggcatcgactgcacctttgcatgcacacaacactgatgcgctccatctccaagcagagtcaactgctgcaataacttagtgatttgcaaacacaatcttccagtgcattactgattcctgcacctgcacccacacccacactaaatttgacctttcaaggaaaccactcaaaaatacaccagctattcaaaataatctgacctactaaaataaaactaactctttgccaaattatgacacaaacagctacattcttacatataagatatttcctcccatggaaaaattcgcactattatcgatagaacatggaaagtgtgtattatatatgtcataatgtttgcacaaaatgtaaaaataaatgaaccaaatatattctaaaaaaatattttcgtgagtaaaaaatcttgcaacagtaattaaactaagataaaaaagaaaccccaaaaatgtaaagaataatgatatttgtaacaccagaatatattgtaaccagtaaaatatactcaaggtacgtaaacttaggtgatgggtgtaaacaagtagaacaacttgtgtatttagtgagaatgacgtatgcaaaatcagagaacttgtgtattctgtaatatatgcaaaatctaaaaataaattaaacggtttaatgctgcaaattattaaacttgccaagaacagtaattaaataatgcaaaacgttaaataattgtgaatacacacataaacaataccatgtataataatggaatatgactattttgctgtaaaacataggttccttgaaataaaatgcaacaaatggtgtttgtgttacacagatgcctaaaaacctcagttcttacaaaatttacacaaaacataaattttatggcccgtgcgatgtacaggtcattgactagataaccctaacaacaatacctaccaaaccacatgttaaaaggattagtccattttattcctctcaattgttgtgtttgtctaaaatacaaccctcaactataaaatcggatattgaaccctctcaactctcaaatcatttaaattcactccctcagagcaaacataggtgacactttcctacatgatgcttaggtggcatctactcagcaaaacgtgttaaaataaactaggacccacttgtcatcctcctctctcttttccgcccctagatccccaagctgtcccctttctctccctctctcacttgctcggatcggagatcgctctcatggaaaatgcagttgctgcagggaggagcccgatggcggaagcactcagaggttgaggtggtggcgagcacttatatttttagtctcactaatagcactaaaatttagtactattgatgaacaccttaaacaaattatgtttactctatacaataaataaactcaagacacaaaagaaaattttttttatcaccttcatttctttcactcattccctaaaggatgccaagtgtagatctcaactggctacattgtagtaattatataggagtattcattattcagttaaggtggtccgagtaagaggttatcattgacaatagagcttaactggcctacttgctgataaaattatgctccacactcatcttgaggagcacgactataataatgtgggacccatgaatcaaggcactagagaaaactccttagcggctaagttggcttcacccgatcgtcaaaggagaattcatataaaagtttaattattttatcctattaattggtagaagcggtatttttaaatatttatatataaatttggacgcctgtgagacatgggcacttggtatgatgtggagattatcttcttatggtattaatgatgtatagggtttatttttgcatacagctgcaattccatctattaaaaagacactcatatttcaagacaataataataagttgtggtgaatgatgaatttatatataaccaggataaagtgatttttggttggatatgattgctattctgatcatttagtatatatcaaaatctatggtctatttcttatagatatggcttcttttagtattccttttatagacaactagaaaggaagcccgtgcagatgcacaggcatcttatttattgattatataaataatactaagagaattaagtcatatctcaccatatatatataacaaattatagattttgcctcgtagtaataaaaaattatgttgtgaaatagaccgtagactttaatataaatgataagaatgtctcttagatttaatcaaaattcacttttgtccaggtaagtgtaaactctcctattatcaccattacttattatcattgttcttaaaacatagatatgattttaataaatggaactccatctaaaccaccaaaataagtctaatacatcattaatacataaaactttatttcaattatttacctaaatgtttatgccaacacttatttctaaatctacggataagtattctaaaactaactcttctattggttattaggatagcaccgttaaaaaatagacatgcccctctaatggggggaaccatcaagattccttcaagcatgggtcgacatagtcgtgcctctcacagcctcacgaccattgtggagcacaattttaattaatcctagttcactatcgacacccttaaagactattgcaccagtaagtaggaagttaaacactattatcaatggtggcctccactgagcctgcctcaagtcaaccatatgtgtgccccatgctatagttgtggtatccatgctcggtgccctctagggaaacaaagagaagatggatatgatgcaaatagttatttggttcttcccataaaatatagtttctttatgttttgtttagacacaattttgtttatggtgttaatcaaaactgcttaatttttatggtacaaatacaatgtcatctttagaaatgagtgaagttgatcactaaaaatatatatagctaaacaaacacgtgaccgtgacaatgttcagattattatatcattgtttatattttgacaaagatctatattttagcatcttgtttgttttcatcacctattgtccataattgcatgagacacctttactaattctaaaattgtatttatttcccaaaattatttataataactaatttgttgaggtgcacttatagttatgtcactgtggtttatggcattacattcatcaattatcacttatgaccattatattataattcctctactataagagaaaatatcatgaatagtttcatgctcatgttataggattgttcatttgttatcaaacctatttggcaaagaaaaaacgtatatgaccataattcttgtgatagattaaggggtcgtattatagcaagatcattgcctgagcataccaatccaatagttatgaaaaataaaaataaactttgagaatctcaatctcacacaaacaaaaattaaatcagatataattaaaaaacataatgttgtttcatttttcatgcatgtagatttcagttagtgttatataattgttaagtgatatttgaccataaattatgatgtgaaattattttgaagattatcatgagattaattattatatgccacctaaattatttaaaaaagtattatgatattgcttattatatgttagctccaggtgctataatgtatttagttataatataactattatatgttatcaagatttgaatacacctgattataagttgactatagaatttaaaaataatctaaaaaactttgtgtgtaaacacatttaatttgttttttatatttatctagtttaacttgcatttttatttttggagtaataaattttattttatggtatagaaaatcctatttttaaaatcatctatattttttcgatggttctaccaacttatattagtattatttgggctttatagctttattatcatgtgttcatatgtttctttgcttttttcaatcgaacattgctaaatggtttctctcgtatgcatgagacgttgaacacatgatattatctatatatgcaaaatatatagaccaacttatattatcgatagaacattgaaaatgtgtattaatggcataaaatatatgcaaaatctaaaaataaatcagtggagacagagctgaagctggagccgtctccgccaatttcaatccatgctggtgctgccatctctattgtcacatgacttttcatgccagcctcaattgtcggtatgcccatgatttggttagaatctgttgctgaattttagtacccgttgatctatttttatcattatcaatgcaatactcacgctttgacgaattgattttgagttctccgtcattgctaggcaatcattttttatttttttttgaaaatgcatgtttcgctggtaatccatttcccaaacggccagtttaccagggatttccattccactggtatctttgtagataacgaaaatcacagttgcactttaattactacggtaagatatacagaattcccaagcagtccctcagtctttaagttgaaattggatctccattactaaaatcataacccccccccccccaatgtgatccctatgcatagcaatgaaattaaccatataagttggcacagttcaaaatggacatacactcatacagcttccattatctgcattaatgggacaaattgtctgcatcaaggaatcctgatcgagtgagggtctagtggggtgcacaccacatggcttgagttgtaggcttgtcaccttaaccccttttaattaattaaaagaacagataaaatttcaagattaaacaaattacatcaattaagtgtaacttttagcgtacagctacgtgacctcgagccctccatgtcttacaggttgcaatcctatgctcagttcactgatgaggcctggaaggtcactaagcaggcgcacgaaacagcacaaacgaggtgaaaccaccatagcaagctgtgcagaaaaactatcacggtgaagacgttttcctcatacaactcattcctaggccggcctcttttttttcaacttatactcttgtcgctttggcatcactcggtatgagaatgtgaatgtactgatgatcatgttgagagggagtggatagtggatatatatagatatatgcgtccacaggtgtaccatcgaaggatgcgtagcttaactggtttggttacctgtggttgaacaagtccacccatgttcaaatccaaaatttaacatgggtactcgtatttacggttaattatgtccatcattgcataatttgtacttgctagattcctaacaataatacgtacccaaaccatgggtacttgcttacgtggtgcttaggttgcatctactcagcaaaacatgttaaaaaaaaactaggacccacttaggggtggatagcgagccagctcggctcggctcggtctagctcgttaggataacgaactggctcggctcggctcggttcattatcctaacgagctagaaaccaagctcggctcggctcgtttgaaagcttgagctggctcgttcggcttgcgagccaaaccaacaacccagctccatggcagactcgcagtaagcagcggcgtgcatggcgagatggcgggtggcggcggcgcagagagtggcgggcggtggcggcagagagtgcttggtgcggtgggcggtggtgctcccgcggcggcggcgccgatggccatggggttggcggcgttgagttccttcggtggacggtgactgaggagtggccggatgcggcggcggaggccggtaggtggctggtggcggcggtggcggctggcggctggcgcaggagcgtggcggcagcgcttggcggtggtggctggcgggtgacggttggtggcggcgcttggcggtggcggttggcgggtggtggctggtggcggggaggatgagaacgagagaaggggattgatcggaattggccacaccagatcgggatcgggatcagtcactagtgttttttgctcccgagttgggctgttgggcctccattctctgccaaaatccaattccaaaggcccacagctcatgtgccctggctcattaaggcttgcgagcggctcgcgatccagcttgagctggctcgttatctctcagctcgttaggaaaatcaaacgagccgagtcaagcttgtcacgagccgagcgagctaacgagccacaagcttcctgtccacccctagacccacttgtcacccacctctctcatttcctcccctagatccccgagctgtcccttttctctccctctctcgcatgctcggatcgaagatcgctcttgtggcaaatgaagttgcagtagtgacaacggagggagaagccggcggagaggagggatggaccctcaaggtggagcccgtggcggaagcacttggaggttgaggtgggggcaagcactgatagcccaaggtggtggctgagcacaagtaatccaacagtgagctcgaggtggtggagctcg

SEQ ID NO: 43116 - DNA, 11171 bp, Oryza sativa
  unsure (1)..(11171): unsure at all n locations
ggcaatgggtgctgagctcactgacctagtgcaaagttctagcttgagtgaggatccaatccgatccgctccgaatcagtccgaagtgaggatatgaaaagggtttgtagatatccgacggatatggattcggttgtgaatatgtagccggatgtggtattggtaatatccggtagatgtggattatccgatagactgttttgtagataatccggtttttatttgactatgcgaccactctattggcactacttaacatcagctagcaaattgtgacttattagttctagtattttatttgtctatacaattggacattatttatggacctgcaatagggctatgtgtcatatgatattatgatatgtgatgtcctgtgtgaattaagtgcttcttttggacaataaacatgataatcagttaatgtgatattgtgatttgtgctgtcatttgtcccatgttgtagatgtgtcatgtgattttattattaagggcttgtgaaatattatatcattattgtcttgatgcatgttgaattgatgactgaatgttatattggtttaatatacatgccaaatctaatgatttgaatctgtttcccagccaagtccgcaccggcttcacaccctttccgacatgcagaacaatccatttcgcatccgcacccgctccgaatctgctttaataatatggtttaggatatagtatgataactatccatccaaattctatccatttcgatgaaacagagaggagaggaggaagaagtggcattgactgccgcacaaacgaaaccacttcgatactgtgaaaaccacctgtttcttcgttgagaggggttgaataccctgttttggagttgaagggtgttagcagagagatacaataattgaggagggtaaaatgtacctattcctattcccatgtaaaatgctgcattgtcactaccatgcctcctcatgccaccacccatgttataaagaaaaacctttaattataaaacttttcaagattatttttacaatgataaactaaaggactctttcggactaaatcctgcgcacacttgttggtttggcaactccacatctcagagggaatttcatgaggtaccaagaggtaccgaaatttccaaagtgaatttcggtaacttctaatacatacaaggatccaaattttagactagaaatagaaaatgtgatatgcctcttaggttctcctcgaggatcataaaatcactcatcttactttgggacattcttacccctgtccatgccatgtgacaccaaatcgatcccagtgcatactaagcccaacagcagcatcgagatcatcatgcctgattgcctgacatcgcacccaagaggtggtctttcctatttggagtattttggtaggtatctcactgtcacatcacatatatacatttgatttgggcggctaattaacgtcgttgtactgtagttgttgttacaatacacaagcaggtggactctctctgagacactgcacattctgaacaattatcatcccaaaaaccacttgatttctttgcacactctctcgatcgatcgcttcttcacctgcgcttcctcctccccttcgcgtagctcacactggtacgcgggacgaagctcggaatgcagcaatggctccactgctcgccgttgccggcgccgcaggaggagcccgtccgggagatggcgcaagcagggccgtcgtagcaggtgaacgattcttgcctctcccggaggaggtcggcgagtcgcattgtcgtcgccggcgacggcggcgttggctgcgtctcctgcggtggtggtggcggcctcagcggctcggccttcaagatggcacccagtgtgggcagcttgcgaggttcaagttgtatcgcatggttgctggagttcgttctgaatgatcttgcaggggtgccatctgatgatgcacaaatcagatgaaaatgaaatgttatttcatatttgaaccaggctgaaatgaagatttggttgggggatgaagttgaatcaaatcaaagactagatatggataaatatctgaatgttatgttcaggcaatgtaacaccctgatttccatgcaaccatgaaagcaaccgtttcagtaaattgatttctgtcaagtcagtcgttttatccaaaaacccaaatgaaatgtcagattcgagttttgaagtttgagtatgcctccgtagtaaaattcatttaaaagccctacataccacgactcgcacaaacaataaaatgctattgatatttgaaacatgcagcagtaaatatttggttggggtaaatcctagaatggaaaaatatgtatcaggatgaagctgaatcaaaccaaagattagatatagacaaaaatctaactgttctgtttctgaattaactttttctttcacacatgtaatatttttcgttacctccattgatactgtagaattcatcctcgcagtcagactctaaccaagggcaagcttcaaagaaaacctcatctctgctgctagctgcacaggtcaatcaagaagttaatactctgaaagctacagagaactaaacagtgaccagcattgaatcagtccaagaacaataatgttcaaaacatgagctgctcaactgcccattggacctggattgtgtgccactaaggaaggatgtgtgcatgcttcctgccctctctaactagaatcatcaagagatgcagagaagtgtcagcaactgatcacctctctctgattatattttttttcggtgcttgatttcttcaggggaccatatcatttctggtgtgaaagacatggatggaatgatctctcttaacgaactgcgtttacattaattatgtcgtgtccgtactttggtactgaaacactcaaatcacaggaaaactgataactgaacttccatcgtcaaaatcactcaaatcacaggaaaactgatagctgaacttccatcgtcaaaatggattttgcaagggatttccatgttcgtgatagccgaaattgatggattgatagataatctgatttttgtgatagctatttgagggtagaaatgtatgaattaactactataaagttgaaaaatgtttcagaaaaatattctctgaattttttctatataattttttttgcacgaaacgcgaagattggaaagcgtgcaacaaaagttcaaaatccaaaatcagaaaaagtagtggattgtcgatcagtactggatcatgtttttgctgaaactagataatcatactttctcttaaacaggaagaaaataaagtgcttggcagcttgtgcttcaggtttgctgatcattggctagtgtgtcaacccagacagatagcactaaactgggcaattagtttccagatttacgcatacattgactatcatcttaattcttaataatatatttggatatcattaaaattcaatgatacttatctacatatcatatgtcatttcagagatcttccactaaaacattgaatttggccataaccactttgtaatggaattgacagatgacatcgattgaaaacgtattgtggtcatggccttatcttctcttttgtgaaacaaaatccagtatatttaaggaaagaaaaacattctacaattgggacatgattatttcaagtccctcagcatgctcaaagtgacactgggataattaattactggagtatcttagatgtagaactgtgataaactactactcgagttaatttgcaccatcttagatatagaactgaacaagcaagctggcggggctttaactttatatatgtccgagcaacagaagcaaatctgacataagaaacacctgaatcaaaatacagtgcaaccatttgtaagccattcaatcaactttttgaaaataagatattacccttttcacaataacaacaatacagtatgatcgctaactcgaaagcacaagtacagatcactaaagccaccgaaactattgcaatagcacaaacattcataaagattcgccaaacaacaacgacgacgatgacgacaacaacaactgcaataacaagaatgcgaagaactccaagatcagaacagaacaaacgtaagaagaacagaagacatttaccatagccagcttctcccaggggcatgttatcatcaggtgccacttgcctgttgttggaaccaacagcaacagtctccacatttgcagcaatcttctccttggattgcaatggagttgaagagcccttcttggccttggaactctttcctctcccaatcagcctcatgcctcccctgcaactcctattcctggatgaatagtagctactgctattttgcaaggtcaaacctgaacatgagttcagaaatgagattgacaatttggagggggagagagagagagagatgattagtttaagtgaggagagaatatactatggggtggtggagtggactaatggggtgtatataaagcaaagcagcagaagagacggatcttgacttggggaattgtgtaaaatcaagggagagagagagagatgcaaattcagataattggtctcattttgagtggcagcttggagaagagatgggatggatggatgcaggatatttatggttgggtagcttgcttgaaagctaatcctgtggaggccagcgaccttgtaaggtggtgctgcaggtctgtaagaactggtgaagaggacagctgatgaaattcaggtcgggtgatgatacattgacgatgttgcaattgtgtgtagaaacttcgtactaccccatcccaaactatagtaacttaaccatatatttagatatatgcttgtctatgtttattgctaaaaattatattttgtgacagaacaaatagatagtcagcggacacatctttcatgtgatatttattttgtggtatgttgttatattttttttcgtattcctgtttgtgtaccatcatttctgcaaaggttgccatcagtccatcgactctgccaagcacacaacaaagcatagtacgtccacatgtcctactgtgactttatattaaaagtaaaacagtataagctgctacagtgtactacttttgttttacttgtcatttatggcattaacacggtcatccacacgtttcttttgaaatcttttctgttcatatatgtatataatcattaaaaatattagctatatgaaagtatttttttcattaaaaatataccaatgttatttactcatatcgattcttaatataacaatattgtttgacatattagtgatttaaggtcttaccattcttttgctgtgaagtaaactgttaaaatcatataatctgacttgactgctcagtagcgtatcaagaagaattagtggtctgaataaactagataaagatataatcccatttacatgtatgtatgacaaaaagttttagtgagaatttcataggagcttccatgatcctattgtcagtagtagtggaggctcgagctcccgtcgctcctatgctagatccaccctgtgactgtttgtagtctaaaacttaaaatagaatgaaactactatgagacagttatgttcacttgtcccactctgagttttgatggtacaaatttagttctccctctatcgcataaagcgtaatttttttgccattggtaaacaaaataagagtgagggtaaaagaccaaaatgtcagcaataccgcagtggtaaataaagggaaattaaggggtatttaaaggataaaatttgtcaatttgtgagcgagaataggcggtaggaaggtagaaatagactatttttgttacaaagtagaggatagcatgaaatgaattcatctttcttcagatactcgtacactaatcatctgtgacgtactagatgattgtcctttgtataaccattattgctttctgcatccaaggggcctgctgcgaggccttggctgtggcagctgcgcagttgcggctacaattgcagccagtgcagccgagcaccccttaaacatctcaaaatgaaaggagcaatactaccaaagtattgtaatctactcaaaaactatataaataattaaaaataaaatatatggacaagaaagggcgaacagcatagcaagaataaaagaaaagcgtcatgcgaaaagtctgcaagatgcaacaaagagagaactgtgaagttcaattagtacttgtatagaagagaagagcactggttacatcaaacatggaacaaaacagaaatttttgaattaggcaataagatgcaaccctataaatgaactaaacaacactaaactttgagtaacagttctcagagtccacagcacacttagcagtgtagtacaaggagtagaatggcaacactgccttgcacagcaacactctttcatagctggttgcttttgctaagctgagctcactgctatgagtggctagaggggcagagctaggacatggcaagcacagaccctgcagcctagccaactctgtctcagaggacaatgagttcttggagacgaagacctccttcacggataggcgacttggcagcaaaatttccactaaatcagcaatgtagccaagtccatcacccaacaatgacagccccccaatatctctctgaagaaccgtacaccagaatttaggatctggattttctttcagaatcgccccgatgatctttgcgccgaagaatgatccgttcagcttcgcggcgatcgattttcctgctgccaccagcctagggttctcctggacatctgtgccggcgaaggcatgcgctttgaagaagaaccagtactctgggcagggcaaaaacttcagtttgataggctgcactgttccaattgtagtgacatgcttgttgctggttgtgactatgatcttgctaccttgtttgccacaactcaggcttttcaggagctcctcaagcatgttcttcttgtgtatgtcaacatcctcgaaaacaatcaagaacctcttgttgaagaaactctgctccagttcatgtagtggatcatctgaatttccaacatctccgatgacatgtttaggccgtagaacaggctttggttcacacatctccatcttgtaggtgtgtgagaaattgaacagcaagattgttgtgaagtggctgcgcaccctagcatcatcacaggcatgctgtactagggtggtcttcccgaccccgatatcgcctagaatcggaagaacaccaagttttcctcttggtagatcatcctcatgcagcaagaagttgatgatcatctcctttttgacatgtcggccgaacatctgcccctcgatgaagatgttggtagctagaggccgatgaatcggctggcaggcctgaaggagcatcatgaactccttgagatcaccacacatgctctgcaagctctcaaccaccctatcaatctcatcaacaccgatgtcgtggcgagacagtatgttcctcacggtgaaagccgcgacgcgcacacgctttgcaggattgaacttggacaaggagaaaggcttgggatctacctcatcgcgattcttgtcatcaagatcaggctccccgcatccgatcgtgtcgagcaagtaacggccttggtatgcgccatcgatgagctccgagagccactcgagggtgccatggttggtgatctgcctccctttggcctcctcaactacgctatggatcttgatcagcatgcggcatatcctctgtaacttgacttcagtgctgtgatctccattgaaattactgacaacaagggatatcactctgccgatcacatcgccaacaattgccgagaagattgcttctgccatcggtgaaagtgtttagcagatggtgtaggaatctctttggaagaagccaacggatgtgtgatgtgtgtggttgaatgtcataacttttgacgaatctaagctggtgataaaagtcaagatgagaaccaataatattatcagcagctggcacataacaatattggcctgaaagagacacaaaagacttgggtgcgtgactgcatgtcataagtcttgctttaattcagagtggttttacagtcctaagcaatgatgatatactccctcgagtcacaaatatgtatcattttagactgtaaaaagtcaataagatgtaactttgatgacttcattcttagcataaatcgaaaaattgttgcataagtttaaaattgtaaaatttttgttacttcaaatgtgatcattttcatatgcacaatacctatattcacagagtgattatatttgaagttaacttatgttagaagcctacaaaattagtaggaaaaagtttggtattctaaacgactctaatataatatcataatcacgaaagtaattccaaatataatagagattttttttgatacatcatgagctgagtgatgactgggtagcctagggaaaattgatttttagaacaaactaaaattcccttggtttattgaaagataacagcagaaggatagtaatggatttttgtcagttaaaagcagaggactgtaaaaagtccaggacttccacaagacagctgacacactacgctgccctaataaattaagtttttagcaaccgaattgaccaggaaccttttttcctccctagaaactgattgcgacgaacattcaattaggcatcagtattagattacaatgacaaaagcaggcagctgcgtagatttgttgtcatcattttagtagaagagacctaaaggacagcaacttggaagtaactgacagggccaccactagtatagtaccagtcaattttttttatttttttatttttttgcctttccatctacatcttgctttgtatacaagcaaacctgtcgcttgcgagcattaatgtcttttaaccccttcgttaagtttttggggctgttatttcttccctgctgcaaatggtaaccaaagatggtgacaaccggtggtctgagtcggagccagcaagaacggattacctaccctccttcccatcgtgttgtccctctcaaccagaagaattggaccttcatgtcgtggctggagatctgtgttgcaacctttcgatctactaacaggaaatactccagcaagaagggcaaagtagggatcttagaactcccatcgtcttcccctagctgccatagccagcactttgtatcttttttgctatccgtgatacggcttgcccaagctgaacttgttggttcctattaccaggggtgcagctggaacaaaaagggaaggggtatcattcgcttgctttactctattttagatcaagtttaagctaatatgagtacctgagtttgaagagtgatgctccgatgcaatatacttgaagtattctactccgagcagaattaatctggatcgtatattttaaaggacaggtaagtaatctcctaatatccttacgagagtggtggccgtgacgttctgcgtgacgctggtggcgcgccacggcgcgacggccatggcggcgttcctgatctgcgcccaggtctggctcgccacgtcgctcctcgccggccaggtgagctagctagctacctacctacatagcttagcctacattccgatgatatatgcatggctgcttaattaactttgcttaaattgatcaatcaacctcaggccttgcttgccagcgcgtttgcaaagaaggatcactacaaggtggcggtgaccaccgcccgcgtgctgcaacttgccatcgtcctcggcgtcgggctgacggccttcctcgccaccggcatgtggttcggcgccggcgttttcaccagcgatgccgccgtcatcagcaccatccacaaaggcgttccggtacgatggtcatcataagcaagaacagattaatcttcagatattagtaaacatttttctcatgaacatatctgacgattgtctccaaatcaatcagttcgtcgttggctcgcagacgataagcacgctggccttcgtcttcgacggcaaatggaggggaatggcatcgattaggataggatagggagagggtgaacagttagataatgacagtttacgataatacccctacgtgaattattatcgctggacaaatatagccctccacatttcttctccaataaaatcgggtgggagtagaactagatctcaaccctacgattaaatacgatcaatggcacggattaatttctactccaagtagaaagcaccggagcgagtctcgagtttgaattgagggggtaccggtggacatattgtgaacatagatgaattgtagctaaaaaatttttcttaactggttcctgggcaccctcccccctcctacctagctttgcccctgcctattacatgtggtcaatgatgtcattgtaacaagatagctttcgtggttggatccaatgacaacatcaagctgagaggcttttacttcctgaatgcattgcctcggagaacctattccatgagatgtaggaagaaaacatgttgagtttgagatgaatatgtgaatgtagtcgatgagcaggacttgtagttttcataaatgttagaatagaattatattcggactcatatcataagcactccgataaataaagaggcaacacctaacgtaagtgcatagggactatagcataggcgaaggaatgacttcctggcagcctaactggtgaaatgtcctagttggggatgagcattgtaatcaatgctgtaaaatcaaagtgtgtctggtccttattctgagatgaacaattggcatttgatattattggttttgatatttgaagattattagcgaatggttttggagatgattgatttgtaggtgatgaacaggaactgctgctgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatggnnnnnnnnnnnnnnnnnnnnnnnnnnnnnnnnnnnnnnnnnnnnnnnnnnnnnnnnnnnnnnnnnnn

SEQ ID NO: 43117 - DNA, 5815 bp, Oryza sativa
  unsure (1)..(5815): unsure at all n locations
ttggttttgatatttgaagattattagcgaagtggttttggagatgattgatttgtaggtgatgaacaggaactgctgcgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatggatcgggagtcaacttgggagaagatgacgtccggacgatcaggatatcatgcaggatgcttagactaaagatcaatgcacgtggttggtgaagattccatatggcatacgatggagatattgtgtgcgtatgggatgtggagtcgaatttgaaaatagtccaaatttggtataattggagtatgtaaagtttatttcttatacgggaaggttttctatgggattaggacttctagtacaaggttggttcgtggctttaggctacctatctcaggtatataaagagagggagggtgtgtcctcttggtatcgtttttgagagagttgagttgagagaaaagttagggtttcgagtgtagtcgagattttcgtgaagagtgttgttgttgcactttgtaaacacggagagaagtaataaagtttcaatctattttgagagagatcttcgatttgtgtttgctcgggttcggcggtccaaccggcgggacaccgacggtcagactgacagctattggtatttcttaacgacattactagaaatatgaattcccagcaatggtgtggaaatggccctggtatatttatggttacagaagtaatccgcaagcgcacggatatactattgtagcatttcacccggaagtattccaaggtatcgtatttgtttaatcccaatggaagatttataagaaagagaaatctgctaataacttatatatattacatatatatatatatatatatatatatatatatatatatatatatatatcaaagtctaaacatgggttactttaattatatggtagagtgacacgaagcagaaggacttagattctttcatttaaataattctaggctaatgtggaagaagaatagaaaagtaatcattcctttacttctaatatacactcaactttagtttacatttgctagtgtacagttttattgaccaataccccctaacagtgccctcctagggcttcgagagaccaccccgggttgccgagtttcttacgacaacctgtcatggccgtccaactggggctaaatacggagcagtaacctccccagaaaattgtcttaggaatatatattaacgtagaggaatgcccgtactgagctgtcaccatcagcatcccacttctactgtcccgcatcatatatgcccaattaatgatatataataatctaagcaccatgcttatattgtcaaatattactctgtatcctctagaataatatagagcaatcatttgcatgaacattaaacccacaccattgcacctctctggtaggctagtcacacaactatatcaacacaaatacaatgtaaaaccagtactcagataaagtaaagtaccaaaggtatataaagaagaatattctattaattctggaagtcttacaaaataagaaagaaaaactactagagtcataccgaaatcttctgaagactcgaggactccgagaactatcctattctattccacttagcactagagcactaaactaaacttgagatagagatcaaagcttcttgcttgagtgtgtgatggaatgaagaagtgacccctttatatagcctcccaatgacggttatggcagttgaaattgtcagaaatgccccgcaatagtcattgggagtgcatctgaagcgtccacgtggagggacgaactgaacggccactgtcagggttcggccgaacctgggccggcccagtagacctccagatttggtagaggggttgacaggtaagtcctcatggcgtttatgatagttatggcggtatctaggatggttgcacctgacatgtgggcccctttatccttgagcttgcttaggagtgagtttttcttcatttcttcttcatttatgggctaatctctgcaaacaaataatactctaagtacaagtggaaataaattattctaaaataaatatgcattgcaagcatagctaattctcctttattatagttatattgacgatcgaaattagtctatagcgatcatcaacatacattacctttattctatctcttttgatcaaaatattgtgttagtgactatttctataatattgtctggaaagcttaaaaaaacctaataaatgatattacagccgatgggacatatttagggtttgctttacttaattttcaactcacagccgatctggggaaaccaacataggctagatctactattgatacatcatcggcttatcggccaatcatctatcggttatttaactctgttttcttgatttccttgttggttgtaggataaaaccagctggcatgcccttgacccatgaggcaagccttggacctgaacatgagttaaccagatcgcccaagccgccttgttttccgtcaacaaggttttaacgaggaaacagatgcatcacaatattcaaagtgccatgcactcttttctcccacttcttttccactgggtttcaggtggagtttttgacgaggcatgtgcataattcaaattcgtccaaggggggagtgttatgaaaactattttgttctggacaaattaagatattagtgaaaagcttactgcagaaggaggcatacattggaagccagcttccaagagaagccaacttatgacgtaagctggcttatgagagaaggcaacttacgacgtaaacggcgtaaaccaagtcagcttgtaggagaagccagcttagagtgtaagccatcaacttcctccgccaataaataggaccctgaaggcactacttggaaaagcattatcgcaagcggccgaaaacggtcttcacaggcggggcggccgtccgcctgtaagccaatgactgtgaagatcgccgatcttcgcaagcggtgcggccgtccgcctgtgaagataatttttgcgggcggacgttggctagtccggtccgcctgctaaaataggaatcggccgcctgcaaaaaaaaaaattccgcctgcgaagtttggtaggaaatattggaatttaataataatttgctcgtaaattacttttaaattatttaatagaaattcttgccggtagattattatgtacatatattggaagattatcaaacatttggtactgataaatgtacatatattacataactcaaaagtgttgccaaaaatattacaatatttttttacattgtcacttcaaatacgccatctaattaatacattatggcatagcactgttccactcccaaagatccttgaattcgtcacttgtggctagggcaccctctgggtcgatgaaatctcctttcacatggtagcactcatggtggatgaaatcgcacagatcacgctgaacatttctgatgcctgtatcttcaacgcttgttcgacgttctaatcttggcatctgcatgcattgaagataaacaatatattagtatcataaatatgtgaagctgtctagcacatagtatagatacttacatcctttgcgttagtcctgtacctcccattaactctaaggaattcgcaagcgtaatacccacaaaggaccgttccttgcggttgcttgtgacacttcaggacatatcataaaaaaatagttaaaatttgtaattagtgaaacaattggtatacattaagtgagtggagtattaccggccaataggtacgtactagtagcttctcccttggtcggactgttctccaaccttgaacttgtagtactggtacgcactgtacggatgtcggaccctttcacattaaggaggatattacttataatacattcatataaaaatgcaagagtcataatcacttactactgtaagattattagaaattctttgtatgactgttgtttttaatcgggagggtccaagactaccacggttcagtctttagggtggatgagtaaacagatataatgatcgctaaaataagacatatgcgtagaagataaatgtacgggacgtacttaaaattataagctaccatgacgactctcttattttgaaagtgcaagaaagctcgtccaatgtactgtgcgatagtaatcaacttctccttgtgcaagcccttcttgtattcacctatctcttttgcagtcttgcccttcagctggtcagaccctggtgctagcctcacggtatgttgtgtttggcagatccgagttggatctaagaagccgataggtttcttttttcttcttagtatccatgtattgcatcctacagaagaagtttgttagtaacaatcacatggatttgtattgtacatatttttcatataattaattaaaactcatacttacatgcaccaaacaccgacatagttgacgtccatcttatcccgacgatatatggcatggagatctgagaaatctagccatacgtaaccttgttcgccgaaacaatatgccggtgatcgagctgttatattgcccaagcctttcttactggcctccatgtagaaggtatgttaccttctcatctcccatggtccttccttcagtgcccattccggcaagagtgctttcccatgttcgtacttttctgggcaatcatcagttgcgaagtatgttggcccggctagttcagcggccttctgggggtcatcatctctgagcttggcacgttccttaccccctctaaagacagttaccatgaacttctccttgttctcatctttggtcttggagtcgtggctcctaagcactctaggcacctcagaactggtagtggccttctcagggaccgtggtctgttgcacctcggggtctttcgcaggagaagggtcttcaaatatttctggctctgtaccgtcccattccaatcctggtacttcttctatttctgtcccaactgatgccacaaatttcacctctggttcagccactttaatatccatttggacatccggcactgcaatctccatgggcacctccggcacttcaatctccgatggcacttccggcactagattttccttatgcatctaaggttcctccaccttatcagtcaccttcttcttaggaggtcttgaaggttttcccaaccctggttttggcacctcatgttttcgcgtggcgtcggtgcccaatctaaaggatatgttattcttgtgctagagaattacaagatcgatcgcatccccaagtacggatacaccatctgcagtagggaagtcaatgtcataggactcaaacccttcgtggaccacttgcgtctgcactttggcatatgcagcaggtatgaactcttcattatatgttctcccagggatagcaatggctgtagcggcctcaagagtattcccggagcgtccaatgggaacgtgcaatctgcagggtgtattctccttgaggtcatcgaaggggtaatctggctcaggttctttggtttcggggcgaggtaaaagcatgtgcttgacgcggaaannnnnnnnnnnnnnnnnnnnnnnnnnnnnnnnnnnnnnnnnnnnnnn

SEQ ID NO: 43118 - DNA, 2649 bp, Oryza sativa
ataaaatggaggagaatcgacaataatttgacgatcattcaatcggacgttatcgagaatcaaacatatggatggatgggccaagaactcagaaatgacatgaccaactgagccaaaattcacgagtctgaagtgaggaacagaaaaggaggccatcgaccaaattgtgggccggttgggccacccctgggttcggccgaacctaaccagccgtagcgccaatcgattcaggttttgactagacggctcagatggactccctatgacggttggagggtattaacgacctttccaaccgtcataactcagctataaaaggcattcacctcacttcctccaacacacacctcaagcaagaagaatcaagctctctctctagtttactagtgttctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgattatgacgggttatcgtaagaaactcggcaatcagtgctagcttctcgaagcactaggagggcgttggaaagagggtattagctaagtaatcgtataactaggatgtgtatataatgtgtatgtatattagaagtgtaggaatagattctttctactcttgttgtgtgtcactctaccctatccattatcttaaccactgcttagactttgattattacaagtaaaatataagatattagtatagttctctctattataatctttccacgggattaaacaaatacgatactcttggaatactcttgggtgaaatgctacaatgatatatccatgcgcttgcggatgaattatgtaaccataatataccatgagtatttctacgttattgctaggaattacacttctagtaatgtcgttaacaaataccaacagtcgccttgagtggttggagacagaacagatcatagagtatcattctctcattctttgcttaactcttattccaaaatttttcaaatgattttgcaaataaaatccaagttcctcaaatgattctctcaatcactcgaagtgtatatttattcctcgccaagatattgccttgagcttgcttaggagtgagttttacttcatttcttattcatttatgtgctaatctctgcaaacaaataatactccaagtacaagtggaaatatattattctaaaataaatatgcattgcaagcatattgacggtcgaaactagtctataatgaccgtcaacaacggcatcgcaccgattagaccgacaggaacgtgtcggtcagaccggcggcagcgacaggaggcagaggcgatcgcacggcggttcggctgggagatcaacaccggttagaccagcggcatatgcgcggtcagaccggcggatcaaccccggccagaccgatctacatcggattctagggtaacttttaattccattaaaagtttagattttcggctagtttagttcttgctattcgatcctacaaatgctttaagaatgtaggtttaagatgaacctcgtaacaaaaaaaaccgtattatattatatttatttatttataaataaatgcatgtgcgagatggtgatgagctaaggcaacatttttttcctattgattaggggttaggcagggcagagagtgtgggtggggcgtgggatttggcaagcgaaggggagaaatgcggtgggggaaggggaggcaatctgtcacgcccagaagtttccccctttttccttgctgtaaatatttgttaaataaatcgtctgaagaaattatcttaattaacctagagctaattccataattaataaatgcaattaataatcggaaatagcgtggtggaattgttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgtgctcggcctccttcctttgggccggcccgttcccctttcccctctctccgggacgctgacaggtggggcccacctgtcaggtcgtccccttcctccagccgcccgccccacgacggcaaccgccgccgaaaccgtccacgccgccgccttctccgctccatgccgcgcccccactccacgtccccacgtcgccgccctccccgccattcctgcccgcacgcgcgcccgcaaatgggcggg

SEQ ID NO: 43119 - DNA, 1026 bp, Oryza sativa
cccttcctctcccctttgagccgctgacccgtgggccccgcctgtcggcgccccctggatgaggtcaggcctggatattattgcgcaataattaattaaggactttttctttattagtaaaaacacaatttatcttctaaaatacataagtaattcatccgagctccgtttaagtccattcaagtctcagtaaatcaagaaaaatgcaaagaatctattaaaaatggttttgtttcctgtttctatagtcttatagcatgttttgcttgtgtgctttgtttgtcgcataggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttagattggtgccaccgcaagggtgtcagttaattaaaatattctaaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagaatgggcgtgatggaattggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagggtaccgagctcgaattcgccctat

SEQ ID NO: 43120 - DNA, 9413 bp, Oryza sativa
  unsure (1)..(9413): unsure at all n locations
atacttcggggcatggcnacatgtgtgttatcgtgtcttgtgggtacaattgtacactctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacaatgattggttaatattgattaattactacagctgttttactgcttcaactactgctttgaaatgcctgctttatgcaaaagaacccctagcttcctttggttatatcctgcatcatacctcctcttccggtatgacttgctgagtacagtgggtagtactcagtcttgctctcttttcccccacactagagttgaagttcttctcagttggagccgtctcagagaggttggtttcgtcgctgccgtcaaggtttgcctgtggagtggagtcgcccgctgctgaagtcaagcttcctggtttagctcacttttatctttcccgctgcatttataatcttttatatttttgtaagacgtgggtctgtatgtcaacaattgtcgtttgtgtaccctggctggtcctggacaaggatttaatgcacattcagcttagaaattctggttcgagaatttctgggtgtgacacaatctcacccattcgatctgttatagatgaatattgatcgttggatatgatgaatgaggaatgaggaatgtatcatgtttgtgaagaagaagaagaagaagaagagatagaaaacaattaaactgtttattgcatgccatatagagaggataggctaaggtcactgacaagagggacccgcatgtcatagagaggatgcaatgggtctaccatggatctagtccatagaggaggtccactatggtccatagagatggatgcctaagataaattggccactgttgaccgaaataatctgactattcagatcaattctgatctagtgatgcagagaggtgccacgtggagcctgggtggcagccacagaggacggattagctgataaaatgctgatgtggcaaccatgttggatcaacaaaggcagacccaggagcagcggcacacggcgaacaaaggagcgagacactgaggacaccaatggacaaggaatggtgaggcgacacttaacaacactttggcaaccactgatgaggatgaacggtggccagcgacgggcttcaagggtcaacgacaatgacagtgctctaacaagacttgagaaagaagaggtggtgaccgagtttccctgtgtccttcagatgccgatggcggcttcggcggggatcatcggcgcagctcggctagagacgacgggcagtaggagcacttggaactttcggtggtcttagtcttccgggaagtggaggccggtcgcacggctgctgcagtgccgaaggaggaggtggcattgactgacgattaccggggcaatgatactgctcggccggagcggcgccgatggtggaggagagagaatgagcatgcgggaaggcggctggggtatgggacgagctcggacaaggggatgctatttattagccaaggaggaagtgaccggtggggatttgatagctagaggcagcgaagaaactagggtttatctcgagttgaccaagatggaacagcgacaaaatcagtgggattccctttgagatttttggagatttattaggagaaaagatagaggaggattgatttagtcaaattaaaccatatttcatttatgaagtttccattaaaaaaatttaagcgaataaatatgaatgtgaattttcaaaattaggcaaatttgaaaaagggatgtgacacaacccttggacgagcaacctcctcccttcctcaattcaccaccgcattagtccagtaattaataggagaggggggaatgggagacagatggtggtcactgacatatgggccttacatgggtctagctatatattttttactttttccttagaactgccatgtagtcgtcacatcggtcaaaaatcaagtcaatgtgccatgcatgtgggcactttgtaggacgaaacatacatgcaaactgctcgataagacaaaacaatccagtattgataggcgagcgaggctttctatctggttttgcgggtaagagatgtgaacaagccgggcctatggttgggggaaacaaaatggattcttttcccttcaatatgtccctatgtttgacaacttaggcccaagttgtaattaagggcttcgattagcccccacctccatctagctcgttttgaatcgtcaagaaagtaagtttcttcctctaaagaaatggataaggttttgcaatatggaaggaactaattgcatatctccaaagagagaagtgatcagaacaagaagaaagctggtatggaaactgttcgagataagcacttaggcacggaatctatacatttagcagagctttgatggtccatttgaaaatcgtctatctacaatgagctccaatcgatacatttcgcagagcttcatgaattcgatgaagtagcgttttgctcaaattaggatagaattaatctattaaacgcccctctaaatttatgcatatcaacgttagcaggaaatgaattcttgccttggcatgcaaacgcctcctcgcttatataaacgagtatatctcgtcgtcactcgccactcggtctcctcaaccattcccatttccaaatttacatcattcaacagcgtaatatccatcgaatcagcaatggcgaactactgcaggagcatgacctcccctctctcgagcttcgtcccccgtcctcctcctcatcgtcgtcgccgtgcaatcccaaggtatatattctaagctcgatctggattcatctctgaacttgtaatgtaattcttgacggattacacatttaatttaccacggtgtgtgtgcgtgtatcaatcaactagcatgggcgctggatgcccaggtggcggacgacatggtgccgacgaagccggcgaagccggtggtggtggccatcggtggcggcggcgtagtagggacgttggcggcgccgttgtgcctgcagtgccggtgctgctcgaagacgaacccgagcaactgcgagctcactagctgtagctccaccttcaactgcgaccccgccggcaagtgtaccctcgttcagcagcgctgcggctgctagctgcaagcctagctactgatgctgatgcatgaactgatgcatggttacccatggatagttcgtgttgaaagtataagcttgtatagatttgattcatctcatcaataaatcttggcattaaacaaacgatagcaaacccatagcaatggatggttagatttgattcctactacactactaccaaaaacccagtggggtttatggtaaattggtcctatgtctatacgagaattccatggatcgatcccctagagttttaaactgttccctagagctgctaaagcaacccaagggaagtaaaatatccctgggtgtaggacatagtatagacaggtgttctgctgccaagaaatggcaacaacgacgtctcctagcgaagggaaggattgagaagacggcaaaggagcacgagctctcgtagatggtggtggcgcaagaaatgcaatggcgatcatgcggtgaagctcgccacccaatgacgacgctgagggcaccactcacccgcagttgagggagctcccaacgagaagacgacacaatgtggactagaccagtgaacggtaatggcagactagcgttggtgctcaccgatctataagggtgtaagtagctaacctgcgaaacacacttacgatcaaataaaacacgaaccagtttattttgatatataagcgggttcacggtttacccacttacacccctactcaccaacctacgtgaaaggaaacaaaagagcgacagcaccggtatttatacatggcgagggaggtggacagccgaaagaggaggggtcatagcctcataggaattggaaaaacggataaaagctcatcaagtttattcagtttcgatctggtatttgaagagagagaattatgagggagaggaagagagattagtggggattgatgcaaggaacttcatgacaaagcagaaaccgacgtaacttgaggacgaaaagaaacaacgtggtgctttggtttgtggcaggcggcagcgtgcgtcaaggtgggtcgcatggtggctttgaatttgaaaacggacttgggtgattattatgattcaatttttgatgttgaaggagtgaaaatgtgaaattgacggggagaggaagacattagtgatgggaaataaaagaatagctggtccgaaatagaaatgtttcgtatgtgtgtgtccagggttggaaagttcggaccccctccgatacgatattacttcggccgaaattttaaattttttcataaattttggtaatatttgttcaaattcaactaaattttgttcaaaattttgaaaatttcggaccgaaattttcgaaatttcagcatttcggtgaggccccatcaaatcagcctaaccgatagaattaacatgtgtgtgtcggggggggggggaggggggaggagaatgaaagaacaacagaagaacaggacgtattgggaggaagcaggaaggaaagatgaggaacaggatttctctggaaatttcaaattttggaggatttggaatcgttgagtaattgttctcgaatgtgaaattttagtcaaataactccaattaacaaaagaaagaatactagcacggcattaattaatttatttagtaattaggccatttttatgaagttttctttaagctattttacatgaataaacacgaatttgaatttctaaaattaggcaaatttaaaaatttaaagaacaggacgtgacacaacaagtcggatcagcaaccgcctccctcacccgatccaccaccgcatcgcaacagagaggggagagaggcaaggtaaggataggcaaaactaaggactatcatgatttgttttttctagaacttagaattaatagatatacgaagtatttataatcttgattaaacataaataagttcgactagaagaaagatcaaaatgatttataatataaaattaatttgatttaaaattctaaactgataattgcaaattgtaattgatagcattgagtcttgttttcaacctaaaccctataggtcgtaaataattttgaattcataaatatgagtttcataaattaatagctccctattaatttaattctaaaattaataatttgaaagttataaatgaaatgaaatcttttttatcctaagccgctataaataaccaacatatttaactaaaaactttttatatgtaataataataacaataataataattattattattaaagctcctgaaaagtgtataattaatatatatatatatatatatatattattgttattgttattattattacatataaaaagtttttagttaaatatgttatatatatatatatatatatagagagagaggtatagatagatagatagatagatagatagatagatagatagatagatagatagatagatagatagatagatttacagccctctaaatgtatgcatatggacgttaggaattatattgttccctcggcatgcaacatgtcgtcgctatatataaacgagcacatctcgtcgtccctcgccattcgatctcctcaagcgttggcattcccaagttgttatcattcaacagcgtggtatatatagggatcgaccgaaacagccatggcgaactgccgcaggaggatgacctcccctctctcgagtttggtcgccgtcctcctcatcgtcgtcgccgtgcagtcccgaggtattctaagctcaatctggtttcttctatgaacttgtactgtattttctgacggatcggatgacatttaactgactatgttgtgtgtatgcatgtatatcgatcaattaactagcatgggcgttggatcagctggatgacatggtgccgatgaagacggcgaagccggtggtggtggccatcgccggcggcggcggcagcggcgtagtaggcacgttggcggcgccgttgtgcctgcagtgccggtgctgctcgaaggcgaacccgagcaactgccagctcactagctgcagctccaccttcaactgcgaccctgccggcaagtgcaccctcgtccagcagcgctgcggctgctagctgcattcctagctagccggcgagccgagcgtgagctaatgcattggatgccaaagatagttcttgctgaaagtataagcatgtatatagagatttaatttatgtcatcaataaatcttggcgttaaacaaagacaaactgattaaaaaaatgtggaacttaatataataaatgcgactggtggttctgttctggatgatctctggactccattaaggacgtgtttggttcgtggtgaaggttggataggatatagacatcagatatggtgggtctaattttttatttggttgggtggatatcacaatccagttttttttgttaggtacatgagaatgagaatggattgaatgaaaaacaataacatattaattaatagtaaaatatgttaattatcatgactatagccattctttatactaattaacaacaaaataaactaattatatctaatcaacactaattttgataagttaattactaattaacaacacaatacattaattattgttaatcaattactaatgatcaagattagcaaaggtggatatcctcatccagccgatacacttatctagcatcttcgtggaatatttccttttcaggtcgccctatccacccttgtccaccaaccaaacacactcaaaaactgaatcgtcatctcccatctagggatattcctccaacaaaatacaccctaataggcgcaccaggtatcacgtggacagctcactgtataggatgttggacgatacgccacgggtgagcaacatgggccgtggtgaatggacagtgagaaatcatgcgtagtgcttcccaaaaatctcattcaccattcacccttctaggactttaaaagcgatagttaggtagacctgatctcctgattaccagtgcacgccgacgagtgaaatagactataaatgatgatgaaatacagagatatcggggtatgtgatcagaacaccgtcacggtctccacaactcgtatctgaaccagataagtcgcacataaccataccaaattttataccactctaatgcatgcactgggcaatccgatgcactcgctagacatgtcattcgtttctactacaaaacgaagccacgtatgtgtgagcacaaagagtcaattattttttatgaggcaaagctatcgagcgctcgtgccttcctcaacaatgtatattccccatgtgttagtgtgtatgtgcaatgggaagcagatcctttgacttaactgcacatgcagttgagtcactggcatatgggtcccactttgctatggcccacatgtcagtgactcaactgcacagcagttaagtcagaggatccctttccatgtgcaatgatatagcaaaatacaccaaactagtacgctaaccgcctttattatttacaagcaaagtgtcagtgcattccaataaaaaatacgaaaaaaggtaggaaaagaaatagagcgtggttagaaaacggtcgagacgaggtgattgttgggaaaattgactctcagtatggaaaccgggagacaatcacacacgttgcttttccacccattacccatgcgagattaacgcgattaattcatagttatttccataataacgcattaacgtgattggtcatgcatgaacattccttttgggattacccccgatacccacagcgccatataaaaagggaacgccagcgtcgtgtcatggtgacgatcgctacacgatcatctcgttctcgataacactaactaatctcgatcctttactaagtgctgaagggtcatcaaacggcggtaccatgccagtgcaggtggcaccccgaaggacgtcgccatcttgcaattgatcgccggcaatccctacagatcaagccggtgaccttacctaccccgctgctacgactactttctctacaccgaacaccggagcggttcgaggaactgctatctctacatccactccggccatcggcaacctcaggacaactacggcatccatggcttccaataatggtcagtcaccctaagtttctgtattatggtgatcatgttaggctaagcacttatgatttagcctcatgatcccatcatcccatttagaagccataagatgcatctaagcctctatctattgagtgtcggtttgatgcaaaatttggtttcgatttatgttagttagtccttaattatcatcagattatgattagttaggttcgattcggttttaatttcttgatgcccatgactaattaaatttgtgtctgcattttaagatcgattactgcttgggtagaaattaggaggagaattgcagcggataaccaaaatctctaattttcacaaatgctaattcaagaaaatccccaaattagaacccaaaaattccccacaatccctgcaaatccctaagaggataagattgatgtcttaccgattcctcgaatcataacgcgagcaccgctgtgcacgcaacccgccgttgtcatggatcggccttgcgcctactctcatgggccatgcaaggttgagactcaccgtcatgttttgccgcacgtggaggacaatcgagattgcactgttgcactagcattagccttgctacgcactcaccgtcacgatatttgactagggctcctacggcaccagtgtgttgcacgagcaccgggtaactcggtcggccacgaccccttcgttgcacgctgctgggcaccacaaccaccgcctcgcacatcgccggcactccgatgcctcacccgattcgccgctgttgtcgccattaggagtagaagaaaggggattggaagaaaggaaatgggttttagggctagggttttggccaatcggccatttttctcaatccaatattatctttcattttgctctatgatgaagttttactccttgtctggaaataataatgttttaatttatttacatagataatatgcatagcttaaagtgaagagaaacattgtggatagaagcaccacaaagtataatctcgagagacacacgacaaagtccagtcgatacaaagacttcacagtcgcacacaatgattatgaaggatatagcttgagaatggcaaaactctcgcacaaaagttcccatgtaggaattggaagatgagaaaagcatactcaccacc

SEQ ID NO: 43121 - DNA, 7257 bp, Oryza sativa
  unsure (1)..(7257): unsure at all n locations
nnnnnnnnnnnnnnnnnnnnnnnnnnnnnnnnnnnnnnnnnnnnntagatgtcgtactatgcactaactcgcaaacccgctataccgagcactggacgaatcatgctgcgctagcaacgcgccatgctactccgaccatgcgccataattgcatcggttgtataccttgtggtcgctccgaccatgcgccataattgcatcggttgtataccatgtagttgctttggtcacgcataccaccgaaccttcgatgtgcatcaaactgagcattacattaattcccacatatcttgaaaggtatgctcgaaaaagaaacggtaatactcacatacatatttagtcctttgaaaggatcatccgatacataatgcgcttatgaaatagctgcaattgtgtctatttgacactacgctcttcccaaaccaatctagcaagatcacacatattggcacctgcacaatgagaaaaagcactaggtaccggaaattggtaatgaaacctattatgggcaatattctcttcatacaacagaaactcattggcattgacctatggttgaaaatcaacctgcaagttgacctatagttgataatgaatggctaaagatatttttggattgagcactcgcatacaagtattaaaagccccaaaccaagatgatgatccgaatatcatcatataaaaaataaaagctcactcttttggaacgagtttaagataaaattgggagaaacctatgttgcttaggcctgtaagcctacaacatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagattgtactctttttctcttggataagttttgtcacgcccggaatttctatccaaaattccaaacgcttacatgtgtgtgaaccctcgtccaggaatcagccgaggcacacaataacaaattgataatagagtacaattatcactctaattaataagcgaataaaatgtcattacagaggtagatagttcctctcaatcaataaagatctaagcagcggaaaaaataagataaacgacgcagacgactccactccacaggcagcttgactagggctacacctaatcctccacaccatcagcatcactgtagaactcctcctctgatgaatgattgcaaggtgagtatatgacatactcagcaagccacgcagcaaatatgcaagtgcacaggataacaaaggatggcataggagggtttcatttgcataaacagcatttaataaacatttcagaatttaataaaacagttaagtaataattaaacaatattaatccaatgctatacaacataccctgttgcataggcccaaccattctgaacaaccatcccggctgcacagttctatctccaaaccaggaatataccattccaaaccaggagctaatcaaattattaccagttatagcatcttttattatgatgagaagtgtgagactaatcacgaaagacattgttagacccgcccttaaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaccaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacggagacaccaactcgtagagggcaacgtggcgaacttaccggtgaccaaaacaacggcggaagatcaacggacggcgacggcgtcgaggaagaagcggcggtaaccttcggcttgacaacgacggcggtgctccggcgacctacggcgacggcgaaggggtggacgagatcggcgacggcttggtgaccacgacggcgacctcctcgagcagcgacgacgaccggagcgacggcggcgcacggctggagctgcggcggcgacggcggcgctaggctacacgatgctagggctctaccggcgacgagaggcgaaggcgagggtggcggcgggtagcgacgggcttgggggtccttttataggggctaggaggcagcgttggaggcccacggtgaccggcgacggcgaaggaaggtctagggttcggggagagagacgaatccgattcgagatcgaatccacggatttccaaacgattttagccgacgattccaaaagaggaaaggtagagatcccgaagatcatttcccctctattgatttcaccggaaacggaaaggcgtggccgaatttggaaggagatgacggcggcgcggcgatagggctcgggcggcggcagcggcgcgaggaagacgaagactgacaggtgggccccacctgtcagcgggcggacgcgcgcgcgggcggctgctgccggattgggccgactgggccgagggagagagagaggttttgggccgactttcggcccaaagccaaaagacttttaaaaacctttttcaatttaaattattcatgaaatgcaattccatttattaaaaatacttccttagctcaaataaatcccagaaaaatctaggaattatagaattaagcaaagtatttaatgaaattttatctggcctcattttatattggaatttattaattaaaactagatcttctcttctaggctttttaaaataaattctaataattccaattaaacaacaatttatatatttaggatttttagggtgtgacaagttttcctctagtttcttattaagggttttaatgaggcaattcgtgcgacatactcccttcgtactcgtaaaggaaatcgttttagacagcgacatggtgtatagaacacaactttgacttcttgtttctataaaaatatttattgaaaagtgatatatgtatacttttatgaaggtatttttcaagataaatctatcgatataatttttacattttcaaactcaataacttgagagttattcatgatttatattcttaaggtttgacttaaacattgtactaaacgacttcctttacgagtacggagggagtatatgcgtacgctatgtactatttctccaatttatccgactgggtttttttgaagctttaatagggcatagacatcacacggtgagtgtcaagggggagtccatgaaggcctagtctaaatacactaattggacccatcaccgaaccttgcatatttgcgaatgcattatataaaaagaggaggggccagtcatttgtacacttggtgaatggattgaataagacaagagagtctcacctctagactttgtatctccactttatacactgaattatacaaccttgttggactactctgtagcatggggttatataatatgttgaaaaaagaaaaaaatagatgaaattattaaattaaatggataatagttgtacttatttaagacaaacggtacgtgaaaaaaaataaatctacgccgaaaatagctactccctcattgctttctactacgcgtttgcgccgttgcatactctccttcacgtccctccctgtctccctatttgccaatttgccacagcatacaaaactcgaaccacgacgagagatcgaccagtgggtccgacacgaaaaccagagagccacgtcaccgatccgccgtctccgtcttcgcgcgcacctccctccctccctcccaaaccgaaaactccgcccgtcttcccgccgcttccggatccaccgaaatccccgacgcgcatcctccgccgtccgtcccatcgcatccgacggcccacgtccacgatccgcgtgatcgcctcccattggctagccacccgcacccaccacccaaaaccaaccctatatatatatctctctctcgcccccgaccactaacatcgtctcatccgccgcctcccctcgcctcgccgcgcgcttcctccgcctccgccgccgcgtcgatctcgctcgcgcagccggtttcttctctcgtcggtgggtggggtataggatggcgggacgcgggaaggcgatcggcgccggggccgcgaagaaggcgacgtcgaggagctccaaggccgggctgcagttccccgtcgggaggatcgccaggttcctcaaggccggcaagtacgccgagcgcgtcggcgccggcgctcccgtctacctcgccgccgtcctcgagtacctcgccgccgaggtattcgctcctgtacccacccgttctcggattggatctgatttgatggcgattgatttggggatctaggtcgccattgtctccgtgttcttggatccgttcgatatgcgatattgccgcgaatccgtggggattgggtctcttgtggggatcgaatttgtgatacactagattaaatttggccttgtggtggtgttcgtcaggtgctggagctcgccgggaacgcggcgagggacaacaagaagacccgcattgtgccgcgccacatccagctcgcggtgcgcaacgacgaggagctcaccaagctgctcggcggcgccaccatcgccagcggcggcgtcatgcccaacatccaccagcacctcctccccaagaaggccgggtcatccaaggcgtcccacgccgacgacgacgacaactgagcccccttcctcctcctccgccgccgccgccgcctgcattcgtcatcttgtcttatgcactagtaggatatttagctgtttattttggaccaaggtgtgttgttgcgttaagcagtaggaagaaacaagaaaaaaattgcttagttcttggtttgttttggtggcctgattgatggctgtgaatatggtgaaatttttggctatttatctcagatgtaatcccggcgatgatcttgctgtgtttggcacttgagtggttgaagaaacgaggaacagactgaaactaaaactttgaatcgtcatcatctgagcattgaccactgagttcttgttgcgcttaacatcctatttgcttgggtgttttgagcgatctgttaaatgttttcttaacattggacagggattagttactctgcatctgttatgttatcaatccctgccatggccatctgttattttgcgctccattgtagttttgttaggattgggctgtgtttatgccatccttttgatgattttgtcaaaaatctgatgttgaaatttccggtttgatttgaactgattttctccgaattgaggggcagaagttgtttgagtcttgtcctgactgatattggattgaagtcagactaatttgatttggttgtcaatttcgtgtcttcgttcgagtgtgccatgaaaaaaacatgacccagttcatgaattgtgggtcatgttgaattcagctatcccatttttggtggaaacgctccatgtttgggcagctgttcctataaggtaacccagctgttcttgtgggactgcctgtacatttgtcgacaaatttttcctcaaaacaaatttttcctcaaaaatttgacagatataattatagtacaatcatagtgtaattacactgtaacttatatataattatactgtaacttgcatgtaactacagtataacttatatgtaagtttcacataattttaaatcgttagatctattacaagatttgttttggtgaggaagaaaacaaatcatagcacacacatatatgaaagaatttgttcccacgacctccattttaccgaaataacatgttacggagagatttttgaaagttagatacaagttacactatagttacagtgtaattacatgcaagttacagtgtaatacactacgattgtactgtaattnnnnnnnnnnnnnnnnnnnnnnnnnnnnnnnnnnnnnnnnnnnnnnnnnnnnnnn

SEQ ID NO: 43122 - DNA, 9728 bp, Oryza sativa
  unsure (1)..(9728): unsure at all n locations
nnnnnnnnnnnnnnnnnnnnnnnnnnnnnnnnnnnnnnacaaatttttcctcaaaaatttgacagatataattatagtacaatcatagtgtaattacactgtaacttatatataattatactgtaacttgcatgtaactacagtataacttatatgtaagtttcacataattttaaatcgttagatctattacaagatttgttttggtgaggaagaaaacaaatcatagcacacacatatatgaaagaatttgttcccacgacctccattttaccgaaataacatgttacggagagatttttgaaagttagatacaagttacactatagttacagtgtaattacatgcaagttacagtgtaatacactacgattgtactgtaattacatctgttaaatttttggagaaaaatttgtcaataaatatttagcaaaatcgtttcttcaaactccatgcacacttttgtagcattagaaggaaaagaagcttatggcagtaggccgcgggccgcctcactgaaacaggcggaagcccaggatgcagcccaatagtactcgcgcagcaggcctcacggtacaaggtacggctggccgacgtggcgtgcgatcacacggttcgccatttttccggcccacccattgcttctgcttttcattttggaataagttcactttagttctctcaatttgtccttcagtctgaaatttgtcatgctggtatttctatcatgaatagctggtattgtgacatcccttaactcacagaaccatattaactttgatctctcgaaaatattgtgaccagttttagctgacataacaagtgtgacccacgtggacctcacatgtcagcgggccatctattcttcatcctgggccgaggctagtcgggctagcacgactcgacctacatgtcgggctaggccgtgcctgcacatgggctgcacgcacgacccaataagtctcgggtcgtaccgggccggcccgaaggcacgatagtccatcatgcttctccatataataagtctatttttccgtcctcatctctttatattgtgtcttatgtggctggaataagtctattttgtatccctgtctttaggcaatgccttatatattagatttgagtctattttggacccctcaactattttctcgactgtgcgtgccgcgctgggccggcccgaaggcacaatagtccatcgtgctcctccatataataagtctattttttcatcctcatctctttatgtttgtctcatgtggctagaataagtctattttgtatccctctctttaggtcatgccttatatatttgatttaagtctattttgggtccctcaactatttctcttcgaccgtgccatgccgtgccgggccagcccaccctgccaaggcatcggcccaagcacgggcccaacaccaatcgtgtcatgccgtgcttgggctaggccaaatggccgttcatgggctgggcgtcaggcctcggattttatagccatctaaaccatcctatgcctctccctcttcgttctctcttccccatctctcgagaagagtgcacagtgaggagatgggtagcgactggcgcgcgcggtggctggcagagccgacgacggaatcatcctgcgcttcaacatgtcgccgagggtgggttgtggcacggtgaggcgggaacccacggcttatcggacggacggcatggtcaccgcaccggcgacacggcgccgtggtggatgtccgagcacagctcccgccacaccagctcgagcgtttggagcgcgaccacgacggtggatgtccgcagcggaccccgacctcgattgcttgatccctacagcacatcgtcggcgacgatacctcccccatcctcaccgccaagcccatcaccacggtctccaaagggttggttggttaattggtggtagtagcaaagcctatggcctccggtgatcagcttgctcaagctcatgctcgtggtgtgcctccgtgtagcactggcacgacgcaggggaagggcaagtacctgctgttaaagggaaaattggaatcatgtcattataattttataaaatttaagatatgctattctgacccacatgtcattgactcatgtgggtcctacatgttattgagataccgatgacatatctcaaacttagctaaattataatggcatggttctaatttacccgctgttaaatgacgagctcgtctgatcgttgatatggttttaccgaacatccaccatctcgttcatgaacaggtgggtaccacacattgtcgctacagtgttttttcttttttttaagttattttattacctgtcgaactgccctatcgaactgccccagtttgacaggtacccttttgaactgccccagttcgacagggtgctaaacttacgattttgtctaaccgacctataattttgtgattttctattaaaataatattatttccacaaaaaattcactatacataacggaagcaggcgaagctaatccagctgccatgtgtaagtgcacaagtgcataggatcctagctaatagtaatacctgaaataagaggcggtagacggcagcggcagcggcagcagcagcggcgctaggcgatcgcagagtcatgctgcacctcgtgccctactgccatcgaccgttgtgcggagtagtggaaggaaaatgggaagccggccgccggcgctccgatgcgtggccttgcgctgttgcgccgcgcgaattcggcgccgtgaggagaagatcagaagacgtgggcggtggcaatcgcggcatcgtgttctattcgccttctgcttgtggctttcgcgcacaatgcgtttgttcgccttcgtgctgggccaggcctcaggcctgaggatgcctggggtttgggacgggaggccccaccaccccaggggggggggggcggcgtgctctggggtggccatgctgtggtacgcataggatgtttgtcttgacgtgcaaacataggttcaaagacgacgcctttcctgtttctctgatctcataaaacttgagtagtcaataagaagaagctaagcaattactaaaatttcgaattcacttctatattatgtcaaaaggcctgatataggcatgtaatttcacccaaaactatctacaatatacaaactgctactttgatattgatacattctttctaaaaaaaacggtaatattcgagttacactcaaatgtacagtgctcattgatttcaaaagcaagtagaagttttgcattccactttctaagtagtaccttaatatatactccctccgtcccataacataagagattttcagtttttgcttacaacgtttgaccactcatcttattcaatttttttttgcaaatataaaaaatgaaaagttgtgcttaaagtactgtagataataaagttagtcacaaataaaataaataataatttcaaaaaattttgaataagacgagttgtcaaacgttacaagaaaaactcaaaatcccttatgttatgggacggagggagtattattactgaaaattaattcagatcctatataataaatgattataaatgttgtattgcatatgtcatatcttcttggttctggtatttttttccatggtcagcactcagcagatgcgagggcttactattaagaagaccaagcattaagcattactatgcgcttactacgagcacatagtgaaacaatttaagaacctgaagatcttcaacaaccatttaacttaaaaatgtatatttagttctataggcctaaactcgtgataaatgttacattgttttgcatgatcgacaagtacaaaaccggacatctcaatcgggctatccgtgacggaggcgagcggcctgctgaacactaggtgagcaataggacactaggtacatgaaggagcacaatgactcaattaaagtggcacgtgagaagatgaacatactgaaagattttaccagcgagtggttgaatccaaattaacaatgtctattcaaagcacctattggagaggatattcaacttcgacaaggacgatggaattcatgtacaaccaagaggacaacttcacaaattgccgcaatctcaaggataccatccattcgttgctgatagagtcattcatgatccacatttagtattggcaattaacaattagttgtatgtccaattgatagtataatgtgatattagctcatccttatgaacccatggggtattttagttagtgtgtatatagtaattttggttgggtggatgagcctggatgggagatggccgcctgattttctgtggtgtttggttggatggcatggtgtatggggcggcccagaatagagaatattttcgcaatatgctggatgagtgcatccgaccgatttggctggatgaagccatccagttttggtctgggtgatgtgtcctgttctgattggctgtggttggtttgattttcggttaagcaagctccaaatgattttttgtcctaaaccgtttatctaatttatgatttgattacaccattatatttgttacaattaaatctttaaaataatatctcggatgattatattttgataaaaaaataatatataacaaatgggtctcactaacttttggctttttccatccatgctacatcctccaatcaaacaagaaattggatcgccatatccatataaaccaaataaaaaattggatcgctatatttaacaaaatatggatgccatatcccatccatgcatgaccgtgaaccaaacccaccctaagtgtcatatggggtactcttgaatataatctccattttggatatcaactactgtgtacactttagtaattaatcattgtccttggttgatcacattattggatgtccctttttctcatataaatgaagagtaaatattctgacctatgtatacatccagtatatatccaaccattattacaacaaaggtgttgaatgtggatagaattgattgagtacatcctctccatcttcctttggtctaaatggatctttctccacgtctagaaatcgaaccaccataggggttttggaaggatatgacttgtccatattaaatttctccaaaattttctgggtatatgcactttggtgcacaaggattccagaaggtaaatgctcaagttgtagacctaagaaaaatttggtttgacccaaatccttcatctcaaattccgtctttaaatgatgacgtgcttcattaatatcttgtgtattgccaatgatgttgagatcatcgacatataccgagataatacaaaatcttgtgggggactttttgataaagacgcacgggcaatcctcatttttagtgtatccctttagtgaaaggaattcacttaatcggttgtaccacatcctgcccgattgttttaagccataaagtgacttctacaacttaacacaatacatgttacgatttaccttctgattcgggatgtcgattccatcaggaaccttcatataaatatcagaatcaagcgacccataaagatatgctgtcactacgtccatcaactgcataaatagacgattttgtactgccaatgatattaaatatcggaaagttataccacttgtactgccaatgatattaaatatcggagacgattttgtactgccaatgctacaagccttgctttatatctcaccacctcgttgttttcgttccgtttccggacgaaaacccatttgtatcccacaggaaagataccacaaggagtaggcattacagccgagaatacatctcttttgtaaagcgaggctaattctacgtcaattgcgtcgttccatttgttccagtgagagcccttttggcactcttttatagacctaggttctggatcaacttggaggcactcagcaatttgttcagaaaaattagtatcgacaattgtagctcttctattaaaagattctccagttttagagtagttgatggcaatttcatcaacccttatagactcatcgtgatctcctgaaacaatgtgtctatggtcttccgaattcctagtctcaacattgtgcaccaccgagctaggttgtagactatcacgatctgcttgatatatagtatcaatttggtgtgtaccaactaaaggttggtttgcatttaccgtctttctttgcttattaacaattgtttctcgctgagtggccatacttcttcctctttttttagtgagtggaagttgagtggttttatttggtacctccactctttctggcgcattctgagcaggaattaaagatttagtcacacctttataattggtaaatgcatctggcagattattcgcaagtctttgcaaatgtataattttctgaacttgaagatcagtttcagtagtacgtgagtttgtggctggaataccatgggcatcccaattaatttcgtggcattctttctggtacttgaagtctccccctaatgccgggaaatgttcctcatcaaagatagagtcagcgaaccgggcagtaaatagatcacctgttaagggttctaaatactttatgatcaacggagatttgaatcccacatagatccccactttcctgtgtgggcccatagcagtacgctgtggtggtgagatcggtatgtatacaacacaaccgaacttacgcaaatgggaaatacttggaggattcccacgtactaagtgcattggggaagtttcatgatatgcagttggtcgtagttggacaaggtcagcagcgtgcagaactgcatgaccccaacacaatgaaggtaatttgcaattcatcaataatggtcgagcaataagcttaattcttttgatcaacgattcagccaaaccattttgtgtgtggacatatggaacagagtgctgaacctgaattcccaatgccatacaataatcatcgaaagcatgggatgtatattcggcagcattgtccatacagattgattgaatcctatgttcagggtaatttgccttcaaccttataatttgagacattaatttggcaaaggcatggttttgtgtcgatagaagacacacatgagaccatctagtagatgcgtcaatcaaaaaccataaagtacctgaacggtccagattttggcacaatagggccacagatatctccttgaatgcgttcaaggaatttaagtggttctgctctaattttgagataagatggtctcaaaatcagtttcccagtagcacatgcagtgcatacgaaatcagagggtttggaaaatttatcagtgatcaaatgatgaccaatagagttgccaataatttttctcatcatctcgataccggggtgcccaagtcgatcatgccaagtgtggaatgcatcaacaagtgggtccgttgagcagtattcgatgaacatatcatccatcgcagagagtggagcgacatcttctgggagaacattgaggttgctctctgggtcagcaggagcctggtgagaacttgcaacctcagggcactcttcatgtgtaagattgaagtgggcttcaaatcttgggttctcagaagatttttttgtccttgagggatttttggtacaagagaacaagatgtttcgggatgcggcagcctttagcgacatgagtgtcagatccacacctgttgcaatgcttgttgccattgctacgaggttgtggtgccttacccttcccttttcctttcttccgacccttgaatttgcgcctgttgttgttgcgtttgtgctttccagtcagattcttaggattattcgaagaatttcctttgaatcctttcttattctcagcattattctgtacattgaagtgcaggcagtggagcagagcccggtgggcgctattgggcattctttaaagaaagctcatggtgtctttttgcctgagtcaatgtatgtataagcagagaatgtttctggaaattgttagcgcgatactgttgagtcagtattctgtcctccggaagcatagttgatagagttttctctatcttttctacctccgttggctcttgttcacaaaacttcaacctggaacaaatgttatgaacagcatggttgtattctgccatagttttaaagtcctgtaggcgtaaatgaacccactcataattagcctcaggccaaatgagttccttttgctgatcataacgctcttttagagctttccaaaggttgagagggctcgtctctaacatgtattcatgtttgagatccttgtgaatgtagagtcttaaaagaaaaagggctgtattgagcttcctgggctcaattgctgggtccccatcattgggttcctcaattgtatttaaaatcccccgagaggcaaaattgattttgatatcagaagcccagatgggatagttagtcccatcgagggcgagttcgtcgaactcttttgttgccatgtccctacaatcatggttaacattattaatttacagaggtaaattaataaaaacatgatattgtggttgtaatctcaatgcgaaatgtaagacttcatattctgtaatgttaggtggcacaatgtggataatatccaagtaattaaacagtggagtagatctcttaatggtgggcaagttatacttgctgcctaaaacacggtctccaggcaaatatattctggtgaatataccgcagccaatgtttaggactccactaccttgtgttcaaccaaatttcaaataatctcatttttcaaaacatattctcggaaaataacacatgtgggtaatcatcgtgagatgtagacctctgtgagatgggcgaaatgctcgctgcctaggttatgaccagtgcggtcaatttgtaggactccatcgggtaatcatctcaaaatgtagaccacttgatgatgggcgagatactcgttgcctaagttatggtcgatatgaccaaagtataggactccatcgacatgtgattaatttccaagtcaaagtgtgaagtggaacatgtattaaatcctccattaattatgttgtacataattaagagaatttgctaaatcaaaatacagaatttatagaattttgtaaattaataaagcgagaaagtagagcgtgtcttgaaataatatgcaaaaggcatgttattaagacaacaaataaatttagtgaaacagggtatttaaataaacacctatgttaataaacacataacatcagtggtctataggaccattacataattgtttgtacaactgatgaactgcttcgactaaattacataaaacattagggactaaaatgtaattgctgctgaaaataaaattaaaaactaaaattaaatggtaaattgggtggtgggccgaaatctaaaggattcggcctaccaccgtgtggcactaggctggcaggcaaggggggcggtgggccggcccatccggccctcagcaaaaaggcaggggaagccgtcggggggttagggttaaccctaaccgcccccacgatttcgctgctgccgccgttttcgccgctcaaaccgccacccttttcgccgcacaccgccgccatttcgctgctaccgatgccgccgttgggcgccaccgacgccgacgaggggacgccgagggggcgctgcccttcctccgccgccgtggggcgccaacgacgccaccgaggggggcgccgcccttcctctgccgccgccgcaccatctgccgcccccatctccccgttacggcaccgatgcatgatgcgccg

SEQ ID NO: 43123 - DNA, 5049 bp, Oryza sativa
gtccaccaccgcttgcatccacaattcgctacccaccgttgtcgccatccaccatacactggcgccacggacgcccctccgtccgccggcggtttgccggccggattaggccgacggctcccgatcctcatcggaatcggaggccggccgagcccggacgccattccccggcaccccgttagggagtgtacggctaggagagccatggggaatggcgatgaaggtgtggcggaggccgggacggcaaacggcggcttcacctgcatgacgacgagacgaggacggattgaagaagggcggctcccccgtgcgcgcagccagggtaccggttctgccggaccccagtagcgcgggagtgggggaacggcgtcggcgtcggcttggtgtcggtggaggtggtgaaggggcggtcagtggtggcggcagcgactccatctccagggaaaggtcacatggctcgccgggcagtgtcaccactgccgtccatccgtggtaggcgcagtactgcaccccctgcacacagatacggcgaggcacggcggcaaccggagacggaggcggaggaggagcagccggagtagtggccaccacgatgcgtcggcgagggtggtggcgacggccaccagccctagcccgacgttcatggtgttagtggcgaccgtggtggtggcggcgactcctctccgatcgacggagaagatggtgaaggcgacgggcgcgctgattgcgagggaggccgagaacggcatccataatccaatgaaaggtaggcatcgtaccttctctgttgaatctcctgttcgcttttctgttagatcaaaagcgatgtttcttccttctttcacttcgcgatctccttcgcgagagcgaaagtgctgataacgtgttgaatgtggatagaattgattgagcgagagagagaattgaacacaaacagagcgaatcgatagatttctcattgatcaacagtacatttatacaatgtgaagcggtgtcaactgcaggggacgcgatatttaggaacatcgcgtcggttgtcgagagggacgctaaagggagagagaggagcgatctcctcttctctaccggttagtataggaaccgttgttcctatttccttgggtggatgagatcacccgtagtttcttaacaaaaggagcggaattgttgtgtgagaaaccaaactggtttgttgttcgtgtggacactggacagagctgttgactgatcgatggtggtgcggtggtgccatttcaaacttggcaaaagtaggtgacacggtagttgaatgttttgtacgtagtggccggccgctggggccacgagcgtgccacgccatcatcaaacacgtttctatctttttctttttggaggtttcgttttctcttggtcaacattaatccgctcgatcgccacgtgatcctgttgtgtcttaattactcgacgctttgatcaaacagcttgaccagcaacgtcgtgtggcatatgcatgcaggcacgtacacagtcagatccaccttggcaagctataatcctgatccaaacctgcctctggaactctattataaatacgtgccttgtatcggtgctctcgatgaactctacaagtcattttgtcgccatcagcttctttcatcaccaactcgatcagaccgtgagtggagtaccttttaattccttagttttccttagtttatactgcctctattttccttttaaataaactaattaaccaatgcaacaccgttcattaaagaatagaggaagtatattttgttctcatgtgtgtatatatatatatagctagaagttatttaactacctttaaggcatttaacttatcgatccacatgcaggcagagacgagggaagatgagctcgtcggcgaagacgtcgtggccggaggtggttgggctgagcatagaggaggccaagaaggtgattctcaaggacaagcccgacgccgacatcgtcgtgctgccattcggcacggcggtgccagaggattttcgcttcaaccgtgtccgaatcttcgtcgacaccgtcgccgagacgcctcgtgtgggctagctagcagaatatatatagctttaaattaaaattaataatggttagtagcgatgctgctgtgccccgaccgtatcctttctctaaaattgatatcatatatatgtattatatgtgtgtaaatcatcaatcctgggatgaaaaagatgaatcagctgtcaggaccactgcatggtcttcttgtactcctctcaaacttgttcttgcaacccgtctaaaaaacgaatttctaaaaaatgaatacggacatacatatatccacactagtacagaaccgggaatcacaatcaggctatctgtgatggaaatgagcgacccgttacaaagatagtcatctttatcaagctgcaaaaagcctcatcaaagatggcccaagagaggtagaattttagtcctcaggataggcccctcacggataaccaacattcatatggggtgtgatttgcccgttaaggtcattagtgacggcccccgttacctatgagggtcatccgtgacgagcctagtgttaaggccggataaagatgactgtgaagcctatcacggattatccttaatctttgttggggcttgtttgcggcccgttacggataacccatagtataaatactcccaaactttcgaaagaatagtattcctatatagcagactattcatagtttgggagggagggctagaggggcgaatttttgctcttcacttgaaaaaaaagtattccaagttaataataaattaccaatataacttcgatgtaataattactagctacatatacatatcattaatttcatttcatacattgcagatggatagaagatggatgtataaaagtgaccgatctagcatagagtattgaaggggcgttgctgatttcataaatgttgtagagcaagacaagagcagaacaaacaatgaatggatgacttgtccatactttgatcgtaagaatgagaagatgctttagaatagtgccaaaacacgcatgcatctgatctaccgaggcttcatggatggttactcatgttggactaagcatagagagcaatagctagagaatattggggataaagctggcggtggtctgaacaaggaagaacacaaacatgatatgtttgttcaatcctcgttggctggtgatcgggaggatgtcaataatgagactattccagtaatgttgcgtgatgttgaggacctaacttacaacgagagggaccatgagaagtttactcagctgatgaacgattttgagacacctctgcaagccagatgtacagtaaagcacacgaagttatctgcgaccttgtatctgatgaagcttaaggaagtaatggctggatagacaaaagtttcacacaactacttggatgtcacctttgaacctttggctgattgaaatactccattgttaaaataatggtgatgtctttatagccataaatgatagttagtgttaaaattttttatcacaaatattcacttttttggcgatgttgcatgtgaggagtaacaaaattccatcacaagaacttaaactcctaggaccaaagtttttttttcatgacgacaactattctaacaaaatgtaatatttttgtgcaacaccatcactaagaaatattttgaactcaattaagcccaatttgggaacaataatattcaaatatttattccgttagtattctctcaggttggagcttataagtcatactccaggcctttcatgagtatctagagatcacccaaatctcatagactgtgactagcagtcgaactcatataagtgtgttccttctaagatgttctgcaggtcaacatctctgcttaatgaaagccacccggaatacattgaggcataagccatcctaccatacagaatagaagagaagtacatcataaaaatgagcccatttaagggtctcttctttcggttacacaatagtttgtttcgccatccaaattcacgggatctccgatcacaattgacaggtttccactattgtgcaactctaagtgggtctcaagtccatttccctcgatgcactttctatcacattacgtggtagccccttggtaaactgatttgccagatttttagctgtctggacatagtccaatgctatcactccggagtttttctgctttctgacagatttcagtcttctctttacatacctagatgacttcatgttgtccttcgaactgttcaccttaataatcactgtttgattatcacaattcattaggatagctggcactggttttccaaccaccggcaaatccatcaggagttcacgaaaccactcagtctcaactgtggcagtatctagtgctgtgagttctgcttccattgttgacctcgttaagatggtctgaaacagcgccacctccaagtgtgaacacatatccacttgtggcctttatctcatcagcatcagatatcaagtttgagtcactatacccttccagtacttttgggtacacagtatagtgaattccatagctcactgtgccctttagatagcgtatgaccctttccagagcttgccaatgatcatctcccggatttgaaacaaatctgctcagcttgctcacagcaaatgagatgtcaggactcgttgcactagccaagtatatcaatgaaccaatgatatgggagtatctcaattgatcccttgctattcttcggtttttccttaaaagcacactagagtcataaggagtaggagatggcttgcagtcactataaccaaagcgactcaaaacattgtccacatagtgagattgcacgagtgtaatcccaccctcatctcctctcagtagcttaatgttaagaacaacattagctactcccaaatccttcatttcaaagctttgggacaaaaagtccttaacctcctcaatcacattgaggctggttccaaaaatcaatatgtcatcggcatataaacacaagatcactccctctcctccgccagtaccgag

SEQ ID NO: 43124 - DNA, 15316 bp, Oryza sativa
gtactttttaattgtaccatctggcctaagctttttcttgaaaaccaatttgcatcctacaggcttgcacccatatggacgctcaacgacttcccaagtactattagatataattgagtccatttcactgcgtaccgcttccttccaatagtcagcgtcaggagatgaatatgcctcttctatagttcttggagtgtcatccacgaggtatacaatgtagtcatctccaaaggattttgcaaccctttgtctcttactctttcgagtatacaatgttatcctcctcaggattttcctcaggcgtttgattactgtgttctatcggtgcaaagtgctcatggggtaaaacaggttcttgactagatgtgctaggtgtatttttcatgggaaattcactcaaagaatgtggcatctctggactcagtaattataccaacacgtatgtcgggtactccagagtttactattaagtatctataacccacgctgtggatagcataaccgaggaacacacagtctacggtatttggtccaagtttacgctttttggctataggtacatttaccttggccaaacagccccatgtgcgtaggtatgagagatttagtttcttcctttcccattccttgaacggtgctactttcttatgcttcactggaattttattcaggacatgaaaagtagtcaaaattgcctcaccccaccattccttgaaaagtcccgcagtgtctaacatggcattcaccatctcagtaagagtgcggttctttcttttggctaccccatttgattgggtgaatagggaggcatcctctcatgaataattccaaactcttcgcaaaaggacataaactcattggaaaaatactctccacccctatcagacctcaaccatttgattttcctttcaagatggttttctacctcagctttatagatcttaaagtaatacaatgcttcatcctttgttttcaataggtacacatagcaaaatctagtgcaatcatctatcagtgtcatgaaatatttctttccctctttactcaacacgccgttcatttcacacagatcgaaatgaacaagttctaggggtgccaaattcctcgcctcagatgcattgtgaggtttgcgaggttgtttccattgaacacaagtatggcacttagaaccttttactaaagtgaattttgcaattaaactcatattagccaagcgtgtcatacaaccgaaattcatatgacaaagtcgcgaatgccacacattgaactcatcattctcgctaatatggttcacatcattattattattacgcatgtcatccaaagaaaaacggaacagaactccgctgacataaccttttccaataaaagttccatatttagatacggcacatttattggattcaaacacaagtctaaaagcatctctacacagtagagagctgctaactagattcttctttattaaagggacatgctgcacgttctttagctgcacggtctttcccgaagtaaacttcaaatcgaccataccaacaccatgaacaaccgcaagcgacccgtttcccatcaacaaggaggaatctctcccgacttgataagaagaaaacatggaaatatcagcacacacatgaatattagcaccagtatcaacccaccaatcaggtgaatgaaaaacagagagaattgtaggtaaaaatttaccataccccgatgttcctccgccctcgctaataaccatgttggcagacttcttgtccttgcgattaggacaattcttggcccaatgcctaggcttaccgcacacaaagcagtcgcccttggcctttcccttgcctttatccttaaaattggtagtagcctttggtttgacatcaggcttgactttcttgttgttgttgttgtgggatgcgtgagggttcttcttttgcaccaaattggcgctagaacctccctcgatatttttgccctgttgtcctttgctctcgccttctcctcaacacccaaagagccaatgagatcagtaacaccgaactcttgcctcttgtgttctagagaagtagcaaagtccgaccaagaaggtggaaatttggcaataatgccacccgccacaaacttgttcggcaactcgcagttgtttgttctcaagttcctttgtcagcatctaaatctcatgagcctgttccactatagaacggtaatcgaccatctcatagtcatagaactgctccatgacatacagctcgctgctggtgtcggaaactccgaacttggcctcaaatgcattccacatgaccttccccgaaggcatgtgcatgtacacgtccactatattgtcagcaagtatactgatcaatgttccacggaacaggcaatccgaatcctcgaacctagcctcctcctcaggagagagaggcagttcacttcgttttttccgtgaaatatagaagcattgcatcgctgtcaaccacagtagtgcacgtgcttagcatctcttatagttagaaccatcaaaaacatgtggtttcagtattgcagcaaagccaactacctaaaaggacctatcaggtttttggattgttgagaatttggtcataattcggcatattttaatccaaaatagcaagataataaacatgatatttacaatgggatttgatccaatgatagtggcgaatgtaatcaatatgagtatgcttaacgtagaataagcatcaacaatcacataataacgcaatgttgacattgcgatgaacattaacattaaaacttctaagtgaaataatataagaaggttataccgaatggtcctccgctggagtttgaggcagtattgccttcattggtgttgacgggaacctccttctccttgtctctagtgttgccgttgtctccagtgctcgatatgttggtgaagacgaagtagacgttgatgaacagtgagtagtctcgtcttgcgctccccaaaaacctgatcgcccgcccgtccgtgcatacgtcgcagcagtgcgtggtttcggaggcctactctcccaacgcgtgtgcatacactcgtcgggatgggattaccgtagcagcaacagccttggaaatggatgaaagtgtgtctcacttctccttagggagatcaaatccattctcattttataggaggaatggaagatgaagagtaagagtcatggaataagaagaggaatagagtaactaattctcatcaattagccatcaaccatcctccactacacaaccatcaatcaaccatcaattaggagtaattagtgtaggttaccaatgcaatggaataggaagaggaatagagcaactaattgtcatcatctagccatgaaccatcctccactacacaaccatcaaccatccatcaattaggagtaattgatataagttaccaattccctaatcaaatggattaattctgaaaattcttcgtcccattgatgtcccataagagaatgaatacacatgaattcctagcataatgagccttgaaatttatttgatttaattgatttaaatggataaattacccaattaaatctaacagaaactccgttagaagaggcgaaggtgagaaatatatggctatctgctcatcaagtttttgactttttgttatactattctttcaacatttgtagcttgtcggtccactgttctttcgtaagatttcaactcctcatgttgagactgttgctattccggtaactaagcatttgtgaccgttcatatgtcgtcctcccattcgtacgctgggccttcctcattagtgtgaattgcaagagtggaacaaacggagacgatgtaaaatgagaaaggaatactcacaggtggcacattcccatatttccaccatatttatatgctatatagaacaactctcataaactatatatatacttccacgattgcatcagcttgaggttattgcttaccgaaaacaaaaaaaatgccatagaaatgagaggccacgggaaaagaagatgtcgctcaagaaatagtcgccgagagcattaccgctggagcgttcagttcaagtccatcgatcacttgacatcttggtgctgcagcattagtggcaatctggcaagcatggtcttaccggcttttgcgttgcggtcaggctgacactggcacagatttccaacggctgcgacgcgctgtaaaccaccatgggtctcatcactccttgaggttatgaacttaatttggtgtagacgcgtggatagttttcagggaaaaaaaagggggaaaaacatgtgattgatttatgtacatttttgtttcgttggttagatatgtaacaatgactactgaatattttgccaactcatgcatccagctatgtatctctaatttataaccgtaactcaatcgtataataagcgactgatgaacaccagctcaggaatgacctcaagctaagaattttggggctagcagcagtggcaaagtcgaagaaaaggcagatatcgcgattgacatggctgaaagaaggggatgccaacacaaagtttttccacattcacgcaaactcgaggagaaggaaaaaccacattcaccaactccatacaacaagtgctatcctgacagaacatgaggaaaaaagtgacgcgcttttcaaccatttcaactcaatcctaggcaacaaggaggcgtgaaattgcaccctaaattggaacgcgatggatctaccacaggttaaccccgatgaactagatgaaccttttacagaggaggaagtttgggccgctttaaagcagatgccggcagaaaaggccccaggtctagatggctttaatggtaccttctacaagaaatgctggcagctaattaaacaggatatcatggatgttttccagtgtttgtataacctgtcaggatgaaactttggagcactcaacagagcagcaattaccttgcttccaaagaggaatgcccctaccttggtgaccgattttaggccaatcagcctcattcactccgtcgccaagctgatatccaaagttctagcaataaggcttgccaggcagatggatggcctgatctctgttgcacagagcgccttcatcaaaaaaagatgcattcaagacaacttcctgtatgttcggaacgtgctcaggaacctaaatgccagcaaaaagccaacactttttctcaagctagacattgctagagcttttgattcggtctcctgggaatatctacttgaactgatgcaaaacatgggttttggcccccagtggagaaattggatctgtttgctcttttccaccgccacttccaaggtagtcctaaatggagaccagggggaatgcattgcacacagacgtggcttgaggcaaggggaccccctatccccctatctctttatcctggctatcgaccccctacaaaggcttctacatctatcgaccgaaggtgggcaactaaccaacatcggaagtcgccatgctagattgaggacttcgcttgatgcagatgatgcagctgtttttctcaaccctgtacaaagcgaggtggatgttcttattaccatgcttagggactttggcaaggcaacagggctgcacgtcaatcttggaaaaagtctggtggcaccaattcgatgccaggaagtagatctggacgacgtcttgcgtagttattcgggggcaagagccagcttcccactaacttacctagggctaccactcactcctggccgcctacgtaaggtgcatttccagcctctccaggataagatcaaaggtcggttctcgggatggaagccatcattgttgtacatgggggggcgccgaattatggtgaactcagttctaagtgccatcccaacttacaccctcacggtgctgaaaccgccgaaacaatctcttcaagaaattgacaaagcaagaaggcggttcctgtgggtaggtaatgagaatatgcatggcggaaaatgcaaggtcaattggcttaaagttttctcacctgtccggtacggtggtttgggggttccgaacttagaaaagtttgccagagctctttgactgagatggttatggttcgaatggaggatgccaaagaagccttggatagggactgaaacaccctgtgatgaattggataaggatcttttcgcggcatcaacgagagtccaaattggtgacggacaaaaggcgagcttttgggaatcaaattggatcggtggccaaagcctaaaaagtcaagcacctaatctttataggcattcgaagaggaaaacctgcaccgtctaggacgccctgcaacaaggaagatggattaacgacgtccgccacagcctcaccattcctcttcttgatgaattcttccatgtttgggaaattttagcccgtgacaccccacaactaacagagggggtacaagactcgattgtttggcaatggacaactaatggggaatacggtgcaaaatccgcgtaccaattccaattcaatggaatggtactctcgccatcaacaaagttgtcttgggaggcatgggctccggcaaagtgcaaaatctttagttggttggttcttcaaaaccgggtgtggacaactgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagagctctcttcttgctcattgcttgggaaatctggaaggaacgaaatgcaagaatcttcagagcaaaggaggcgacagtacaccagatgattagtcgcatccaagaggaattaggttggtggagtatggccggcgctaaacacattgggagaatgttgccatgaggagctaggaaggctacgtgcaagcttgtttgcatgttgtcatgtacagtttttctcttttttagccctttggctatttgtactttttgtccttctatcaatataacgccagtcaattctgaccagccgttcgaaaaaaaaagactaaagcttgttataaaaattcaattagtttgttttggattagatgcatggaatttgtcgagatcttatggaagtatggatctgtcggtaactccaaattaagtgactaaaaaactggtaaaaatagttacattattgtcatattttgagcaagttagccatacatcttgcctgcatatcaacgtcatatgtccaagtaacatcatggtttcctccctgggctacggttcgagatcaaataccaatcagagagctgctagctatggtacactaaaatgtagcaagcctagcttttcttgtgcttcttggggtggacagaattgcaaagttctcatgttgccgcctcttgtctcaccaggaaaaagggaaatactcagacacgtaatgggataaaaactagaaaatgctccatcctatgaactagtcaactcttcacttgtgaacaggttttgagtgcagcacaaatttattcacttgtgaacaaaacaaaaactgagagaattattggagcgtatgatgttttgctgcgaatagatcgggaacatcttgctacagttagcccgattgaacaaggaagaatggaaggatgagttaaaaaaagtagtccagagagtagtagtcacagagacgggtagagagagtctgggggcagcagaatcagtatttagtaatgttgtttaattgtatcagtattttttttaaatagggtgagtgacatttgggaatgttactatgttatttttaattttgaaaatgcaagtctaatttcttaaagtgatatacaattatttaatctatattttcgatttgtttgtatcttttatgtatgatccgatagcataaatatggttataatacaactcaaaataacatatatttttacatatgagcttaaattattagttttgtttttcatctaatctaataagtgagaaagaagaaaaaatgaaaataaagacgtggggctgggcgtgcttatgtacgtaccgtacttttttattccttcctacttaccgatcagtggcaacggttttggggatatatttaattggtgacttttaagatagatataatggtgaaaacgaataatgataggtccatcagattaaatcaaaaccaacagttagatattttgtttatttatagaatttttaggatttattagagcgtcacgtggcggtttaggataaaaattcatttgtctaattatggaactcaaattgttaatttaatagaaatataatcgtttaaatttaacataaaaccaccgatgaacctcatatccatcaccgtacatgggacatgcatcagaatttctttggcaaccggttttgccttcgtgagagaagtaaaggaattaagttgaccgtcagttatattaatatgtaacaaatcatggattatatcttaacaaccgaaagatagaaagcgggtgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctagagctggagttcaatcaaacagtttcaactatacgtaaaatcttagttattaagaccggactggaccagcggttggaccggggaaaaaccggaaccaatgccccaaccggtccggtccaggtaaaaagaccggcatgcaatcggcccagcaataaaccggttagaccgcctggttttagagaaaaaacgccattaaaccggggaataaaaccgcttccaaccaggcttggcggctgctgtacgcgcgcatgggtgctgttgggggaaaaatgagagaaaatgtgcatgggtagcattcgaaccggttagactgcctggttttagagaaaaaccgcctggttttaaagaaaaaacgccattaaattggggaataaaaccgctgttgggggaaaatgaaagaaaatatgcatgggtaggattcgaacctagaaccataaacaccccaaccaccaggctatcatgtcctttgtgtttagatagaatgcttaatgtatttaatagttattgaactggattaaaccaacggttcaaccagttgaaccagtgaaccattgaatcgagagcctcaccggttcgattaccagtccggtcttaataactatgcgtaaaatgggagtgagaggagctggatggagttctcttactaaatgaactatagaggtagagctgggcttaggcaactctaaaactccactccagacctaatttctagagttaaatttaggagttagaaatctactaaataggcccataaatttgcaattcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatccccgggatcccctctatcttttctcttatggaatcgtcgccaattcggtttggaaatccgtggattcgagttcaattcagatcgatctctctcctccgaaccctaaaccttccatcgcgtcaccggtcgccgtgggccttcgccgtcgcctccttgcccctataaaaggacccccaagcccgccgctacccgccgccaccctcgccttcgcctctcgtcgccggtagagccctagcaccctgtagcctagcgccaccgtcgctgccgttcgtccagccgtgcgccgccgccgctccggtcatcgtcgtcgtcgctcgggaaggccgccatcgtgatcaccaagtcgtcgccgacctcgtccgcccctccgccgtcgctgtcgaccgccggaacaccgccgtcgtcatcaagccgaaggtcgccgccgcttcttcctcgacgccatcgccgtccattgatcttccgccgttgttttggtcactggtgagttcgccgcgtcgccctctacgtgttggttccctccgttcgcgttgtcgtgccgtcattcgccggcgagcatgcacgcccgagccgccgccggtggtgacgtcaccgctgacgtcatcgttgccatccgtcgtaggcctgtcgtggaccgatagatctcggccgttcgtttttggatggatcggtctcggtcgttcgtttccgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgagcgtgacaagttctcatctagacagcatcaccacatcactccatgcctcattcttaccattccctgttctagccatggactgtaatcgtcatgcaccaagctctaatcatcttataaaccacaaacacaaaggatacggatgaagccgagtgtccccattgtacatagtattcgagtaatccaattgttttggcattaatagttacaaattctgaaattgaagcagtgacaaataagatggatattcctcatccaaatatgaagacacgaatgagatagcattttcttgggaagaaatgtttgaatcaaaacaggagcggaagctggcgaacaatgagcatgattatgaatgcattaaaacaacagcgaaatttcttcgtcttcatctactagtttacaagaggacatgcatcacattcaccagaaaatatataccccccacaatttccgtaatgagcaactatagggttggcgcacagtatagtagtatagtagtaaactacggtcaagtccgcaatgagcaaaatgtgatgccaaactttaatttttgcacttgcgaaagggtccgtagagaagtgctctgtaggcaccagcagcgcccaccccatcttgccattcgcacgggagtgccactattgcgaaattcttattggtgttggttgggaacaactataggtgttggtttaacagtaagaatcaacttggaaataccaatgcctaatagtatagatgtcgatttaataactggtacctatataattgataataggtactggttttgtctagtatccagtacttataattgataataggtgatgattttctctaaaccgacacctttaacctattatttagggttttgtagtagtgtgccgacggcattcaggtgccgttgcgtctgccagtttggttttgtattatactagcaagactttaaattgaattatttgagcactattttacgtattatgtattttgttcttttttgccgtgtacggtggcagaacaacatacatacgacaaatgttgggttgtttaatttcatttcttgctctcacttagtgccagacacattgcctagtaaatttcttcactacaagtaaattaaagcagaataaattgctctaccaaacatccatccctcttctagttatatacttcgtcccagggctgaatcagctggagggcttcctgagaaacggcgacagaaatagcatgggaaggttcttcgtcactcaaacaaataccccaaatttaggccttattagttttgaaggattcctaaaggaaatctcaattcctttggaataagcaatattcatgcattcggtttgtaggattcattggaaaattttccataggaacactatgccaatcctccaaaaatcctccaaaatatactaattccataggaatgaaaacattcactctatcctcttttgtttagctcggtggaggaaaaattcctgtgttccaatcctttgttttacacatggattcctatattattcctacgttttttctatttctgtgatttggaaatcctgtgaaccgaataagccctacttaggaagcggcaatgaaaaagaacgcgtaccatggcaataagagaaccttgtaaaagaagaaaaagctcctggaaatccaaatgttaccgacaactttagaacatataaaaataaaaacaagatctttttactaccaatagagaacaccataaaatggatttttttgtacggtggcgctaatacgcgcgctgcgcgtggaatattagtttgagcaccgcacaaccctctctccttccggttttctcttttttattatcactccaccttccatgtttcttttttctcttttccatctcatccgtgcttcatcaaaaggcccggaaaaatattaaccatccatattttttcctctttcattccttctctgcattttctttagcattttagttttctttatctttttagtaaaatatttatcgtgtagtttttctttccgggttttctgtttttctagtgtctatccacgtttcaaaagcaatgaatttactccatagaatttttcatttactcccagcctaccacatctgctcattcaaaagtaacaaatttactcgcatgaatgcccgtcatcatacaacaccattcctagatgtccgtaaaagaattactaccagcttgcaatgctagtaattcttttaccacagttatcaatattgtttagacttcgtgatctacgagtaaaacaacaccttcctctcgttatagcctatgatctcgtagccactatgcagtaatatgttactgatgtgttcaatacacagtataagagtaaaaactaatataggagtattgttaatccgtatcacaaaatggttgtacgaatgaaaaacattacaggctcaatcacacacgactgttaatataactcacagatgaattaaactaaaaaagaaaaaaataattcagccaaaaattcatgatgacgttgggatcctggtggctttgctggatctttctataaggatagagaggttggtttgtgtcatgtgactggtagtggagagggcaaccaggtgaccagcagtagtcgatgatggaatcatggaaagatgtagcggcgtggtacatagatgagctcacatttgcgcagtagcaaccttccatcatctagcgagcatgaaataa

SEQ ID NO: 43125 - DNA, 1121 bp, Oryza sativa
ggccgtgtatttggccacctttccggccagagccaactcggcctgctgtttgttgccccagaggaggacaacatggagacgatcgtcgcgcaggatgcgcttgtatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaataagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactactggggttctgaat

SEQ ID NO: 43126 - DNA, 1544 bp, Oryza sativa
aattcttctatccatgacgaaggtgctcgtcacagaattgctatccagctggctagtgacaagcatcatccatgccacgtggctgccatacgtggaatccacgttggatgtgacgtggcagatgacgtgtactccacatttgtccaagccacgtggctgccagacgtggaatccacgttggatgtaacgtggcagatgacgtgtactccacatggcggatgacgtgtacgccagtatgctagagccacatggcagtcgtatttaaccccacgtgttggcatttcatatgtccacgtggcgttagcgtgcaacgccacgtggccaaatgtggcaacgccacatgttctcattttgaggcgccacgtgtctttatgacaggtgtccttacctgatacagccacgtgttaatatgttttgatgacacgtgtcaaacacattaaggattcaggtccactcatttgttctggcccaacccatttggccacacattttacatctagttgtggcccagtccactattagttctagaaaatttttagcattggcccatttggagcaacaattagaactttgcacacattacaaataggaccaacataaacattgaacacagataccaacttcattacaaatagccccaacatcaacattaacattgaacacagaaaccaacttcaccgatgatcccaaacttgtgagccagtgttgccatcacctccactggcagcagcagccatggcccgccgagctcgacatcgacgatgttgccgaagtccttgctaacaacatcgatcctctgaaacacctgataatcaaacgaaaccaagtttcagattataccaacaccaaatttctgattctccaaatcagattcagctgaataataattcaggatcaattgtttttctgacctgcccgagggtgatggggaggagcctagcaacctgatagtacataaccatatgttagattattttttttatgcgctagataaacaacaagaaacaatctatagatacgacattagttttttaatgatagggctactttgcaacaccaatctgatgtccccataatatattgcactaacatatctcaatgtccccatccccaacccacctcatttcattggccaagcaaacaagcaaccgaactagaatgcataggagtttagcactaaaatttagacactaaagttatgatacgagtaacttcctatacatgcttcatttctacagactataggcatatagcatgaccgtaaagtgtggtgtaaagttatggacaccatttaaacatgcttcatttctacaaagtacatgcatacaacggttccaaaatttatatcaccagtggaacaatgtagcagcaacatcactaagtactataacactagagtggaacacacagcgcgctgcaccagtggcatcagaagacgaaaatttgtcgttattttggtaaacagagtaaatactaaatcaaaaggtattataacagatgagtaccaattctacaatatacattttaatctcaatggaaaacta

SEQ ID NO: 43127 - DNA, 4161 bp, Oryza sativa
tcctagctactgtagtgatgctgtttttttatgacaggcaaacggctagtgacatcatcagacaatggaattaatttagtagtaccatataccctttttttttcaagcagcagactgcaaactaaccattcaatggcactcatagattacagactagcatagttacaggatacagtactaagtgcatagtaatctaccctagtgctcacacgtgcaaatggaaatcccctagtgctttaacttgaaaattgccataatgccctctgaattgtataacataattgggtataatttcatatatttatataactgatttaactactaactgccaattgttcaacaaatagaaagtactcaactagtatttgacaattgttcaacatataagagtggcaatatgtgaaatatatagaggattgaaaattgtgcaatgtttgaggcagggggactcatgaattgaggatttaaaattcatgaacaattgttcaagagcaagaccattttttctcttcatattttagacccaaaaatccaacaatatggaaatgggataaatgcctctggattctcatggaagaattgaagaagaatcatgcaatgcaatggtagtgtagaagaatcatgcaatgtaatggtagtgtgccgaacgccattgccaataagtggatacggtagctctgctacataaattgatttcctttctgtaggacaggggaataatagacttaagtacacatgccaagaattatcattgctgagaggagttgcaactgtactctgtacttagatctgagtagcatcatacgcaggtaaatgcatgcagaacttgcagatcgagggaacagtgctaccggatgaatcgcaggatcaaccaacattcaacaaagacagatagatagagattgaagcttactgttgtggctggcggatgagtgctcgacccatcggcactccaggggaatccacttgagcaccctcccgtccgacacgcccgtgtacgggccgtcgccgtcaaacgccacgcagccacgctctccggcccaaccgcggacctgctcctgggggaccctgcagccctgcgccgacgagtcgtgcggccgcgccagcgccgcagtcgccggctcggcggctcgccgccgccgcacccgtacgcctctcttgctcggctcccgtgtctagggtttgggtattaggtgattagggttagatggggaggagaattggggaaaatgtcgaaatgggctgagctgctcctggccatcgggtccagcatcgaagctgctccggatcaagcgctgcaccaccatatggagcgctgctgtggattatgggaggcaacatcagatgaagcagcgagtggacggaggatgtagcggcggcgggaggcgatgcgaggcagcagaaaggcgggaggtggtgcgggagtaccgtcgcggctgctttcggggtggggaagcctgccgccgacgcctagagaggtgccgacgccgatcagggctaccggccgcggaagcgagatgccgccgccgccgccgccgcgggtgtggggaatgcagagggaaagaaatgagagtggatgagggttagggtttgcaaccctattttatacttcattggtgcaatgacagccattcgatcaagaatcaatggccagaaatttatgggccgagtacagtaacgggccgatttctgggtttaggcctactaatatatgtggtatttttttaatttcaatttatgagaactttaaatttaattttaggccaatttgtgtgtgttttaaatgcaaaaatcataaacaacaaaattttagaactcatcaatatctacaactattgtattggtatttttacaaataagttcatttgaacaattcaaattttgaattttcaaaatttgacaacttaaaaaaaattggggtaaataaatgatgtaaaatgaaaaagtcaccaaaatcaaagttgtagaactcatagagatgcaaaatttttattttggtcatttctccatctgactctatttgaacaatttgaaatttgaaattcaaagtttgagaccttcaaatagaattttttattagtgaacgacttcaactgaaaaagtcatcaacaacaaagttgtataatccatcaagatctataatttttattttggtcatttattcatccgataaagtgatagtaacattatttacaaattttacatatctcccgtatggtttcataagttataagagagatatgtaaattttgagaacaacgttactatcactttgtcgaatgaataaatgaccaaaataaaatttgtagatctcgatcagttctacaacttttgtgttcatgaatttttcagctgaaatcgtttactgcttcaaaatgtcatttgaagttgccactttttgaaatttaaatcttcaattgataaaacaaagtcacatgaaagtatgccaaaaataatagttgtaataacacaataaattgatagatcatgaacttagaaaaatttagaaaaaagaataatcaaatttgaagttagtatgagagagaaagactacctacaagttttagccaaagattaaaaagataaaccacactttatgatgaaccccacaagcaggtgatgcaggtcctagctcctaggtcgtccgcataaaacattcaatcattcatgcgttcaagaattgtgaaaggaaaactaaaagtattcgatcctagctgcagcatatttttttagaaaaaggtatttcatatgggctgcaagtagacagcatttgccatctcctggcccgaaaacacacctgggctgcatccgtgggccaaataactaaaacgaaaacacacctgggctgcatccgtgggccaaataactaaaacgaatgttgggacccactgtacctcaattatatgtgggtccagtaacaacctggttagccacatatacaatgtggggtcaatctagatagccacatatacaatgtggggtccagggaaaatctggatagtgccacatatacaaggtgggaccaataggagaatagatattgacttacatctgatgaaatatatttcagcataaattctattaataaaggagcatcataagtgagttacatgaatggtgcgcaacatttgtgacgaaattatctattgttttttgacgctattttaaatttcgtcatggagtttcgatgtctacccctgcgcatgagtgatccgtgacgaaacatgaattttcgtcatagatatgctctgttcaatgacgaaattatacaacgtcacgagcaaaacgtcatagatggacgatttcctactagttgcaggtaagttggagctgggagctagagctgtgccaaacagatcctaaacgtagttaataacaaaaacaaattacagattccgccaggaaactgcgagatgaatttattaagcataattaatctgtcattagcaaatgtttactgtagcacaacattatcaaatcatggtgcaattaggcttaaaagattcatctcacaatttacatgcaatctgtgtaattgttttttttcctacatttaatactccatgcatatatccaaacattcgacagcgtgaaaaattttattttgggaactaaacagggcctaagagcatcaccgagagactcaaaatttcatccccaaaatttagattttgggattattaaacagaatttgaggtttgaatacattgatctctcctagtgatagcctaaaattaacttcctaaaatttaaaagttccccatttaaaactaccaacaaaaaaaaatatttttttctctcccagaccgatgtgattccgaatcccggtcggccggcgacgatgttgctcgcccctccacgcgacagatctatttttcctcccctcattgacattagcaacaacatttagcagcattaggatgcaaggagcagcttcaggccttcagccaaagtaatcatcatgcggatcatcaaacaacgacatgtatcagcaaacatcagtagcaaactagtagcaattactatggatgtgactagacagctaccgatcgctgtgtaatcggatcgtagatcggatgagtagtttaagagaattttatttgaagcataggtggttcctatttgcttgatgaactattttcagtagagtaatggtttcag

SEQ ID NO: 43128 - DNA, 7162 bp, Oryza sativa
  unsure (1)..(7162): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattgatggcctgtttagttcgcgaaaagaaaatttttgggtgtcacattggacgtttgaccggatgtcggaaggagttttttttacatgaatgaaaaaactaatttcatgacttgcatggaaaccgtgagacgaatcttttgagcctaattaatccgttattagcacatatgtgttactgtagcactttatggctaatcatggactaattaggctcaaagattcgtctcgcaatttcttctctaactgtgcaattagttttttaatttatctatatttttaatgcttcatacatgtgttcaaagattcgatgtttttttgaaaaagtttttggaactgcctgaagatgcccgagtaccaaacagaaaatttgctgcgtgcatatgacgtgatcgtgcgcaaatactccagttcctaaggacctgtacgccaaagggacgtcccctccgctcccctccccagatcctctctctcgaatcgtctttgggcggccaacgcatcttcctcttcctcttcctccatctcatctcaccatcccatccacgcttctcgactcccagacgacgctgctgctgcctttcgtcaaccccccacttctccttccccgccgccgctcgccgccatggatgaggagtacgacgtgatcgtgctggggacgggcctcaaggagtgcatcctcagcggcctcctctccgtcgacggcctcaaggtacctctctcctacccaatccatccgccgcctcccgtgctcggatcggtgctccccatcgtcgtcgatccgtagatcgccccccacttcatctcatctgggcttgacgctgccgcactcggatgagctgctgccattttgatcgctgatttacttagctatgcgagcgtagcgggatggtaatttgtccgtacatcgtggctgggtaggtggtggcgccatggttgtggtggttgctttgcgtttgggggagggatcgtcagtgcgtgcctgagcttacgacttcccttatcccatttaaaagagtagcggcatagcgattttgggggatttcacaacaagatctaactaaacagatcggatgcacttttcaatgtttttgcaggtcttgcacatggataggaatgactactatggaggagattccacctcgctcaaccttaaccaggtaagcaaactgcaatgaacttaatttgaccagtacagggtctatatcttgtcgtcatatcatgtcaaggaatgcttatgttattacagagtacattatttcttttaattttttgtccttgttcactgacattgttttccacttcgctttttggaatagctgtggaagaggtttagaggggaagacaaacccccggctcatctgggctcaagcaaagattacaatgtagatatggtcccaaaggtgcaactgtcactttcccccatcataatctatcttgcttctatatttagtattagcagctaacgtacgtggctagtgaggtaccatataggtggggaacctcaaaaacagaaatcccgtgatggtgcataagttcatcttgatgagaacatttagatccttttatgttacaaatgtggttattcactggtttagaaaactatgtaatctcatgtgtataatactcaaatggaaaaaaaggtctgaaaagtaatgattgccctgatttttgtagattgtcaattagtcggatggtttattacaagcgctaccactatggttccttgagtagcgtattgctgttgcatgattatctaaagtcctctcttttttttatctccgcagtttatgatggcaaatgggacactggttaggaccctcatacacactgatgtgacaaagtatttgtcattcaaagctgtcgatggaagctatgtcttcagcaaagggaaggtaacatcttcagctcatttcctctgttttcattagcatcacatttcctctagtgttttatacttttatctaagtggttgttggatctatattctgatcttattcctatgctagcagtgtaacatgcacttttctatttttgctgtcaaccagattcacaaggtacctgctactgacatggaggctctgaagtcccctttgatgggtctttttgagaagcgcagagcaaggaacttcttcatttacgtccaagattacaatgaagctgatccaaaaacacatcaagggttggatcttactacaatgacaactagagaactgatagcgtgagtacactagtgtttcttgcactgtattcaaccctttctcagtagtgcatggcttccttttctaaatgaaacaatagatttggggcatatatactatatttatatgggatatattgttgtagacttatacatgccctaatgcatacgtgaaatgtcaaacataatgacagtgtgcgggcaccggcgcatacatgaaaccacgtaatatgaaaaaaagaaaatgtgcacttcatagcaaagagaacatccattgtatcatctgtccattgtgtagaactttagaaagggtacgatagacagacttttgcatggaatccatatgtggcacatggcagtctttacatgcgtagcaacaccctaaaacttactggtcactaatgattgctaaatttaggataactgttgatatgactgaaagatttctctggataaaattaccttggtattagaaaccagcgtacttaaatttattttttcgatctgacacgggagtacttaagatacggatgcagttacattattgaaccaagcaacacatttatgttatatgctgcatgctgtggtactgcattacaagcctactttgtgctgctcatgaaatgtagaaaccttgatatcccttttagggaaaataaagtatgaaagcagaggcatcagagcatgggttgggtatctagtgtgtcacatcaatgagattctcactgcaaaattttaatttgcgttatttttaatttgttgtgtcttgactaatgtggacccacttaaatatagattagcttctattgtaacttgtaagaagacttacatcctgatggatattcttgtcgtcttctagtagttgtgttctgacaaaaaagtagtacaaataattgccgccacagaatatatcatcaatttaccttcagtctttcacatgatgcaaaaggatatatctatgcttcttttaccttttctgcatataaataactctgtttccatttgccctttcttttccagaaaatatggtttaagtgacgataccgtggatttcatcggtcatgcacttgctcttcatagagatgatcgctaccttaatgaaccagcaattgatactgtaaaaaggatgaaagtaagtattgatcaaagctcctgtagattgttcgtagtcttctgctacggatatcctgctgttctctgaatattcatgctttatgaagttcaattacattttagtgctttatctacttgtagctatatgcagagtcccttgcacgttttcaaggaggctcaccttatatttatccactctatgggctgggtgagctgccacaggttagtgaaattttaatgttaagtaaatacctgtcatactgcatgtgcatgtttttaagatggtcatatataacgctttcttattcaaatatttcttattccacagggttttgctcgtttaagtgctgtttatggtggcacttacatgttaaataagccggactgcaaggtgtgattaccatcaaccctgtcattacttgcatctctggatgaccagacaacctaataaaactttttggcatgccatacatgatcttaggttgaatttgatatggaagggaaagtctgtggcgttacttcagaaggtgaaactgcaaaatgcaagaaagttgtttgtgatccttcatacttacctaacaaggttaattttctttcctgtattcaatttatttaccacatgaattttctttcagtatgttcatttaggattcctagatgatgtacttccatcttaacacattcacagcaaatttactattttttcttcttcccttccatttgttgagaagttttattaactacaaccacatttgatgttctgtatacatttattaacaggttaggaagatagggaaagttgcacgagcaattgctataatgagccacccaattgcaagcacaaatgactctcactcagtccagattattttgccacagaaacaacttggacgcaagtcagacatgtgaggcctttctcaatcacaaacaaatactgctcaccttatgaattattacatttgcttgcccattgcttttaacaaagtttatttattcccattttgtaacatttttattggtattctcctgttaggtatgtcttctgttgctcatacacacacaatgtcgctccaaaggggaagtttattgcatttgtatctacagaagcggaaactgacaatccacagtccgagctaaagcctggaattgatctacttggtcaagtagatgagctattttttgatatctatgatagatacgaacctgtgaatgaaccatctcttgataattgttttgtctcaactgtaagttttgcaatatctgatttttgaaatgagcattaagtttgattgtctagactgtaacatatttctggtccacactccctgcagagctatgatgccaccacacattttgagacaacggtgacagatgttcttaacatgtatacattgatcaccggaaaggtagatgtgcttccgcctttcattttctttaatctttaatacatgtaatgcttctatattttgtttgaaacacctttttttggaaaggatgaaaattagccgggaggctatagagaggactagagtaccacatatgttgtaatagcttgacttttgtgtcaccttaaattctaaatccaaatccattctgttggctattgtttgttttacaattatgtattctacccttttcctaattcttttctcattgcactattgcaggctgttgatctcagtgttgatttgagtgctgccagtgccgctgaagaatattagatttcacaaccaaagctcaatcatttcacaaagatatgctttttcttggtgggtaccgcaggacagatcgtaacgagtgactggtatagttattcaaactccacgttataccgagtgttctggccaatatggcttgttgctagcagtaatatgcacaactgttggccaagatgactgaaatgatggtggtttaatttgatacttcagtaatgcaatggtgtaaacagtgtacacactacacaatgacggtcgggcgttttgtgactgatgtatcataactgctggataattttgcatgtctacttctgcagtgttgtgttctttaccttgcattttcaggtttcagttgggtgtgcctgcctccggtatcagccggtagggtagcatgagtagattttaccgagtcatgcgaatgaaaattataatttaacagcttaacctacccagaatatcttattcctggttggattaaccaaaacttcaggacaaatttaaatgtgtttgacgtttctatttgttcttccggttctacctgggatacattctcaccgtttggttggttaccgatgaaatttgaaggcccattgtccgcttgcaaggaccgggaaatttaaactatttgccacttttacgaatggcaactcttcaaatgctatccttatggttgttcttacacaattgtcatcggagagacgtttttaataatttgctacttttgctgatgtggcatgcccctcatactgccagcgtggttttgctgtgtaaattttccgttttacccctgatgggccctacaaatcggggaaatgggaaaaggagcaagagagagaggttcaactgccgtctcatcgtcgtcgattcgctcctgtgctcgccgccgtcgcagcagtggagggaggagagcgcggtgaggtcgggtgcctggggatccgttcgtagccgctcactgcctcacgcgacgcgtaatagtggcctagaagcggaagaggacgccgtcgttggggttcagcttggccgcatcgaggaagtgctcggccaccgccgcacggagcagccttttcgtggcatccgtctcattcggtgatgcattgtccggccgatgcgccggggctagtcgactccggcgctgcacggcagtcatatatggcgctatatatgcaaaaaaaaaagaaagaaaaaaaaaggaagaagtttttgttttctctctgacgatggccgctttagtctcacaggacattgacgacatcgatggatctgatcaaa

SEQ ID NO: 43129 - DNA, 2866 bp, Oryza sativa
catcagaaaaaaggtaaattagaggctacctatgaaaagcgattgcacataaacacacgcggcaacactatatgtttactgtaaatcatagggcaaaattatgccactatctaaccaatgaggactttacagtgcctggtatcacttatcaacggttgagttgccaaaaaggtaacttaggaatagaaaatagtaacacgaaaataggataaaagataacttaggaatagaaaatagtaacacgagaataggataaaaggtaacttaggaatagaaaatagtaacacgagaatatgataaagtaacttagggatagaaaatagtaatggttgagttaccaaaggatagcatagggatagaaaataataacacaacaaccgcaattgtattccaagttacaacaaccttttaacttcttcctggttttgtttgcagccagcccactccctcgtccagccattagatgatcacacgagctagttcaattattgctaaataccatgaaaatcaattgctcggggttagatgtgtgttttagtaagttacatcgcaggtataattacatactactttgcaaatttgttcccagcaagtcatggaatatatatggggcaattgcatccatgtccccactttgaaagccaattgttgttttgcccccattttttagggtttgcatttttacccccaccttttgaatttgaagcagccgtctacccccatttatgacagctatttggtgggtcccacattatgtgttaaagaaataccaaaagaaataaaaaaaggttttaggaattatgtaatgacacttctacccctaagggaaagtgaatggacaggattcttctcttcccgtgcgttgggactccttgagtggagtcaactcaaaaccctagctagtagtcagcagcggcagcgcacggcggggagcgcgcgcggctgtgaggcggtggcgagggagcccgcgcggcgcggaggcggcggccgaggagcgcgaggcatgggacgggaggcggcggccgaggcacgcgcgcgagggagctcgcgcggtggggaggcgacgtgcagaggcgcgggcgataggcagcgtcggcggccgtgtgaggaggcggcggcggccgccgccgcgggtgcgggaggccgcggccgagggcgtgtcccggcgcccgctcgcaggaggtatacagccgcggccagttctcttccagcgtggaggcggcctctcacaggccgagggcaagacaaggcagaaaaggggaagttgttggcaatggaggaaatcatatcaatggagctaattttgatggaagagttgcacagataatgcgattggcttgtcttgctatcttatgaaaaatagacatgaaaacttagagctagctaaatctagatgaaacttagagttagatacccagatatacttagatatacttgaactactagctagtatgcattttaatcttggggctgcattcagtacggttgctttttcgtctctctatataactttgctatttaggacgatttacctaaatgtgccacttgtgttgtgatttgtaggcctactcacagcgatttgcaattagttgttagagttgagtcttttttaagtttgccggatggaggtccaaagcaatacctctagggtaaaaccttgccaacccaaaatattgacatgcataagtatgatctgctgcaagttgttaatttcattgctgaacactacacgtggggatctaagcaatatgtgagtttgtgacgttctttggatgatggttttgttgagataaaatgatggttttgttgagataaaatccgatgaacatttgcgggagtggtttcagctcaatatagataagggggttgtgtgcattgatgccaaaatcaatgatttcaatggtccattgcaattttcacccacaaagcgtaggtttcattcttcagtaaggtctagagcatgcataagtgagattgccacaaatgagggagccaaaaaaaaagagagccacaaatgaggaagctactaatgagggagccaaaaaaaaaaaagagagccacaaatgagagagccactaatgagggagccaaaaaaaagagagccaagaattccaaaaaaaaggggtcaaatgataaggatgcagtaggcattgatgatgagggcatatactctgacaatgaattacttgtggtacatagtgatagcagctatgattctgatttgtccgaatcttccgactctgattgttctgaccctaagtttgatcctgatcaagaaattattgatgagggtgatgatgatgatgtacctgtctttgcatatgatgttcaggatccttgtattgatgttggtgtagtgttcccagatgtggatcaatgcaagttagcagttacccatcatgctatcttgaatgatcatgcttttgaaactgtcaagaaagacaagaaaaggtttagagccatttgcaaaagagcagaagagggttgcaagtggtgttttttttttgcatcaacaagccctaagtacattggatgcaaggtacttttatatgtgtatttatgaatggttattctgtttggaatttttgttcaagctgaaacatgagctattaattctttgcttgtaggtcaagacaagtggaccaaagcacacttgtggatctttcaataagtgtggtgaaacaatggtcaccactaagtgggtagctgatcgagtggtggacttgttgcgggataactcctcaaggggagcaaaggatttgcaggaggagttgaataggaagcatcagattgatatcccatatttcaaggtcttcagaggtagagagagcacttgacattataaatggaaagtgggatgacagct

SEQ ID NO: 43130 - DNA, 2267 bp, Oryza sativa
  unsure (1)..(2267): unsure at all n locations
nnnnnnnnnnnnnnnnnnnnnnnnnnnnnnnnnnnnnnnnnnnnnnnnnnnnnnnnnnnnnnnctacgatctgctggctacctatcgggaagagctattgagatcagtgctaggcaaagtatttgaactggacactaaagagtgcaatggtgatgtctgctttaggaggttctttgttgctcttaaaccctgtatcgatgggttttttggaaggatgtaggccttacattgctatggactccactcacttgactggaaggtccagaggccagttggcttcggctgttgcaattgatggtcataacaggctatttccagtggcatatggggtgattgagacagaatctaaggaaagctggacttggtttgttcagaatgtgaagaaagctattggtactccaaaaggtatgtctattcttaaagttgtttcttgcatcctccatcatttcaattcatatttgactaaccacctactatactcgtactgtaggtttggtcattagtacggatgcagacaaaggaatagaaagtgctgtagatgatgtttatccaggagtggaacatagagaatgtatgaggcacctctggaagaccatggaaaagaagttccatggccctctatttgcccaaaatatgtgggcggctgccaaaagcttcacaaatgagaagttcacataccacataggcaagatagaggagaagtgtcttgaagcactttcttggttggatgacaatcatccatacatttggagtagaagcaagttttctaacgagtgcaaggtagattacatcaataataatctttctgaatgtttcaatagttgggtctcaagaaccaaggatcgacggattgtggacatgtatgatgcaataagatagatgatcataaccaagtttgttgcaagaaacaactttgctggtaagatggagggaagaatcattccagctattacaaagtctttgaatgctcaaagcaagaatatcaaggaccatgaggtattgatatgtggagctgggacagctgaagtaactgtgggcaccattaggcatgccgtacatttggagcaacaaacatgttcttgtagggtttggcaagtgactagaatgcctcgcagtcatgctttagcattcattgcaaagcttagcacggatgtccatatggatgattttgtggatgattgcttctccgttgagaagttcaagaaggcatatgcaaggactttcaatccaatgacatcgaaggatagatgggcacatgttgatctaggctacaaaatcaagaagcctagtgtaggatcgagatgtcgactagagggggggtgaataggaaatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcttatgtcgatgttttgcaatcctagggtgatatgatctcaagtgtgtctctagaaaagtaaatcgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaaaccactcacaaaccggcgccgggcctcctccacaatcttctcggagaggtcaccgggcaactcctccacaagccgtctaggagacggcaacctccaagagtaacaagcaatgacccggtgtggagatgatcaagtgccacactagctctacaatggaagcaaatgcactagactcttggctaaacaaccctctaacacactagatagatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggccggtcagaccgacatggg

SEQ ID NO: 43131 - DNA, 13983 bp, Oryza sativa
tatttgtgatttttaattttttttaccatggactgctcatttgttgctctatgcaatgaactggacacagagttgctgttgcattttttttttggaacaattcacaaccctgttgtattatccatgtacaactaaatgtggtgttgacctgtagtttaggggttcagagtgaatgcacgtgcttaggccgttcaaagcctcacattataacactcacacaagctgaaaaaaatgggaggcaaaatcacacaaagctgaacaaaatgggggcaaaattacaataaccaccaagggtatatatgtccttttctctacaactaacaccgttagttgtggctgttaggaatgggggtacatggctgcttcagattcaaaaggtgggggtaaaagtgcaaaccctaaaaagtggaggtaaaacagcaattggcttcgaaagtgagggcacggatgcaattgccccaatatatatacctaaagcaatttgatgagtcttaattataaatgtaaatgggaatcaaatctcgggattatttttgataaattatttgaggcttactcagttttgaaggaattttaacgcataggaataggaaaaatgaagaaatagaaatacatgcacactttaactcataggaatttttcaagaagtttgaggggatgaaaaatttcctacgtttacaacttgtagaaaagaaatttttttcctttggttttcctatacttacattcctacaaacagaataatacttataggaatcaattaatccttcagaatccaaatccgcttctcccgttctctgcgactccacctcccgattacctacctcgcatgacagctgtgcgatgcgatcgatcagagaggatcgtagcagccgtgccctcccgggcagctgtccgttcgctcattttctgcaatggaccaatggcgcatccggcaaacacgactctcccctccctgtgcgtgtatgggagcgcagcagcggcggcacgcgggtgcgtcggccggtagggatgcaagtgggtagtcctgctacccgcttgctagttcatttcccacatggtagtacaaaatttagaaaaaaaaagaattagaagtgagataagtgggctaaaataacccgcttgcatccctatcggccggccaacagcgcatcacgcggggctacggcctgttggcaagttacacataagtattagcagggtatttaggtatgttttcaattttctattttaacagtaaattgctgtatcagattgtactgttgtattgtagtgagtgaaaagcattgatgttggtttgatcaatgagttaattcccaacagtaggagatctgacagctagtaaagaaatttgtttgtttccaacaaacaaggaagtatagtgagtggaccatttcagagtgtggagtgagaaaaggagtagttcaatgagttcgttgacaagagtaggagagtgagttgataggtatacaaactcaatactagcaacttgtgtcgtatcgtttgttaccaaagagagatttatgttgtgcagttgactcgagccaatacatacctagcaataagaaagtcaatataccatacctagcaataagaaagtcaatggcggccgtattctgaaatcgttggataagttattgggcttcctcttttgtacatggcgaagcggccgtctaatcgaatttactaggagacttgtatctcatgctaattattcactctttcaatgttgtctttaagacattgagctttcctatgtctgagaagagatgccatactaataggctggccaagcaaagcctaggttaatttaggtgaaataatttttactttgtcactattattttaggagatatgaattttaaaatttatattctagaaagtaccatttattccttaggtagtcgtttgcaatacttttaagagatagttttgtcaaattttactctatagcactaaagagcatagttttctaagatcaacccaactggtctcataatcttttaggcttatacgaatttcttatgcattgtacaaatcgtagtgtacatcaagtgaatggtatgcaatacagaatttcaaatgtgttttctgcacataaggtgccaaattttagtttctagtaatgaagggggtaattttctttgtccattaaaactgcgttcatagtttttggtacttatgtgaatttcctacatatattacaagttatgatccatattacgttgctacataaaattttgaaatgatttatcgtacttcatgtttggctcacccatttcaagacaggattgaaattctatgaattttacagcttatgcagttcattatggtaatatcttaatactaaaaaaaatagtaccattttctgtgcagaaagttgcatgtaaatctactgaaatatggcacacgttagatggatttaatatgaattttctggagggaactacaaatcgggtgcccaattcccttaaaaaaaatatcgggcggtcaaatgtttccgttaactatcgagcgaaacattaagttatataatgtgaaacaaaaaaaatccaattgaaacatttgaaaaaatttgtggaacacagtgaaaacacatgttgaaaaatactgttatcacatatgaaacaatgagttttaacactttgaaacaaatgtatttctttcatgggattatagtcatgcgatatatttttaattacaatagatacgacggtgtgattggatcgtagatcagataatagtttagaagagaagattgctatatgctaattgcatgtatgaatggagtagagaaagcaaatagttttagttcgttagttttatgaaacacattgaaaacacatgctaaaacatatcactatagcttatgaaataatgagttttaacggtttggaacaaatgtttcttttcatcagaacataaccatttgttatcttgttataaaaatttaattataatgaacataatcgtataatcggattgtaatgggattagtttaagagaaaatatattttaaagattgtaaatggaatgaataaagcaagacgatagcttattgttaggttggagctagcggccgataaaattttctccgtcggtctactgatccatagctttctcctattttccgcatatttttgaagtttattctcttttcagttgaacaaataatggtttaacaattttcctcgaattttccagattttaaatctgcggcaacatgtcttcttgcatctaggcccctgggtttccaaagaatagatcccacggtccccacatgtgttaagcaaagttcttgcatgattggccttgagtaaggcctgaaatgggacttgagtgcttacgattgggcttgctttcactcccacttgtacattactagatgtgattaagttaagcttgagtttggtcatgccaagtaattctaaatctcgatgttctctatagaattgccattaatagtaacttttatttagctctagtcattttcgtttttctcctggtcaacaagatttttgatcttaacaaataaaaattgataagattttggtcttgacagagtggcaccacaaaaggagtcctcgcatacgtaatcttacaaaaatgaatgaatccaagatttattacttctcttcagaacattcatcaccggtctgaaaatgtgttaggaactgatgaacatgcatgactaaggtctgcaattatcttttttttttagagaacacaaaccaaaactatctcgacaatagctgtcagactcattctcaaacattcagagttcaggtagactaaacttgtaggctgatttaacaggaaagtctttttcttctcgaggggatgtcccatatgcatttcatcttttttatttttaaaaaatattaatatataatatattactccataaacatataatttcaaattcaatcactacaagttgctttaaaaaataagactgaacatacacgtaccagttatagtttaattcgtctttttacaacttgtagaggttgaaattaatgttacaagtttgtgaagtgatatatttttctatcttactatttttctaaaaaaatcatatgttatttgaatgatatacaagaaatgaggggacattctcttgaggagaaaagtcatctctgcctgaatactgcacctcttgatgtagaggctaaaataatctctattattgaaaaaaagtagactgaaattattttccagaattttccaacatcacattgatcttatttgtagtcttaagaaagaacataatctgcagagtacataaatgcacatggagtctatgcagtggaccttgactggcatggagagtctttaggaaaatgccagaccacttgagtgactcactgcagcaatacacaggcagttatttcctcacctgaaagtaagcatgttgccaatgccactatcctcgagatcacattcaagcctaaccactccgctagaaagacaacctaaaagcaagctaggtaactactactgtctgcacaaatgagaaagatagctgaaccatcaggacagaacacacacacacagagacatacatgtggtgtttggatcagggactaaattttagtccctattacatcggatgtttggacactaattagaagtattaaacgtagactaataataaaactaattgcataaatgagagataattcacgaaacaaatttttaagtctaattaatccataattagtacatgtttactgtagcatcacataggctaatcatggattgattaggctcaatagatccatctcgcaaattagtccagagttatgaatgggttttatcattagtctacgtttaatacttctaattagtgttcaaacattcgatgtgagagggtcatatctacactacaacttattccattcttcaattttgtattttctcggctgtgtttcagaatattctccagtcaccatcttgtatacatgaggccggggactctgttccaatatagtttttttttgtcaattccgaaccttatttcttagcatacatgtagtggtcaccgagtgagatggatggataccagaaccgacatgcatcactatactactcaagtatgtaacttaccatgttttatctctcatgatacataactgggtaaaacacaacgtatgctacactagacctataagatgaatcaggagggaacattgttcatttgtgttggcgtctttttcagccaacaaaaagtcacctaaagatttaaggtgatctagatgatagggaatcaccaaaactggctagcggagccgatttattgattaaaaccggactctaagttgatttagatcgatttgagggtatacacctacaaaatgaacgaattacacccgcaaaatgaacgaattaaaaagtttacgagataaacatataaaggatgtcacactctcgtaaaaaagatgaacgatctaggcgcaaattaacaaagataaactaggattaaaaaactaggtaaaaggtaaagaaagaacggaattggtgttcaccttttaccaaataatttttaatattacagagtcatcttgtttcagccagcaacataagctgcagaggagcaggtggggcatgtgcagtgtgctgcctaattaaaatcacatcttaaagcattgtactaccaagtgtcaaacacaaacatgccgtttatcctaagcgaagcactactgttcactttcaggcctcataactgtgccagtgacgacaacagatgaatttgagcagtgctggttgcaccagatctgaccaccagcgccatttgagccatggaaacaacctcattcctttcaatttggtacacacacgcatacgcgttcagcgttaggggcataagcgtaataagccgatgcgcgtcatcgggccgagcctgacgcctctgggaagataactattgtcagtgacagctggatcattgctcactacacaaagctagcccagatgaaagcagcagcagcagcagcagcagcaggtagcatatctgcagtgtaaagggggagacttgacctgagatcagatgagatgagatgagatgatcttttctctgtgcttaatttatccccccctttggtttgctcttctgtccttccctctcaaagtaagcagcatcagatgcaaggggtgacaccaaaggctggcacacattctcttctctcccctttttttttcctctctgctttctttcttctagcttccttctccaacattccaaatggtgatgctctgatgacctcctggctagcttctacacacactccaagaatcctctccagtgatgtagtatataaacctcatgaggggctaatcccttgtttgcatcaggggatccatctgaataattgatactggctattaagtcagtgattatttctgtactgtgctattactgatcgatgcaaatgcccttctgcccgaagctctggagctcggcggcgccggcgccggtgcagccggggagcgtggtcatcaatggcacggtggtcgtcgccaaccacttcggcctctcggctcccggcaagtccaccaccctccgcctcttcagcggcacggaggtcgatcacggtgagtaagtggcgtatgcaactaatgtctgaaactctgaatccgatcagcgctgaaagtctgaaaagaattgcagagacgaggaaggggaggctgagcgcggaggcggcgttgaggggagggaagaagacgaggcatgggaaggcgagcacgacgatgtaccaggtgacgttcttcgtcgacggcgagttcgggacgccgggcgccgtggccgtcaagaacgggaaccggaacgaccagttcttcctccggcacgtccggctggacctcgccgaggaccggagcatccacttcgactgcaactcctgggtctacccctataagaagaccacctccgaccgcgtcttcttcatcaacacggtaaacacaactaattccctgcaaaccgtaatactccatccgttttatattataatttattttgattttttctataatcaaacttatttaaatttgattaagtttatagaaaaatataatagtaatttcaacataacaaatatattgtcaaaatatttcaatgctaaatttaataaattaatttggtgttttagatgctactaagttttctataagttttgtcaaacttaaaaagtttaattaggaaaaaaaataaaataacttataatatgaaatggagcaagtatactacgatgacagagtctaagttgtttgaccgattttattccctataagatatacggcaaaactcatgcccttctggtttcaaaaaatacaatgagatgtcgcgtacagctaaattgatttttttttcactgaactgataatgatcgaaatgtttttcttttatgatataacgagtttaagttgaactgacctatcattctgcagagctacctgccagataagacgccagaggcgctgcggctgttacgggaggaggagctcagaagcctgagagggaatgggcgcggggagaggaaggactgggagcgcatctatgacttcgactactataacgacctcggcaaccctgacaacgatgaccatgtccgccccgtcctcggtggcaccaagacccacccctaccctcgccgctgccgcaccggccgccccctcagcaagaccggtacttccacacaaaactcatctccaagtctccaaaatttctttcttagctaataaatagtacccgccgatgataatgttgatgagtagtagaatactatcagtagagagtaccatatcagtagagagtatcataaaaggtagtcaactaattgagcatatgaaaatattttgtggaagacggggtgacggagacgcggaagcacaagctgataaacctggactactacatcccgccggacgagcggttcagcccggggaagctggcggaggtgctggcgatgggggtgcaggcggtgacccacttcgtcatcccggaggcccgctccatcttccacggcgacgtcgtcaacttcaagtccacggagcagctgcgcgccgacctctacggcaagccgccgcagccggcggcggacgccagggtcatggacgagctcaagtcctccgtgccgtcgcacaagacgtacaagcaggtttccaggattgtcaaggacaaccccgccaagttccccacccctcaagtcatccactgtacgtactgcgtctgtgccagtacgccatggcattgcagcttcttgatgatctcgcgcgattgaatttttttttttgggggaattttgcagatgacactgaggcgtggaggagcgacgaggagttcgcgagggagatgctggcagggctcaacccggtggtgatcaagcggctggaggtaagaacagctgaaaatgttttgacatgtttgatgagctatgttgatgtgtgattcgtgctttacaagtggatatatgtttttaatcattttttcatagtattaaatatgggttcgtgtctaactcttcgactttcacaaggtgtttcctccaaacaagagcaagataaccacggacgatatcatgacccagattggaggtctgaccattcaacaggtatgtgcatccacgattctagatgaaccgaagatctaccgttccaaaatcatctatagaccgttctttgtaccttttttaagattacaccgtagacacacgcacacacacgcaatgccacactcacacctccgcaaatgaaagcacacctgcatgtatgtaatattcgtgggcatcaggatttgaaccctggtagagtcatacatccacgagtataccaccacaccactagtatgtacgtaatatttgtgggcatcaggatttgaaccctggtagagtcatacacccacgactctaccaccacaccactaatgctgcccctaaaacttagtatcttaacttcttaagtagtagttatttttattagtgtaaaattatattcctcgagatactttctgtcaagtatgtaccgggataccgccaaatttctcttatattatgttctctaatatgtttggtttcatctattttcatttggcaggcgatggagcagaaacggatgtacatcctggaccaccacgactacctgatgccatacctccggcggataaacacggagggggtgtgcgtgtacgcgtcgcgcacgctgctcttcctcagggacgacggcgccctccggcccgtcgccatcgagctcagcttgcccgacggcggcgtcggcggcagcgagatcagcagggtgttcctcccggcgagccagggcaccgatgcgcacctttggcacctcgccaagactcatgtcgccgtcaacgattctgggtaccatcagctcatcagccactggtgagtagggcacacgcctcgatcaatcagttttcagtactgtcggggtgaaatctttgcaaccttatgtcttaaaatttcagttgcaaatttgctatgttatatagactccctcgactttatacagtttgcagttgtgccactaacacgtgggccccactttacaatgacccacgtgttagtggcaaaactataaattgtacgaaatcaggggatttatttccgtggtttatttggttttaaaccattttatgagtttttgagtgcttctgtccaaacatccccttttgtgatcaagttttgcagtgctcggtccaagatttcggccgagtttacttccaaactttttttttttcaaatttttaactttttcatcatattaaaactttcctacacacacaaacttccaacttttcttgtcacatcattccaatttcaaccaaacttccaattttggcgtgaactaaacacacccttcattgtttctgaaagactgaaactccgaattctcatctcaaattcttgttccgaaacaagaaattgctcatctgcaattctttctgtaacaagacatttctctgaatgctgatatggaattattcttgttctgagacgagtcatttgtctgaattctgacatgaaattcttcttgttctgaagcaaggcatttctctgaattctgatatgaaattcttcttgttctgaaacaagacaattctctgaatgcttgctgacatgaaattcttcttgttctgaaaacaaaatatttgacttgaccataaaaatatgcaccgtcttaatccatgaatggaacaggctgttcacgcacgcgacagtggagccgttcatcatcgcgacgaggaggcagctgagcgcgatgcacccgatccacaagctcctggacccgcacttcaaggacaacatgcagatcaacaccttggccaggagcatactgctcaacgccggtggcctcctggagaagaccatgtacccggggaagtactccatggagatgtcctccgatatctatgcccattggaggttcaccgagcagtccctgcctaatgatctcatcaagaggtacaaaatacaatcaattcatcatcccaattcctacattgccaatgaatagaaccacaaattcttaatttactgcatgtctgaatttttagttacttctcggtgagatcaacggctttcgatccgcctagccacttcaattttacaattgcggcgtacacattaatgtcccgtagcaacacacttggtatcatttggtgcattttatgatagccaaatatttgacaacaagattcaaataaaattttaaaaattccatgaatcaactgtatattaataaaaaatcttacataaattctgggaatgttaaaagttcgaatatattgttgttttaaacgtaaaataattttgactagagagagtagaattgatttgagaatttattgttaactaaaacatttccaaccagggggatggcgtccagggaccccaaggcgcgcggcggcgtgtccctccacatcgaggactacccgtacgccgtcgacggcatcgacgtgtggctcgccatcgagggctgggtgcgcagctactgcgaccacttctaccacgccgacgcggcggtggccggcgacgccgagctgcaggcgtggtgggacgacgtccgccgcgtgggccacggcgaccggcagggcgacgccgcgtgctggctggacctcgacaccgtcgcgggcctcgtcgagacgctgtcgacgctcatctggaccgcgtcggcgctgcacgccgccgtcaacttcggccagtacggctacgccgggtacccgccgaaccggccgacgcggtgccggcggttcgtgccgctcccggggtcgccggagatggcgcagctggaggccgacccgggccggttcttcctggagacggtgcccgaccggttcacggcgacgctggggatcgcgctgatcgaggtgctgtccaaccacacctccgacgaggtgtacctcgggcagcgcgcgacgtcgacgtggacggacgacggcgaggtgctgctgctgctggacaggttccgcgacgagctccggcgggtggagaagagggtggaggagaggaacaaggaccccaggctcgtcaaccggaggggccccgtgagggtgccgtacacgctgctctacccggacgccggcgacgtcgccggcaaggagaaggggatcaccgggagagggatacccaacagcgtctccatctgacacgattcatcatccttcttctcttatacttcatctatccgactcgactcgacgcgtgtggaatgtaaagttctctgcttttctttttctttcttttcgtttgagagttttggtgttggggatgtgaaattgagattgattggttggtttggattggagaattgatgagcaaactgtgatgcagaattcaatacatgtaattattgttctaatccaaaagcccggtaaagaaaacacggtcgatggatataggccgatctctcttcagaactgctcagtaaagattctttccaaagtgcttgcaacacggctgcaaagggtactcccgatgatgatacatttagaccaaacgggtttcctcaaagggagatgcatctatgagaatcttatatatgcgacggaattgattcaagcatgctacagaaggaagtgccaaactattattgtaaagcttgatttcgcgaaggcgtttgattccgtcatttggtcaagccttttcaagattcttgctgtcagatgtttcccagaaaactggattagctggattaaggggttgctttcctcctccaagtctgcagtgcttcttaatggagtccctggaagatggattcgctgcaagaagggccttcgacaaggcgaccccctatctccatatttgtttgtcttagttgctgatgtgctacaaagattgcttgaaagaaatactgaaatcagacatgcaatctaccaagacaggctgtgtaccaccatccagtatgcggatgatacattgattatctgttgtgcggaggaggctgatgttcttgctctaaaggagactctgctgcagttctccaaggcaactggactgcaaatcaattttgctaaaagcactatgattactctaaatgtcgatcaaagcaaggaactagttttgtcggattgctacagtgcaagctggagaaatttccgatgtcttatcttggacttcccttatcaattcacaaactgtccgcagctgacttgtagcctctggttaacaaggttgatggtttcttatctggttggtaagcatctctcctattgcaggcggagcgtcttgttctgataaacgcagtcctgagcagcctaccggtgtatgcaatgtgtgccttcaaacttccaccaaaaattatagaagaaattgatagacgaagaagggcttttctctggacaggggatgatgtctgctcgggagcaaaatgtctggtttcttgggaatcagtttgcaagccaaaagaacatgggggacttggtattaagaacttaaagattcagaacgaggcacttcttctcaaacgactccttgctctttacaacttgaagacctcctggactcgatgggtctgggacgaaatttcagattcctcgttactgtgctcaactcgtctagggcatcactgggcatcctttcaaaagttgttgccagaactgcgatctttgacggaagtcgtggtaggaaatggtgagcgaacctccttttggtacgacaaatggttttcgactgaaagcttttcaagtcagttcagcaatctcttctcccatgtgtgtgacagacaaatctaagtaaaggaagctcttcacataggaatttctgaaaatcttgttccacgtttatctgaaactgcatcggcagagctgtgctgcttacaggaattgctgcagaacttctctccgagcgaggagatggatttccgcctcagtgcaaagctaggaaagttgacaactaagaaattctatgaggcaagattacccccaggcatgccatctccgaactgggatcttatttggaagtgcagagcacctctaaaagttaaactcttcgcatggctactggtccgtaatcgcctgtccacaaaagaaaatttgctgaagaaaaccattgttcaggaggcaatctgtgacatctgcaatcaggaagatgaaacagctaatcatatgtgtttctcatgtccgttcgctcaggctttctggacgcagatcaacgttcgaccgcaagctcaagacgtcacgcagttccatcgttcgggtccaactcgcaagtgccggcgctacactggcaggtcttcttccagctttgcatgtgggctatttggaatcatcgacacgatgttgttttccgggggaaaagcccctcactaagagcctgcctacaacgatgcatcaccgaggcagctctctgggcagagaacttaacggaagatgatcgatttgtaatctctgtttggaaacaaatcttctcctcccccttacaatctatcaatcttttgtaatgaacttcttacttctaattgcaatgacaaattcag

SEQ ID NO: 43132 - DNA, 8176 bp, Oryza sativa
tcatggtttaaaccaaaattcgaatcacacattttgtcagaatggacacgtgtcaactatccgaatggttgggtctaggaacctcatctgcgtttgtatgcatgcgcaatgaacctccattagcacacgtctcaaaccatttgaatggtttgggcccaggaacctcatgcgtgtttgtctgcgtgcggatgagatcgggatgaatgcttatgagagaaaaatccaacaacattgagaatctaaatgataaaaaatggaatgaaaaggaaacacatatggatatggacctatgaattgctcacctctccttcatagtttgtgatgtcaagttgcaaaatatgtccatgctccgattcataatttgtacatgattattctatcaacactccacaagacgaaagcctattctgcgtagttcaaccttcttgtttttaagcaatgcatagtcatgctagattgcaagggatatatatgtgaagggtattttggtaatctcttctagtgttgtaatcaagtatgtgccccattgggctaatttcatttgcaacaattcattcatataatgtaattgatttgtaatattggtatatatttcaattgaatttctatgtatccttaaaatgaataatacgatttgtcaaaaaagacatgtgtcgaccatctaaaggatttgggccagggaacctcacatgcgcttgtatgcgtgcgcaaaccacctttgccaacatggtttgttgatgggtcagtagtcaagtatgggctgataacgggccttttggcatgttttgtgtttttacttcttttgggtttggtttgtctctttgtatttcgaattcaacaactttctgtgcacaaaaacccacaaacttctgtctgtttgcttggctctagcccattttgaagagtttaagccctccaaatatgtctaggttgtgtaccaaaacaagtccatggacattgtgacgaggacatcctccactattaactgctagtaaagacgcaacaaagggccaagtggtccagttgtactcgggcggcgaccgtgtgagtctctgaataatcccaccttgcttagcttgggaggagaaagccaccttaaaaggaagagtcacccttcccctattggactagtctttcaggaagagattaggcctttccccgagtgggtgttcaactgttggggttcgggcaaccttaattttattgggcctcggccaaccctacctaggccggagcgatcatttggtatcagacttaaaaggcaaccttaattttattgggcctcggccaaccctacctgggccggagcgatcatttggtatcagacttaaaagggagagccaccctttctctattagactagtctttcagggagattggttctttggtttgtcacagctaatatgttatgctttagcacaataaaaaatcctaaactttatcagaaaggaaaaggagattgggtagatgtgtgatgtgtctaagaagagaggggtagaaagccaacaacaagagcatctaaatggacaagtaaaaaggaggactagaggtggttcaattatcgattacttaaaatatccgtagtggtgatggtgaagctaacatagacacgtgatctattaaccgtggatcaaaaaatcggacgctgcagagcgacgcactcctcctccgcaccaccatcgcgcgactcctccgtacatgaccccacttttccgttcctactgcagctcgtttttcctattttatagtttccaaccgacgtggtttataattttgatcatacaacagtgaaatttggtaagccccgaggaaactgtcggcctaaaataaatatcggcttcagagttttggaattggccgatgggagttctcaagtcgccaggagtcggattcttggaggattcggttaaggaagtctatccagaagagaccgacttcaagaaggatgcggcatggcggtttatgtattaattatgaagagtttgttagtttccttttatctttaggaaagtgtgtttagtgtccaataaggacttcatgttttccttttatctttatgaaagtttttttcttgtccaataagggctagtatctactcatgggtataaatatatacacccggagtaattgtaaatgatctcacagattaatacaactactctcggtgcatcgccatcctctttaccgagattttacttgacgcggggttgcatcggctttcgatcttcggcgaaggggtaagtcctacgttccgccggccttggcaattgtatcggctacattggtgttgttcaaggctgcatcgctttggtctcttggatcgctctggttcggttgatattttggcctacctatttatcatatatcttagttaatctagtttggtagcttgatttacttgtatcggctgagattcactttagggtttatgccggtattggctaaatcgctttgctagattagattagctaaggtatctaccaccctgaaaatcagtcaagggcttgctggcttgattatctagatattgtgtttgttttcatacttagtgttgtatcagtacattcgacctactatgtcgtgtttagaaccataatctctagcctgcttttttattgccaataaggatttcatcggggtttcagctgatgagatatctggacgttgcatcgatttataaggagtacatacaagttggatttagccgatcgcaacaaaggttatactgtttatctaatcttgcggatttaatgacatcggacctccagccgatatatgctttaacctttggatcagtgcttattctatcatattgttagccgattggtttctactagattttattgttgtttcgttacattatcattagttgattgtctttatttacatcaagtgtcagattctacatcaaccatatagccaatagctcaaaactctatcgctatcggctagtatcgacatcgactggaattactctattggcttgtcagccgatcgactcattgatctactatttgcatattttgtgagttgtagaatcaaactaactggcacgcccgcatctcatcaatctttggacctgcactggagctaagcagatctcccaggctgttgtgttcgtcgacttaattcgcgccaacacatacccgacaccatcggccatgcgcagatttttcgtcaacactatgacatcaaatttattcattttccggagattcacataaaaaaataatcaaaggaaaagaaggagcgtgaaacatcctcgcctcctgcctacccaggccacgtgataaggcccatcaagattaggtccaatataagattagccgatcaagaatcactttccatccattgcagaactcgtcgaataccaaggctcataaacaacgccgacgctgacgccaaattcaccgaaaccaatctacgtggccaccaaacgatgtatgcattgccctcaattccgctttcactgtcactgccgcggactccaccgccactgttgccgtcactgactccgccgtccccgccattgccgtcgccgctaccaccgccccaactgtcatcttcggcgcggccgccgccttcatagatagaagcaacactgtcatcacagagatcaatcctttggtaatgaagttaagcacctagctcaatgagtccatgacatctaaggctctatgctatcttgcaatttgtactacttattgcaggcagtacattagctagctaaggttaatgcatggtactgtagattaatggttggtactgtagattaatacatggtattgtagattaaactagctatttgatcaatctttttttcaaagcatgcatgcgatgcaagaggctcttgtgtgtgtctttgtcaactgcttggacttgcaatcttttgctcatgagtgacccaacataagtatctattggtttttgaaaacaaaggtttgccttaaacagaagtagtaacaccgaactgatttacgtgcttcatagttctgaaacaccatagctggattttgcgtaataattctataacagttagcatatttgagacacaatttattgtaataaattcctgaatttccccaaatttaatcactaagtgcattaactatatcttttcagtgttatataatttccctgtacaatatagatccttgcttaattttatgtggtactcaggtcaatcaagacgccattcatgctgatatgattacaacccaaccctcgaagaaagcaaaagattcggaatgtaaggataatgcatctatttttgtctcaatctatttaataatgccaaatacttatatatatatatatatatatatatatatatatatatatatatatatatatatatatatatatatatatattatttgaatcactaacatttttggtgtttgaaatactaatgtgagctaatgtgtaactgattggcaatttaactttgcttaacaaacaaaataacgtgacagaaaaataaaaattacattctttattttctatctctggtatccgtttgtgatcgacaagctaggccatgcgtgtgtgaatgagggtatatgcacatacactatatcgatataataacaagcacagtaagatgctatactgattaatttatgtgtgcatgctcaaagtttgatgtgtatgtgcatggtatttagaaaatataattgggttctgttttgtcaaatgcgcagcaccacttcagacaatgacgcattcgtccacaacgctcgctatgccaagtggtgaacagagtcggagcaactgtcaaccaaactcaggagtggatgcaaacataatattcttatcatccggctcatattgatagtcaaatattaattaattgtctgattatatatgtaggagaaatacaactagataaaccattacatggaagtgcccgtcaaactacgaatgttttgtaagaacttattaactctacttttagacaatattctatttaatattcttttaatataataataacatctagcagctaacaaatatgtaataaggatacaatacacatatatcggatgcattaattagtgcaaaagtgtcagccatacaataatatttacaatattgtcatttccatttatattgttaattacataattgtcttcatttgtttttcttttgatggaattacatttggagagcttggtatgtaagcaatagtcggtgcatcatcatcagatgaaatatcttctgccatgattggtagtccagcctctgagagcatgttttataacataccctccaagttgagatccctcaaattcccatggaatgtcttaatacaattgttcctatgttcttgcatccaatggtgacaaaactattttttgagagaaaacggtaacaacatatggaccctttcccccctcccccaattctcactcaatccctgcattaagaaaaaaaatggtaagaacagtttatacctagactatacaaaataaatgggaagatcttggtactacaatgtgtccgtgctattttactaaactagaaggtaccccgcggcgttgctacggaacattgtagaaaaaaattagaagaatagtttgtattggaagtaaaaggattctaaagtaagacaatatgtgaatattaatttgattgtatgatagggtacacaaaagttttgttagactgaaagggaactggcatatatcaaaattatgattatttgaaagcacctagagtatttagtttggacatagtcttgacaacggaaacaggatagaccatgattacgaaaatagtaaacaacggatgtgattattcggaagcatctgcagtctttaagctgtatattatgtattgacctgcaaatttcgctggacaatgtattagaataaatcataatcggatttgcttgtatgatgaagcaaggcttccaaacatgggtgattattaatgactaatttgatttgaactattagatggatgatggattgatctaaggtgaccaaacatggtctacaatttttgcttttatctcttaaaacatccgttacaacacacgtgcctttatctagttcttgttaatttcaatcgatatgtatttgttttttccatgtaaaatgtagtgaattggtttttttagataaaaaatgagattttgagggagagacgtccatccaaaaaatttttaagaagaaattataagcgtgttggggattgaacacgggacctcgagttgaaaccatacatcccttgccactgcactatcaagtgcatctctagtaaattggttttgagataaaaaaattgtagtataattgtttttttttgttttggaaaccaatatcactactgattcaccccttgaatcggcatatgatactgaccaacattgccagttgaacaacacacaatattaatgcctaatttgatttgagctattagatggatgatggattgatctagggtgaccaaaatcaggaaatgtgtattccacagtcgtgcttcgcttaaaatttaatcagatagtcatgcattgatgacaacgtggaaagctattatgaaagagaatatttaatgctacatggtgggaggcaattgtatagtaatgcaggattacaatacaaggtaagataatttaagcctcatttagatgggctttattctcagcacttcggcccataaaaacaatgatttagtgaaaaacaatatgcaccataacacatgtaaagtaggaaaagggctcaacatatgacataccacgtttggattgcagcaaacaactttattagttatgttgttacacaaaacaacacaaacaatcccctcctctgcttacttacaactgactatcaatttctcaagccttccagaaggctctttctagcatgcggcaaaatccatcgcttagcatgtacctgtacattgataagcattgagctagaagaatcatccaaggatggcgtggaggcttagaccaccaagtatggaatgatgcataaaattagtggatcgcttgtacatcaattcacaagtgtatggacatgcagtggtgcaaaaggaaagaagcaagaaaggctaacagaaccccgcaacaaacccacaagagaacaattagagacacctaacctcgatgctttttcatgaatcatcgtgtctccagttggcatccacaatatcctttactactttgtactcctatataaactactttgcttggttcccattctctcatcgaccacaccataaattggtcacctgcttcaacatcttgatataagaaaggttgtttattatatcattattatgtacttctactaattcttgagtgttagtgtaaattgtgttagtggctatacttccaacgagaagcaatgtagtttctattcaatttacatatttttactgggaagatgaaataagttgttgtttcaagcaagtacttaactgagttattgttcatgcattacttaaaaatgtaggagtaaagaaatggcgattccaacaaaggaggaggtggagcagaatgaggaggacaatacattttcaaggttgcaattgcttgcacaacaacggcatgccatggaggaattctggaggaggagccaggaacaaatcgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctccataggtcaaatgggaactcaacacaagctgtctccattcacttttatgatgcaaggagaatctcttctcaacatgaaaagagaaaaatccctagttaatgaagtgatggtatgcaccaacaagatgagcataaacaactttgatggagctactagtattgg

SEQ ID NO: 43133 - DNA, 2603 bp, Oryza sativa
tgctattgttgtccagcaaggggaaactacacacccattctcatcccagaatgcatgtccttccccagaagataactatgttgttcccatgcctacgggacatgttcagagttttagccctcctactaatatcaatgtcaagaagctacatcaagaggagaaaaacatctattcacaagatgttgctgaagaggacatgtccaatgagtctttggagggaagccagaaggatgaggacctatttcttcatgagaaataatttcctccatttatttagaatatggaagaggaatacaacaatggcaacgatattcatgatggtaatttctccaaatcaagcaacagtatcaagaattactaaataaacaacaaatcaaaggaggatgcatcttagctatgtttatccaatgatgttgtatagtttaccttatactttactcaagattaataaaaaataatttgtgtgtgattccagtggtttaccttgtgtttccatctacctttgtatggacaataataaaaagattattgtttgtttgataattcaataataaaacattcataagttgtatcatttatttagcaatacttcacaagctaaaaaaataatttgcgattgaccatttcttaatggcattgaaagctttaggaatttcaaagttaacatggtagtaagggagcctattaactataagatgttgttcctagaacatcattacaccgactttgtaggccctacccaagctacctcaacaggcaaaactattatgttcggtccatggtggagcagttgtggaggaaccctggtcgaagcctggagtacttcgaccacgactattgcttgcgctaggaagacatagttgtattccggtgcaacttcaaaatgtttgatcactaagtggtgatagctgagcgctaataattagcattcattttgccatcctttttgcttctttgacattagtgacatgaagatagctcaatggacgtgacttctatactagctttagtactcctagtcactctaggagctgtattataatttcagattctagttcatctagagacatggactctagtttcaccgggctagctgcccttctaatgacaatgtaatatacttgtgatcattcttcagtacatgatgtctggttctttatggcatttgtttaatgctggtatttcttatagtcaaagaaaaatccgcaagcacacggataccactatagcatttcacccaggagtattccaaggttattgcatttatattttcacagagacgacgatagtgtaaagatagagttcatacatttttattcaagctataattattttaccatagtctaaatatgggctaattgataaatgataatggagtagtgtgacacacaggagattcgtctctaatagatatatactaggcaagaagaactatagaaagcttaggttcatatatacttctatattactaatgtttagtttacacttaacacatacatgcttacagagaccactccctgttggtttgccagcgtggctatggtattttaattacgaactcttacttcatacccggatgtgaaggaattcaaaggaccgacatggctgtcaccacctgccacctacctcactttccatggggcttacccgcatccaatggcatttaattaagctaagcaccatacttatgtcaataaataatgtcaccaattcccctgggattcccacccttcggattgacaagttagaactagtgcaatccgttaagatcattggtccattaccgtagaataaattgactagcttaatcaagtgaagcatataaatgaagtacaatctactcattgaacacacaactagtaaactagtgtatgaactatgaacactaataagtaaagataactcctttattgcaactatagtgttacaagaagagtatagtactaaagacatatcaaaatctctgagaagactataggacctaaaattgttctaagcctaactccactactactagagagaaaacaatttatggaatgaaagaattgctccttgaagtgtgtgtgttgtgaagtgagaagctcttctccttttataacctcccaatgaaggttgtatggtggttactgaggtcggtgcacttctaaccatcattagggagggttgagatgttgccacttggaaggtggagatgacgggtgaccatagtggttcagtcgatccaagtgttcggacaatccctgggccccacctctccaccgcctttaaccaaagggtgctaggtgggcccctatggcaattgaggatggtgtggccccactttaggttagtttagactgacttgtgggcctatcgttccgtttactcgcacgtgattcgccggaggtgtgtttctttgcatgccagctcatttctttttcactttattgtgtaatctctgcatgtacactgattcatcaagacaagtggaattacattatttaatactagcatatgatagttgacggccaaaatcggtacttcacgaccatcaacacttaactacgttgcccatgtaagctcccaatagccctttgacattttgctatgttttatgttctttg

SEQ ID NO: 43134 - DNA, 16445 bp, Oryza sativa
  unsure (1)..(16445): unsure at all n locations
aatcggagttgtgagcgtatcagtttgtcgctgaaattgctcttttgctctggatttgtcaagccctaacaaaaaaaaactaacccttatgtcttttttgtgtgatggaactctcaagccgtaagaagcatgttggttatctagcttacaccacgcttaattagttaaagtttgaactaactgagatccatagggaaaaataatcagaactattattagtgcttgaaaatttgttgtgtgtttaattttttagaagcattatgtgcttttttactttcggtttacaatgcataggtaaaataacataaagaaataactaccatatgtggttctatgccatttatataacaagccacctaaatggcatataacaagccacctaaatgagactgaatataggttttcttctctacatgttcatgctagactaatggatttggtatgcaaggaacaaggtaaacctctatatgtcctcagggacattacactattgttttctttttttgcaggcttttcatggagctcttgatattagattttgcatggcaatttatcctatgttttgattgctagaatcttagtttgagttgaaccgctaaaataacatgtttggaatgttttatatgagtaagattttcaaattttgatacctttgatttggttctcttttcctcagagacctctaggagttcttatattggcatgcttttatctgattgcatacaatattttctctaacaaaatgttgtaaagactgtttttctcttggaggttggagctgctatattacatattttatagtgccacattccatccaaggttttcaaatttgttaggcacactaatatgctatcagcaattatagcatataaggaccaatttttgcgaagcacgtgatctgttagctacatgaaacaaagtatggtaattttcatatccttaattttctgttagtgtttatgaactccatttccagtggctgggatcttggggtttcaagatggcgatgatactccccatcctcccccggcatgacgactatggtgctctccgtcctccctcactacgaccccaggctagaggaggagcagtaggacactcaccggcgatgaggaaacaatagggcaggtgtcgaaggaagcaacagaacaggcggcgcatggaaaacggtgaagaattgtgtgggcagagaagagcgcaggacacttgttttttttttggcgcaatatctcatccctatggcattccattgtgtaaattttcggattattagatgtagtgcttttcctatggcatcccattgcgcaatatctcattcctatggtctcccattgtgtaaactcttttccacaaatgagttttttttttctagaagttgtatttttcaatgtctccagttcactatagttgtttagctgtgggcgtggtgccatgctacgccctatgttctagtgtttacaatcgctagcttatataccttatatacccaaatgtgcacatgttgtgggctagttgttactaatatcctgatgatcgatgtagcctaacaatataggcaaaatgtactgtatagaaaacacaaacaaacccatacttgaaagatatgatagaaatcctcaatcctgatatagatacaacatatatatgccttgtacgaacacacattatgaatccattgtatcaacacaaacgtatggagtctccctctaattaaggtacactaccaagttttcatcatcacatccttctatataacacaagaatcaattcaatttcaacatgatggtgatagacggatgttgatatgcttggtgtcgtcgctatgggccagcgagaaggttccctcggcagtgaggttgagataggtgaccgagagcttgtattctcccaagaaggcagaaaagttgaaggagccgcggtcattggtggttcccagggtctccttggtttgccactcccccagcagcttgtccaccacatctcccgcaggaaggttggtgaagttctggttggtcaggcacatctggtagcagctagcattggtgtccattgccgtccacagcattatgccatccacggatggatgggcaaacccttctcggagcacctcttccaagtatgcagcctgcaacatcatatcatcgtatagtacattaacaatgagatatataggttatatactacctccttctcatgtagctacctagtattggatttgacactatctacacatgtccagattagtagttttaggtagtgttaaatccggtactagatagctacgttttgagatagagaaagtatttcttatggtctgtcactcgagttttacatctagtagatatatatttgtgagtatgtaactacgtacctgcgttttggggtcgaaggagctactgatgtcgatctcggtaagccaaatggggagacgcagggtgccgagcttatcgagcacggcgcggacgtaggggatgttgggcttgccgaagtgtccctcaaggccgatgccttcgaaggtgacgccgccatcggcgagttggcggaggcgggagacgtaggagtcggcactggagctgaggtcatcgcagacctcgacgacgttgaagtcgttgaggaagagcgtggctagcgggtcggcgcgcttggctgtgtcgaagaagtcgacggtggcgttgccgccaaggcggttctcatagaagtcgaagtgcagcatctcgttgctgacgtcccaatgcacaaagtcgcccttgtaccgagagaggaggctctcgatgcggccagagacggcagcacgtagctgtgaccccgtcagattcttcacccatgctggcgtgtactttgggtcctcccagaagatattatgcccgcgcgccactgcgtcgttggcctgcacaaactgcaacagctggtccgccaccgtatagtcctccttccccgggtatggctccgttgcataccacttgagctcgttctcgaacaccgccgcattgaacctcttgttgaaccattcctacaaattcattaattaagtacattattattactaaattgtcatatattatatatcttaacaccaaaacaactaaataacatttaatgtctatcgctaccgattggatatagcgagctgtaacctagcagccgctatatgagctgagttagcgatccgtggtagcagtcactgtatgatataacaactaaaggcgtcgatggtgccaactccgacgcttgctccacgaattacgaatcaacacattataaactctttaatctatgttatgtatcgaaatatcactaatttatttctcagtttctttgttaatgtattataaaatcattattaatgatacacatactcaaatttatgtgtgattattaaatttcgttattggaacttagcttcagttatccgtggttcgctacatagacacctgcaatccgctacgaacctactgtccactatttgttttgttgcttaacacacggtttaatttcataaatcaatgctaaagttcgtcatatatctcagaaaaaaattaaggaaagaatcatgaaaacaataacctgataaagtttgttcccaaggattgtcctgctgatggcagagccgaatgggaaatccctggtgatctgatgcaccgcgaccttggcaccaaccacgcgactcccgttgctgtccgccacgtggacattgacaaagcgcttccggttctgttcgtgaaaaagaattacatgctggcatcatcatttgctccacacttcctcacaattaagttggattttttttaaattatccatcgtgtgacagtttttttataatggattaaaccggtctctatacccaaaagagttacacagcctaagagtcgacgaaacagtataagtacattttattaccagctgaatacggtcctccctgtgctgattccattgttcaggtgaaaatggttgcaaagaggcacttctgatcgagatcgttgaagcatttgggcttgcagtctgcagtgaataaattgcaaactgcatgacgattaattaattcaccaagtcaagatctaaactaggttcagctaaatttgtatgccaatatattactgtgctctctgtgacttaaccgtgaggaattaaattaagtatatcacctggaaatagaggacggaggtttctgaagcggagttgagggtgaaaccacccttgaggaaggaccaacagtcgtttcgcaccagagccgtgccaaggcattgagatgcagcgtttgctagcgtcaatatcttggctttcacatgagcagttgttggcccatcgattttcacccagcgtagagaaaatcaagcaagcaattccacaaggttaattttactcccaggaaatgacaaaattaagccagtagaattgcaggtccatcagaaatctgaataccaataacaaaatcaaattaaatgaaaagggaaacaattatctatttcacttgaatatttgctagtccaataatttttaattcacctaaaaaataacgattgcttgaagaaaactttcaagaaaatgctcaacagaccagtaccaaatagtaaagtcataaaatcagtaccatgccaaaaaagcaggggagcatgcatgaaaatgtgcgtgccaaacagtagaaaacagggcaggaaaattcgcatcgctggttcaatatggcagcatatatatgcacgatacgatgtttgggactccccgttttctttcgtttgtacgcgggcaatctgcacgaatctttggccgccccgcgcccaacatatgcatatgcgcatgcgcggccagggttgagacttgagagaggacgatgcgatgccggcgagatccggctatatgcgtgcggcgtgcccatctcatcatcattctccctagtttcctccgtgtgtcttgtagctcttcttggcttgttctcttctatggtgggggcctgctcacgctcacgtggtttctttttgctcatttctggctgggatacattgggtcagggacccctactgcagccacagtccttttggttccaaatgttagggtgtgtttgattgggtggatgtgactggatgggagatggctgtccgattatatgagttgtttgattggagggcagggtggatgggatggtaaaaaaaagtaaatattctctcaatatttttaaattatttttcgtttttgctagaattgtggcgtacgcctaggggtcttaggttagctccacaagctaggtggtgtactagacgacctggattcgaaacatcatcaattctaattatttgatattaggtaattcccaatattttgctcttttttgataaacgcctagggaatttccgaatagctccacaaggtggttggctaaacgacttggattcgaagtctcaccccttctaattatttgatatttggtcattccctaatattcgcgcacatcggttggattacaatccatggctgtttgcatatgtcaccaagtgacttgacactttttcctgagccattaaaaacaatcagcccacttaggatcagttatattttgccaaagctaatcaactggaacctactcctccattttaaaagagtgtagttttagtcgaagaatttgtctataggatgttatatatcatagctatatacgctactacagaatcccattaagttctagcttgctcctttatatttaacctatctagatgtgggggaaatatccggtgaaaaccatcaaataagtaaaaacccgtgaaaaccatatctaaaatttttataaatttatgaaaaaaaaatactagagataggtatatgcataaaatacatagctttttttttcttccaaatggagttgattttggactcgagatttggtataaatgtatttcatgcatatacctatctctagtaattttttcataaatttacaaaacttttagatatggttttcacgggtttttacttattcgatggttttcgccggatacgtccccctagatgtgaacgtgtatgtatttgttttcttcatttttatatattttttacgttttcaaaagaaatttagagaggtcaaatatttatcatggaactcgtcgtctctgacatgtattaggggattccatttaggctagcctgcaagctaatgcatagttcgataacaatgcaagcatgcatgctttatccatttttttcttttacgcgtacaatatgatcgaacgagtggccggggaaattttagccttttctacagttaaattagcaattactagcttttatactttagaattaaatggcggtctctgagagagctagtacaaacaaacaaaaagaaaaggataacggctggaaacataccatgcttagagcaggtataatagggtacagtcagtagacggtagaactgttcatctaaaagtaaatcctacatggaagagtgagaaaacatcagaaagagagtagccggcccttaatctatcgccaggctagccattaaaaaaacagcacgaccaatcggtcatccatgcatgcttcagctgcaagatttttccactaattacacgcttcccaatggcctcaatgagagagaatagagattgtaagagaataatttttgctgagctggactttttatagcccgctgctagctatatactattatgttttgtgttggtgggggacgggacgtaacaattagtaataaatattttctataaaaaaatattacattacatgatgggtgcatcagacataaagagcattgtgtgcgcaaatgaatgcctaaggcaccaaaaatattttggagcatgcacatgtgaatattcagtgaacttgtcctcattcgtgtcatattacgtagagaatctattctatgtaaatgaatttactatagttaaatgacttaccattgactttggctctctttaatatgccactaactttactatttttttctacaatatatcattaggatggagtacttttaaaaatacctaaaatacaattcgagttacacaaggggttaacaaattgattgaccccactacaagtttcgaaaaaatataattttttcatgtagcctccttccaaaatatagaagtgtatgtatatttcaagattttgaatttacatgtattaactgttttgagaatataaatatattttatatgctaatagaatactctttttattgatgttcttttatgtaaattatctttcatatgatataaaatattttttatccggataccttttgtgtatgtgattccgctttcataggctatataaaagtagttttccaaacaaaaaaaaggaaatcacaaaatatacacaaaaacttctatattatataaaagacaacacaaaaacttttatattttttcgaaacttctagtggatcaatcagttataacctcttaggacttgaagggtattttagacttttttgaaaaatatccattcaatcacacagtagaaaaagttgacaaagttagtagcatattatagagagagaaaaacgttaatggcaagtcatagtaaactcgatggtatataataattctctccatattataacataagtgttgcatgcatgcacaacgctagccatatcaaaaagccaacaaccctcaaaattattagaacaagtttttgtcgagttactaatgcttgaagtttgacaaatatcttcttttttgagtcccatagttattttttggaaaaattggttatatagcatcgaaagttcatgtttttggttttatagcaccgaaagataccgattcactttaatagcacccaaagttcaccatgttcccatttttagcacttccatcaattctcgatcgttttccgtccgtcgtgatccagccacacacacgatatgacgtttctacccctcacaacgtttctacccctcacaagtacaagtagaatgcatgtcaatgaggggtagaaacgtcatatcgtgtgcgtagctgggtcaataacgatcaagacggacggaaaaattganggaagtgntaaaaatgggaacagggtaaannnngggngntgnnaaagtgannngganntnnnnggngnnatnnnnccnnnnnngnngncnnncgatgctatataaccaattttgccttttttatcattttattttagggtgttgatacctctttcatacagagtttatgcttcacaacctcctataatatggttcaggcaattgttcgccaagataccctttgccgtcattcacttcaacataaaattactacgtactcattcaattcaattcgttatctctagaatttgttttcaagataatccatttggtaattaatatttaatgtttaagactatcaattgttgtactgaaataaaattataaataaatctaataaatttgtgatagtatttttcaaggtaaatatatgtatagctttttaactaagcattttagaaactactagtcaaatttaaagggtttgatcatatctttttttctaaacatcaaatacttcctactagagggagtacaagataagcaagaaattctgcatttgtggatagcaccaacacactgcaaagttgcaccagctccatgtaaaattttcagatcaactagtcaaatactcattctttgaaaaaaaaagagagaagaaaatcagtttcactagttttgaaaacacgagcacaaattagaagacagaggaacaaaaacagaagtgacgaacaaaaaatgaagtgtgatatatatactcacaggagaagctgtatactgttgccgcggacatattatacagcacaaatgccggcgaatagttgccatcgtcctctgttctgaagtccgtcactttgttcgcccagcgcaggatgccaccgttgtacagtgcaggttcaggatgcgatttgcactgaaaaagaaggcgggggttcagagctcagacgcatacaggcccatagttttgtttatgcttatacttataagctaaaataaattttcgtcatataacatttgatttttaatcgtgaagttcgtttataaaaattttacacataattcttttttttacaaatgtgtaagtataagtataggcgaaacgacgaggctggtaaatcgatcagcataggagatgaggtagagaggaagagatctagacgatgcgttgcgtacctcagtgtaagctctgtaatcatagcgcactccatctgcaaaacagcaaatttgttttccttttctgtcaggcgaaatccataaagtcgggtgccaaaatgagcaggattaattcctcccatggatcgattggttaactcaccggaggatgcagcagggcgagctagcaagacgatgagcagcagcagcagcaagagcaaagccttccgatctgcagggagaagaggcgatgatgatgacgacagtgcagcagcctccttgtgcttcttgccaatcgccatagttcccgtcgtgagtgagggtaacacgagcacacagagactagctctctctgttgtctctcgtgatttcttcttggatcgacgtgttgatgtgtgctcacacggtatttataggaagccaagcaactgtacagctagctctagctagtgtctagataagttgaaaagaaacgcaaattttactacaagatattatggttttagttctgaacacgataaaagttaacttttttttcagaaaacagttttaaagtttgtgaaaatttgctactttacattgcacacattaaaatatttatttctagttagataggagagaaaaatgatgtgagaggttaaaaatacccattgcttccacatctcagctctcttattcctcttttcgataagtttgaactttcatattttgactaccaataatttgttaatgcttacttttactatggtaaccctattaaattttataaacttattgtaattgaagttaaagttctacagttttgaccgaacgagcagggcactaagtttaaaatatttttaaaatgactatattttgtagcttatttcacatggcatcaaaagttcaaaacccatataatcccactgataaacgataacccataaataacatgtagccatgtaggtttgtaacgtgtcagccctacatatgttggagcgcgctatcaagctgcatgtagctgcactaaaacttgtgcattttgtaagaggtaaagcagaggagcaactatttttttttctccaagcatgaattttagattgaaccctcttttcttaccaaaagtttacgttaaacccctgaaacacatatttttgctttgacaactttgtatttgaatcttttttttcaataccattcttatctttgggtagacgcaggcagagacgccgagggtgtcaacgcagacacgcagtggtgaaaagatcttagtggggtacactgaggcctagttgccgttccggcttaactgatcgcgtgaaaaaatccgctaatgattaattaagtactccatctatctcttaatataagagattttaacattttacttgtaatatttgaccattcgtcttattaaaaaactttaaaattattatttattttttattgacttacgttattatccaaagtactttaagcacaacttttcgttttttatgtttgcacaaattttttgaataagacgagtggtcaaaaagtgtaagcaaaatgtcaaaatttcttatattatgggacggagggagtattaggtattataaatttttaaaataaatttatttagctttaaaaataatttcatatataaagtatttcacgaaatatgctgaaatgcacctaagactaaattagtttgatgacaacagtaaaaagatgctataaagtaaaaagaaaaaggaaaacgaaaaaaggaggtccagagtgcaagggtaaaactttggcaaagaacaggtgtcaaactgaaattcactctgaaagctaatgagcatttgactttcttaaaagttttatacagcatcacttactactaggtactatactcctacgtgtcatttttacaaagtactatgtggtcatacatcacgttagccttgacagcattaattcttggcagtttatggacgtggaagcagctgcgctgaatggggcctgcagcatgctagctagccttgctagcttccggctggatagaacgcaatatgcagataatggtgaaagaaagggagtttggaacgtgaagactaacaacatgtgggcgtgaggcaacaacgagagacaggtagggagaagtatactgactagtgcacatgcatgatcatatatcacagttcacatacgactcgcaagtgcatgtatacccaactttcggtgtgacatatattgcgcgtgcagttgtcacgcgtacattgaaattaaactagatgggttctgttggtatgcaccaatttcagctcatatactccctccgttccaaaatgtttgacgccgttgacttttttaaaaatgtttaaccgttcgtcttattcaaaaaatttaagtaattattaattcttttcctatcatttgatttattattaaatatatttttatgtatacatatagttttacacatttcacaaaagtttttaaataagacgaatggtcaaacatgtttaaaaaagtcaacggcgtcaaacatttagagaaggagtaagtactaaatatggtttattaaattataaactaatatattacctcaaatatgatatgtaaaaaaaatacgtaaggattcaggatgtatttgtgtccgtccctcctcacgtcggcccaggtggcgcgactcatccccctctccgcgtgcgcctctacctccacctttgtctccctcccctgatcttccctccctcccggcggcctccatctctccctcgcgatcccaaaaaattatttgatccggcctacctgcacgcgcccccttccccccacggcctctctcctctccctcacagcccctctcctctctctggcgcccctcctccctgtcgctcctttctcccagcgcccctcttctcccttgtgttccctccctcgttcaacgagaccggaacccactcgtctaggaatgagttttgatgcactcacccggctgcgatcaccaccagagctcctcgttgccatttatctctctctcgggaccacatagtcgttgttcccgctattatagttttcttcattgccaactgccaccatctatggacgagtcacattgtgcgacacgtccggccatcttactcactattgtttggttgcaggaggaccggcgcccatcttccctcctcttctctttcttgttttgactaggaagacgatgaatagtgttagtaatttttatctccatctttcgttcttccagcgtgttcaaggaaaattgaaccccttcatctggaacgtattttgatgcactcatctggtcgtgttcaccaccaaagctcgctgttgccgtttctctctctattggtaccacatcattctaaccgtattcatgttgttctgattttcttcgttgccaacctccaccatctgtggatgaagacacaattccttcctggtttagcctgaacatgctcctggatcactcacataatattaagaccataggaactatgaatagagcatgaaaattctaatatgtcaatgaaacgggtactcgttcagaattaatggatcggattttcatttatgggctaaaatatttttttttaatttctagctaatttcagtagtttttccatttacattattaattttagcactatttgatccattcaaaattgttgtaacttataatattgaattatttatagctaaatgaaaaaaagaggatttagttatataattttcattaaatatattaaattatcgttccggccaaagttatttttagtttcatgctgttatttatatgattatatttccttcaatccaatcgtgatatgcggtttaggattttaatttaatcatatttcttcagtttaattgtgatatatggtttagaattttaatttatgtcaatgaatgttatttagaatccgttgcaatgcacgggcatcatgctagtaataataataagaaagaatgttaatgcgaaagcggatggtggaatggggcgcagtgcatactaaggtaggagaagctaaaatgcggatagttgaaagagtaggtaatgaggtaaattatgttataccaaaggtttgggtccattttgtcttttcctcgatgaccctcatttccacaatcatatctatatgatgtaaatttgctatcagattcttttttgtctgtgtacctttttcctgacttcaaagcccttttgacctccatggctatgccaaaacatctaagcctcatctgcgacttttgaattccattccaacatgaggtcccaaacatggcagtggcatatcttcatacataaaaacagtagcaagtatggcactagtgtatacgcatgatgataaaaaaactgaatacacaagcatggagttctattacaaacctatatccttccatcttacgagtatgatggcctagacttgattagcatctgcaatcaaatgtttttttttccatgggaaagggatcgaaaagcttgatcaaaggcaacctaatatgaggaattgaggagtttgatcaattctaagaagccattcatagggatatggtagaagagaggtagatagttaacactaatgatcaaagtgaacaaaagctcttattgtttgccgaccctcagaacaacagctgacaaggattttttttcccctccatctgacagggatggcaccctttttccctccagatgaccgggcggtgaatgggcgcgcggcggccagggcgagcacgaggttgttcatgggctgattttccttgcatgggccgagtgcgagatcgctcgcctgagttgctcactggttcgtgcaacgcaaaagggatgaagcagctacgatcatgcgatgcagatcgagcagtccagcgatgtgcgacatccctctgacatcagttggccaaagtcagacggccgagttccgtactatgggaccttagtgttaacggtttccctctgtatcatattatattataagtcacttgacttaattaaacttttttatgtttggtcaagtttgtaaaaaatatatactaacgctttcaatataaaacaaatatattgtcaaaatatattcaatgttagatttaatgaaactaattttatattatatatgttattatttttttctataaatttggtcaaatctaaataactttaactaagaaaaaagtcaaatgacttgtaatgtgacatagaaggagtactagttaagaaacacatataaacatcacgaaggatataatttaaaaacattaatttggtagcaaatgcagaatcagcagaaacaacatttagtcccaactcccacgagccgcacaaactgaaagaagatcattcgatgagaaggaaataaatagagaaaataagcaagatgtcatggagtgaagaaaaataaattaattgaaatcacagaaattgcaagggaaacgaagaaggatgatttttttttaccatccacttgccctcctcgggtggaggttgtggctaagggagggggctgggatcggcagcggcagtgggggcataaggtcgttggctgcctgacgatgaggtacggcggagtcagggtcagtggtgtcagctaaacacaggacacgtggcagatacatagggatcatcagtgatctatattcctcatttgcgtgacgcgcgcagagtggttgattcaacgatgaggtcctggcaatgatggatcgaggcggaggggctgattcagtgatgggtcccgactgatggatcaacgtggaggggctcgaggcaactacacgatggtgatctaggttgatgcatcagtagcacctgaaacaacggcgacgtggcgcgcttgacgacatcaacgatgatagattgatggtgccactgtttgaagcggagtgaactgaggtggcagcacccacgatgagtgtatggagtgctagggagaccaagatagggaattgggggagatggaggcggaagtgcaggattaagggtgtgggaggtgggagcgatctaggatgttggatttgagtgacaagatcttgactgtttcatggtggatttgaaaatgtaagaatgaaagataagtataataagttggtgaattatagaggagatagatacataattaatacttggtccacctctctcttttatatagcttgttgaaacctgtgttgtaactagctataaatttatggtccgtttttcttctccattctctaacaaagaataaactaatgtggcaatttttatagcctacttacctcatcctattgtactcagcaaacagaacttagatgagtcatgggagtgctctagtcatgctttgggtcaggattctccgcactgaagaacaaactgcagagttacagtacagtgcattagggtatgatttttgctattggatccacatccaacggttcaaaacaaagtgctacaacagatctaaacactaaaccttaatcagtaattgcataacagtaaaacggatactgttcatgtacttttgctatagtgctactgcacttcactgtagcggtagacacaatgcacttttgacaaagtgtccctatgaattacaggggaggatcaggatccatcagtgttacgtgcccccgcccaaagccacggagacctgccgttgggtatggttacccattccgcacacccatacccacttgaaatggtagggtatggtcatgtcgaggacaacttatgttgcccatcatgaatgtgttgggtatgggtaacccgtaacccctaatagaaacattgtaagggagaggtttgtcttttttatctaacataaggatgatttttccccaaattgaatacccaaattgaaatgtgacatgccgagggagatatgacggagtactaagatggcagcgattgtggggtccaacgtttaataaatagcgtatatcgcgtcggtagtagattgttgcctatgtagcggatcgtggatagtgggtgctaagttccaatagagtattacaaataacgactttataaaacattaacaaagcagctaagaaataaattaatgatataacctacaaggataagtagagatttagtagcactcaaaaagttgatgtattatttcaacctaaactaaattaagaagcatacatgatattctattcattagatgttatgactcacaggaatataatgttttggaagacaaaacaactaacaaactcgtcattaatttgttatgggttagtggttatataaaatatgctcacactatagcggcccgttaaatagaattgcagaaatagtgctgctatattccaatatgttacttctagtccagtggcgaagctatgtatgtgtgtttgggggagggggggg

SEQ ID NO: 43135 - DNA, 10391 bp, Oryza sativa
acaccccactatccgtcccccctgttgtctagccttgaagcccatggaccttactaggatccaatgttctgtctgctcgagagaatcaacgagcagagtagcgatgtcgacgtctcggcttcttcgttaaccctcgtcctatcgcttcagcttcgcattgtgcgacagcgactgtcggcaacagtgacacactacgcacgcggtaagcctctctccgcaatctgtgcctctgcccttcgatcaacgatcgcgtgcgtctcaccgtcaagtacgcagcacacctaacatgaccatcggacgcggcctacaagtgaggttttgtccattttccccaatacagcaaaataacctaatcgcttgacttttagttttatgttttcttttacttgtacggtagtcacttgtccataatttagtatatagacatttagtccgttggtgagtactggattttgtgatgtttgaggcttggaggtagttgctactctctccgttttagattataagtcgttttgactttggtccaagtcaaactacttcaaacttaactaaatttgtgataattgaatatatttttataatatatttgtcttgggttgaaaaatgttactttttttttttacaaacttggtcaaacttgaaacagtttgactttgacaaaagtcaaaataacttttaatcttaaatggaaggattacctaataactatatgagcacttgaaccttcttttctatctaaaaaaatatttttgttgattatctaccaacaatgaagccatgaaggctatagtatgtatatgcattgattgtcatggactttggccattttgtcttctggctccctcaatctcagatttggcttcgctcctgtttacagtgcactacatcatataggcactggtagagggccactgtcatgatatttattagctcaagcatcgtataagggctgagtagtaaaaaaatcaaaattgaaaacaggataaacagaaaagccaagaccgagaccgaactaactgattacttttttttgcgacaaatacagggagctttattaaatcatatcaagattacattcttgagcaagaagctcagaaacattccctggagcctgcaggcgccaaacgggtatcgttccatcgatcggtggttacctctgttgcgccaccgccaccaccagccaacccatcagtcgagttctcggcttcacccttccaattcccgagttggcttaacgagtcagctagctcaattcaactcatcgagtcgagccgacctgatagtactatataaaactgattgattcatattactacgacgttttagagcatcaccaagaagttttctaaactgaaaataggaaataaataagttgatctccctaagagaaagcctaaattttatcaaaaaaaaatatttttctggaaatattttttttgataaaatttaggctttctcttaaagtgatcagtttagaaaactgaaacaaattttcggagagattatacgtctgttgatgcttaaggctgtgttcggtagaacaagttcgcatccggaacagaatagtgatcacagaaaacagagcggtctattagcgcgttattaattatgtatttgctatttttttttcaaaaatggattaatttgattttttaagcaaatttcgtatagaaaattttaaaaaaacacacaccgtttagcagtttgaaaagcgtgcacgtaaaaaacgagggagaggggttgggaaaaggggcatcctagctgcagccgaaaaacctacatccagtttgtggaaaacaaaaagaaaaaagaaaaaacccaaaacctaactactgtagcctgtacgcacatctatcccccatccgccgccccctccctttcgtctttcgtcgctcgctactaccgtgccgcgtgccgcctccctcgatctcacgattcgcctccgccgccccgtcctgttccccaacgctagctcccattccccacgcctccctctattctattcccgctttccctatcttccaaagccgccgagccgcgcggccgagtgcaaaaaggaaaaatatcggtccccgcgagctagggtttaccacccccccctcgtccacctctctctctctccgggtgcccacgccggcggcgagctctcctcaactgcgccgccgagagcccccccgccccccctgttcgtgggggaagtacaggttcgcagtgccaccctctgtgtctactagtgaagtttcagttttggactatgattttgttattatgctccattatgttgggagattgggattggggaattgaaacagtcacgtgaatccaattaggcaactaaaaaaacaaaaacaaagagagtacaaaatagggaaaggcgaaaaattgagaggcaccgcactggggatgtttgattgcttataattcaatggctgatctgtaaatgttagccatttcggcttggaaatgagtggaaaaagctaattaatcggaattttttcgcaggctgatcttagttgggggggtatactctgcggtctacttgctactccagcaatgtattgttctcactgtcaagataactgccccgtcgtaaaggaccctgacaaaaactacacgtgaggcctcccttcctgtcttttttctccttccatttcgatgcaaaatcagctagtacaaattgtttataagcatggccttgttggtcactcttaaatttctgtgtaccagctctaacacttttgtgcgcgtgtcattatgtaatttttcatatggtgatcagatgttgtggtttgtgtgggaaggttcttgatgatcaggtttacgatggtgagccaactttccaaaagggcgccgacgggcaggttgatctttcactttgcttctaatttggtttggtttatttatttttcacttctcatgttggttgttttggagctttacaggcccggttggctggtagtattctatcaagcattgagagtggtaattcagtatcccatgaaagaactataaataaaggtacgactttgaggtcattcctctatctcattttgctgccactttgtgggctaatttcatgctttgtttttccaggaagagaggagattaggcagattgtcagcagcttacatgtggctggtggagatactattattagcatggctcatcgctattatacagtatgtatctttgttactactacctccgtcccaaaatataacaacttttagctttgaatctggacacacagttgtccagattcatagctaaaaatgcttatattttgggacggagggagtagtcagtagcttataatttctaaaataatatggtacatggtgatgctgatgtttattcttgttgaagtttagctagctgttgacaagaattttacaaggggccgtcgaacaactcatgttgctgctgcttgcctttatattgcctgccggtatgctaccacctaattactttgttgatttattgaaagtcttctcactcattgtacttgttttttttctcaagcagtacctttcaatagaattatttcttgagcatgattcttttctttgtcattgaacttataaaatgcctaaactataacacagctaagctattccagactatagagcatgcatggtgaacatttgtgatgggtttgtttaatacatatatattttaccaagcacacaatctgaacattgccatgcatggccctcaaatatatcttccatgtggaaaggaatgctgtgtcctaaattttcaagcgcagagtacttaatggcctggttatgctatatctcatttttccctttaggagaacataatactccctgtaattgcaaaacaaatcctaggatttgacaccggccaaactttttaacccttgatcaatggtcatattggaaaaaataacttccatttctctagagaacatataacatccatgattgtctttatccatagaaatacatgagcatgtaggtggttatagaaactagcagtcaatgtggctcattgtagattatgtccatgtcccagatggtgtgctatatttgcaatcataggtcgtacacagtattttcattagttattgctgttcttaagttgtccagcattattttttttcctattagttcccttggatatctgttgtcaagtttcaaacttttgttgatattcattcctgacattcattatacctaatttgtgtgctaggcaaagtaaaaaggcatatcttcttattgatttctcggaccatttgcagataagtgtgtaagtgccccattctcctgcccttatcttgtagcccttagtgacatggctcatctggatttttctttcagttatgtcctaggtgctgtttttctgcagctttgccaagttttgctacttgcggaacatccagttatccaaaagctcatcgaccccagccttttcatacatcgttttacagaacgtaagccacactaaattgtattatttaaatttagcggctgaaaacacatgtgccatttcttgtgtacatctctacatttccatgcactttgaatatgcacatttggtttcttcaatgtggggagggggattgttcatgtcatgcaattataagaggctgggccaggctgttccaatgttggtacctgccacatttgccatggagaacatgttggagtgcaattctgtttggaaattgcaattacaacatgaattctgattcttaaatcataggcgctgtttgattgatttgcagaattggatcgaaattgtggtattcgagtcctgaatcaaattttactcgaaacagtcataggctcttgcatttacaccccagtgagaagtggactgatggatggaccatttgataattcttgcacaaagatttatgtagcttttgactaatttcttcaccttaatttatctaatctattcaacgtgcttttacattcttgtgaaaaaatatataacaattatttaaaatcacatatgatatttattttgaactatttgatagatttgtatatggtagagtcatgtgtagtagtcagactggggcatactatagtcaaactatctcctcgcttgtgttgctcatgtgaaggagttcaattgcaatgcaagctccatccttttatcccccccttttctgagatctttgcaaggcaatgccagaaggcaattgcttgggttagtaaggaaaccaaacatgtttagtctgattatttttgttttttgtgtcactttgttggttttatctgtaggtttactggggaagagggacaatgccgtatcagatacggctttacgcattgtagctagcatgaagcgagactggatgcaggctagcatatttttctccttccttctttaggttcttttttgtgattgtaataacttgacttatgttgcagactgggaggaaaccaagtggattgtgtggtgcagcactatatatcgctgctctctctcatggatatgattataccaaggcagatattgtaagcccaagtacttttgtctgatatacttatttagaattgtattctgaagtcttatgccctccttctgtatcagttagcatgtatcgggcacatgctacattttgtattttttataattggacatgaatatgattctatgctacagcatataatgacataaatttctgttttatgttttttaggttgctgttgtgcatgtttgcgaggcaacactaactaagcgcttgatagagtttgaaaatacagattcgggtagcttaacggtatggattctctctccaggaaattgccaaattcataggcgctgttacttaccgcatacagatgaaaatttgttgcaacgatgtatttgtaataaagatgggaatgacagcgctaagttgattgttggtacaacttttccctctgaaagtcattcttaagctgtctatgctgaaacatattgtaattactatcagtgtatggtgtctgttatggtgcaagtatttgacattactcatgacactaaagcaactattgacctaagcaagtactgattagggcagggcagcccatgtcaactagacatgcattcactttctttaccctgtccatagagctagttttaggtgcttatttttacccgttggttcagcatggtctatctggcaaaaaaattgggtattgccccctttcatgtctgttttttcatgtcatcaattcatcatccacaactgttatctactactccctccgtcccagaatataagaagttttagggttgaacacggttattaagaaagtaggtagaagtgagtggtggagggttgtgattggatgagtagtgaaggtaggtgggaaaagtgaatggtggagggttgtgattggttgggaagagaatgttggtggagaagttgtcatattttgggacggagggagtatatgaatattctttaagcaaatgaaatagtattatgctagattgtaaacgaaaatggtccttgaggtgtaaatgtgtcattgtgaagcccattaggggtccatgcaatgggcgaaggatgctgcctctgcccactactgcctaagcactgttcatggtgccttgtgctagttttatttagtttaaaaataagatgagattgaattatttatcggtttgtttccttagttttagagcaaagggcaaagggtttttgcctctatcatgcacagtacatcaggattaggattagaggtgtcttcatttcatacttaagtgattggacacatttccagctcgcattcaacgtattgtatccatgccaatttgcatttgattaaacattatattttgctgccctcttgctagattgaagaatttttggcaaaggctgatgaacaagtgcttgttactaaaatttcaccaaagtctggagaagtactttgcaagcacaaggataaagctgagcattttgctcatggactctgtgaaaaatgctacaacaaagtaacagacctttaccatgttcataatacatcagttttgggacttcattactcctgacacatgcatgactgttcagtttatgaaactgtctggtggactggagggtggctctgatcctccagctttccaacgagctgaaaaacaaaggttggaggctgctaaaaatgctaaaggaactgctgcatctaaagaggcagcactggaatcagtttgtgaggcacgcgaatctgatgttgagaataacattacgacaccgccaaaggtaatatgttcttaacatagttaagctcatgcttgttcccctatttaccatacattcttcctttgttagccaactaaataatgtgctcttttagttcattaacaagggcagaaaaaggtgacttttgatcatctagatcctgtacaagtacaacagttttgttatatgaatatgttgcattctcatgcaccacgtatatgagtataaatttacacgaaactgtatataggtcccgtttggaagtggcaatcagtaataatccgccctggattatttgttccatgcacctaaattatgattttttgaaaaactctcttatattgccttgcttagacaacttgttcctagctactactccatctgtccacaaatataagggattttgggtttctccatttgtccacaaatataagagattctggagtactttcccaatccattgaaccattgcatttgtttctcactggtagttgcatcattagatgaaatctttcccaatcaaataaagtcccgagagcatcaaagtaattccaccttatgtcacgagctccaggaagagactggattggatatgtgtgggatgtgggcggacgtggtttcgggagattggacgtgcgatgccccgtgatggcgacgctagaagaacgagatgagaaaacagagaaagtagatgagaagagtagattgaattcaagcttgatctttattgaatgaaagattgcttatataagcttatatgcaactgaattgctaattaaaagagataagaactaatgcaacaaaccggaaccaactaaacaaactcgagataagatcctattgccaagccgtactgtagcgcgtccgaatcacgccattcatgctgccgttgcgcgatctgattgatcgccctcatcacgcgccgccgttcccgtgcatcccgcattcatacgcctccgatgatatccaattctgaccatgataccttaaccttaaactctgctaaaaaaaacctagcatacttatatattttcgaactgaaggagtatttgttaagtttatttctcaaaatattaatttaccgtgttaatcaagtagatcatccatttcatttcacccgtgtttcatcactttcaaatggggccttattttgacaaaactatagttttaagacacaataccacaaagctagtatctatttagcattgaatttataaaaagaactacatatttatgttctactataaaaaaaacttcagatttagcatctcatcacaaagctatggatttataagttctattaggacaacagtgtgaggatctaactcataaaatctatatatcttttatggtctatttagttctatgatctgtggtttaatctgcagttttgttataattttgtgaaatttctgaatttgtgattttttttctctatttattaaaacatctgcatttgttatttctgttgtataccatataatgtgtttttgtaatttgaatactcaatttaacttattttgacagaatataattggagataagcattcgacaattccttctgtgaaagttgctggtgattctgtagctacagaagatcctgaaggggaaggtttgtttgttgctgtaccatcaacgatgatactccacaagaaaattcatatttccattttaggtcccttttgataagttcattcctgctgcatgcatatttcatccttaggtaaaaatgataaagcagatgaaggtcctgaaagtctctctgatattgatgatgcggaggtacttcatcctatccatgagatcacttctatatatttcatagagtaacttatttatgtcatctttagatcttgaaagataatcagttaggctctttatgatttactacagtgctactattaatttctaggttgatgggtaccttcacaacgaggaagaaacacagtacaaaaaaattatctgggaggaaatgaataaagagtaccttgaggtagctaagctgattacatagtagcataaggactttcttattttaaccacatagtgtggttctcagctggttgctttacaggaacaagcagcaaaagcagcattagcagctgagctggcagctagaggagtggttgtggaagaggggaagaggaaagtatgaaatgtttctagtgctaccaacctttctatgccgtgtgttcactgtagttcgtgattaagcatggatatttcatatgtagagaagaagacataatgaagatggcaagaacgcaacacccgctcaaacaccagcagaagcaacacagaacatgttgaagcggaaggtactaatggtcaatacaccccgatgctttgtaaggtttttcatttacttttgatggagaataggagaggctccactacatattaatttcatataagggagttatttgtaagcagtaaagaatcagaagatgattagtgcattttaattatacttcgaatcatagtttcacaagatagtttataggataagtgcatggctttattcatatccatagtatgcctactcatgagactgtcatgtggtccctgcgctcagatgttccttggcatgttatagaaaatggttgaaacttgaaactgaatggttttaaattacaatacatcaatacatggttagtccaaacatgaaaaattgcagattttattttaaattagattttttgcttccagcatgacatgctctttaaatggtctaaagagaaatctacattaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaactaaacacctacggaatgttcatctccaccttcttttggtgctttccatgttgtattaattagatctaatcatgtgcaacaaaatccaacattggttctccaacaatgaaaaaggaggggcagatgtgccaatgtttgtggtgttggtaggtgaaacaaaggcccataagaaaggtatagaaaactgtggacatgtttgcatcatcttaattggcccataagcgaggaatttgctccaataagcccatagcaattaagcagacaccaattgaattgagtagac

SEQ ID NO: 43136 - DNA, 1687 bp, Oryza sativa
attcctaattcccttaacccatgaacccatgacagatgcgccttgctctaccttctgtggaattacagtcagatactactactgacttcattatggtctactttgttattttctgactgaaaatacatattgaattattgatttttgcgggcagaccaaagatgaagatggcaaagcagataaagagatggacttcaacgatgagtatggacaggacacaggtgatggtgaaacattcgaaggtggttatgattatcctgattacaactatgatggctatggtgatggagcctacggcgattatgatggtgttgatttttaatacccgatatatcaatgctgggtagaattgttacaattttatttgtgtgtgtatggcaacaattatcaattttacatgaatagttctgattagttgacgaaaacggagttaatcagtactcagtagacagtatagcagtgtagctcgttgatttctctggtgatatgttgagaagctgttgtagtaactgtattatttcattcagcgacctatacttgcaagttgtatattaaaacaggcctcgaagaaaaaggaaaattttgaatgcctcatgaggtatcatggtctacacattcgacaggagtggtgtgcatgtcgtcatttgcgtgaaatgttgacttaagctgtcctgattggcgagcacgtctagttttgagttgcagtgcacagttctttttttctttaatgcagcgttgaatgtttgtttgctgttgttgatgtagtctgatggtgatgaaagtagtgtgcacttcgtcgtttgcgtggctgtgttcctttcttcagctttaaactgtaactttcttgttttctagcacgttttgtaaagtgttttttgcaaataactttttatatagaagtttctttcgatgattagggctattaccttactagtggtctgaaccagtataatctatgtcttctatgtgtttgatgtcgtatcgtgtaaatcatcgaatcaacgtacctcaataccttcataatacggtccgtgggtatccctcatcgataactgttcatcgtcttccttagccgaaggcgagaaacaaaagagggaaagtcttcctcagccgaaggcgagaaacaaaagaggggaaagatgggcacggtgctttgggtttacgacttcacgagttgttgtcgccggcaaaatcttggtgagagagaaggggagagtggtggagaacggtcatgtggagtggggttgacgacatcatgagttgtcgtcgctcggtgcagctagatgaggttggttttgctggattcggcctcttcctcctctctactgcttggatttggtcttatttggtccaccttgtagctcccgacctctcgcgcacaaaccatcagtgaggatgctgccacctcaaccggcccactcgtgttggcagccgggcacctcttccatccataaagtttactgagaaattaaagttccccaccttttccagggcgatgcgtgcgaacgaattcgtaggcggaccacggacgtgaacgcgtgggaaccgtaggcggacgaaaacacaaacgcgctcctgaatcggatgtgtgcagtggccaacggtgcaaaagcgaaaactaacgacaagggcaagcatgagagtcagatgacgtacaaagaaataacgcagtttcctttgcatcacc

SEQ ID NO: 43137 - DNA, 3396 bp, Oryza sativa
taaaacatcaattaattctgttttttcaagtctctctggctctcgctccggcgtgtgcggcgcgtgttaacgctgattcttggtaaagatgttcgtcttgattgagggcaaggcgattggtcatactgtaatgggggattaattatttgcaatgtgtcctcttggtgcctgaaactctgaattctttaagcattgtcatcctcctagtaaattatatattccatcgaagatagatagtagattctaggacgaattcgatttggacatagcaattttctgatatatctagtaaattatatatttaattccgaaatgttgggtgatacaggtatttgcctttcaccttgagtcggccccaatttccaatcttgatcttgacttccgcatatgaatgttgcttgatctgtattcgacctatgcaggtgctgttgatcgctttgtgaaatggagctcccagttgctgatcctgggccggtgagggctgaaggattgcttctgcagtgtccctattgtgattcagaggcaatgcacaaactcgcgcagttcttgctccccggcttggctgcggtatgcattgactgcacgacaggcgatctcttcaggaagccatcagttgtcgccgttgacatgaggaaggaaatggtggactacgtcacgcagagaagcgagacattcatatccgattcgcttatcgaatcagaagcaagtcaggatcaagagaacgagatgccggaggacccttttgagatcgtgtccatcttcatggatgattttagtagcacgaagaggaacattatcggccatgtctctgggtggttgatgagcgacagccgcgaagataagattgatgactttgtccaagaaatggagatgacccgcttctggccgctggaaaggagagaaattattgctgaggtcctcctcaagaatgtagacctgaaaaccaagtaccactgccctgagaaatatgaaaatgaagaacgtctcgctgatcataaggcccagtgtagcttcagacctgttacctgccccaatgatggatgccgagcgaaagtttctgttcgctgcatgcaagaccatgattcagcttgcctgtttaaaatccttacatgtgagcagaactgtgagaagcggcttctgaggcgtgatatggataggcactgcgtgactgtgtgccccatgaggcccatgaaatgcccttttggctgtgattcctcctttcctgagcgtaatcttgagcagcactgttctgagtttcttcaggcacacctccataaactcctcaaggctattcataagaaaggttttacagatgaggggctcaaggaccatgctctactgctggaaaaggttaggctcctgatcttgttaatttacaatgtgtaacatacgcttttcaattaaaatggctgccttattttcttgatttggaaacattgctgtcaaactattgtgaaaaagaagacatacatggactgcagcaatatgatttactgaaataatctggttttgttctgcagcatgacaatgatggtaaactggctaaatctcgggatgtaagatctcttactaatgttgtaaagaatcttgaagccaaaataaaagatgattcgagttagagtggatggcgtctccagagcaaaatgcaagttttttttgaggcagcaaaatgcagcatggatattgaatggtatagctgaagagttgtttccactcacagtatacacagaagagtacaagattctgcacgtttttcctttacaactataattttcccctcatgatttttcttttctcaaaatcggttagttttttatggtgtaaaagtataacattattttatccttgctattttgtccaaggaactcttttttttcatataaattgagaataatttatcaggaatgctaatttttgtttaatttatggaagggcgatgcttgaagtaagggatgtttttcccagtctaattccgttccctgtaccagctaaatactccctccgtcccaaaaaaagacaaaccctggtttccgtgcccaacatttgaccgtccgtcttatttgaaaaaattataaaaaaaattaaaaagacaagtcacgcacaaagtattaatcatgttttatcatctaacaacaataaaaatacgaattataaaaaaatttcatataagacggacagtcaaagttggacacggaaactcagggtttgcctttttttgggacggaggcccactagctgaagttaaatgctattcctcacaatgttattatttgttttttggaaactttttttttcaatgatccagatcaaggttaggaacactagcatttatcggtaaactgttggaatagtttaaattcaaattttgtttttcgatttacacttagtaccgtttacatgccctcacatgtataatgcccattgataggatatctccacctcctacaagttgtgtcgttttcatttatcatggattcgtgtatgatgtttatttcaatgtataaattattacaagaatgtcaaacatcttttttttcaactagtccctgatcggtaaccattattcaaattctttttttttttgctgggaaaaccgttattcaaattctaatattcgatttagatttacagtaaaatctattccctctatttcatattataagttattttgaattttttctagccaaatttatttaggtttgacagtttattaaaaaaattagttcggttaaatgtaacattgaatatgttttttttccaaatgttgctatattcttttattaatttgatcaaacttaaaaaagtttgactaggaaaaaaaatcaagcaacttaaagtcttttttatatgaggggaaaaaagagaattgaaaagatacgcaaaacaaggtgagctttagcgaacgattaattgagtattaattattttagattttaaaaaatagattaatatgatattttaaagcaatttttctatagattttttttataaaataaacatcatttagtactttagaaaatatgcgcgtaaaatacgagggagtttttctgtatctaccgaatcaatttctctcaatcagttttatgatatgaaacagagggagtagatcgctaattactggtcaggcttgggtgactggtactttttgcaaatactggtttcctaggttttatcctaacaaataatctggcgatattttacggtgtttgcattttaaaaagggtaaaagtctatcgctgcacaatgaaaggtaccacttaaaaggttgatatagttacttactccctccgtcccacgaaaatccaatcctagcatcccaagatagaattagtggaggatagaaatgactaaaatgcccttaatcattgaaaaaaagtagtaagagtaataataggt

SEQ ID NO: 43138 - DNA, 12883 bp, Oryza sativa
actaaaatgcctttaatcattgaaaaaaagtagtaagagtaataataggtaggtaaagggtattaaagggagttttatctctaaagagtaggtaggatggtaggatggtaaaagttggtttttttatgggacaaaattcaaactctagaagttgagttttttttttgacggaggaagtaggcggtaaaagtaaaatgataattttcgtaggagatagagaatggcataattgttttcgatattagttccaggtacataggtgcatacaatgcctcactaactgtgtgcccggtaatttacatgacatgttttttagatttacattttttcctacgaatatggtcacgcagtaatcctctagattttcattttgttttaggagcacgattggttaaaatatgatcgaatgtttgccaggttattttgatatttacattttatcacaaagaacatctaaccttggtaaaaagatcagtggttagtaggttcatgtgtaattcatcctcaatacgatatatttatattgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttgccattgaaaattaactacctctttgattttaggatttatggatttagaataaggtattcggatatatggatcaacgtgcgcctaatctacagatttgcgaactaatcatctatataaccaagcataaggaagataagtaccgattcttttttaatacgtaccggttcaatcaagaaagatattcacatcaaacaaaattaccgttgttttactagttacttaccctactgcaattggttataataattttatttcacatcttgcccttgcctttctcttagatcaacgatccacattgcaccacctctcagtacctctacatatctcacaaactccgtaaaagatcttaataaacttagatgaatgtgaggccataggccacacgttttccttcatatccccgaaaactatatcgtatcatgtaacaaatagtctataacagctaactatgcgtccaaacaaaactacagcatatgcatagcaactcgttggtatcaaaggtaccaggaggtaaaaaatttatactaaaaaaattatattacctttatggacgtgactacacagctagtagctagtggtagttagtttgtctaaaccagctaccactccatttatgagagacattatccacatatacttcaaatacaattttctcttaaactacttatccgatttacgatccgattgcaccgttatgtttgtaacaattaaatctttataacaagatctcacatgattatattctaataaaaaaatataaattacttttataatatatctaaattacttttagatttcactaaattacttcttaacatgtaaaagtaaattaaatgaagtctaaaagtaatttacatatgttacagaagtaacttgtaacaaaaagaaagtaactttaatgaatgtgtcgacggaggatacccgtagactggatatagagggtattgtcgacgggggatacccatagaccggatatagagggtattggggtctgttggtacgaggatctacatagtacgacatcaagcaaacaaaagacaaggattatactggttcacgccccttagcaggtaatagccctaatccagttggtatgggattatatgatggaaaccccagattacaaagggaatagaactcggtgatatcgacgagaccgtagtcgagttggcccgactagatctcctagtgacttggctcttgtaagctccggcttcgtaggctgtggtgggtgtgttggcggtgagattcgatgccatagatcctgccagggggtcccttttataccgcggttcagtcgatctccaagtagaacttggagatatcggacccctcacgatatggtaaagacccagtctcgtccgagtaggactctttccatccgtagattctgttcctatcatgggatagatttccttaatgtatacggaaactattcgtacacgcgcgggtatactgtatcggtacccatcgtatatccaaggatagagggcataccttatccgtaaccctgacatttaattggatgtgactacacagctagtggtagctagtttgtactccatctagtatctcctttcaacttaaaaaatacaacagtatcttcttttctcattctacatgaaaaacaaaaatgaaagggaaaaaacaatcgatgattaaacagattcatagagagttacttttgaaccatgcaaaagttacttccaattaacattgaagttacttttaaaaattgttaaacttatgtgtgttgatccatgctgattaaatttaatttctagataaagtcatatttttatccctacaacgaatttactcctattgtcgtgacaaaattactgccgttttgttttaagttacttttataatataatatatgtaaattacttttagactattaaatttacttttatatgtctaagaagtaatttaatcaactctaaaagtaccttatatatatatatatgataaaagtaacttacatataaaatgaaagtaatttacaaatataaatatttttttcatcgtaatataatcatgtaagatcttgttgtgaagatttaattgtaacaaacacaattatataatcgaattatagattggataagtaatttgggagaaaactttgtttgaagagaaaaaggacgtacatgtatattaaaaaaatgcatgcatgtagtactatgtagtagctagacttctccacgtaggcgtcgctagttaagacaaaatcgagaggcctctccaaatagattttatgtacctttatacttcctccatctatttttgatagtcattttttttaaatctgaaaaatttatttttgatagtcatatttcaatccaacaacatatactcttaatgactttctcggatttaatgtatgtctcactattcttccacatatgattggctacatggccattgagaaatataaatattaatgaatcgtttgtttacgaggaatgactagtagcatgtttaaatggatgataagtagaattacttatccttgttctgtgtgacaagatgaaatatgactatcaaaagtagatggaggaagtatttgctctaataacctctcgatacctcctattgaccataaaaatccctataaagaaacttttactacaaacactggaaaacttgaatctttcttgcggtaaagacattgattgtagtatgttagtaccatccaagtctagaacgccactgattctaaaacaatttcatgtacgtccaaaatatataagtaaaacgaaatatgaaaaacaccttatgcatgttgtacacgcctctgaaatcatccaactatgcgttgtaaccaccttatactcgatgttatattgtaaccttcctcactgaaatgtcttcaacacctcgaaattctgaaaaacaattctatattgacatttgccaacatgtcaatttaaggtttacacaaacacatgattttctacgtaaagtggcacacggattaaataaataaccaggaaaattcatattagtttggagtatgtttcctagaatgatttacaataaaaatcggttgacaacttgtttttcttaaaacccatccaacaacgggttagagaaccttcatgcaccagaattttggcattatcatcaccaactttaaatacagaagcaacttgtcacgcagactcttgacaagttcacttgagtcggcatcaattttgtgtcatgttttaggatcaattctgaacatcagatcagaggtgtactttccagttgaaattctacagtaacagaagttgtctgcactacactggaaacaccattgctactgctgtagtgatttactacaattaactgtagcacaagactcatttcagtattgatgcacctctgcagtaaggatcagtttccgttgacactgcttcctctttttttccctcaaaaacgcatgagagcattgctcccatttttatcaaggtaataagctgcatatggtgtcacttcagctaacaagaccaacctttgcagatcaaccagtccaattaatcaggaaatgggccatgctaacattgaagtccaaaaaaatctcatatgactgcctgctacatcatctcaatggctaatgatcatcttgttctgctaacactacagatataaattaagtgaaaagattcaggactgaattttacagctgcagaggggcacttgtatgtcttaccagccagggtcagatgcctcccagctgccatcccatggataactgctagaaaataaaatgtacaactctgattccttatccgtttgtgctacaaatagatgtcaagtcaaaggagtaaaattataaacacataaccatggaaaaatcaggggaaaacacagcagtccaacaggaaaaaaaaatgagtttaactacagccctcagaacaaacaatggcacaagatatgatggaaatatagaggcaacacatggtcttcaggagaagttaagtgcagttcaacccagggtataaatgatccacatatttctcataatataaaaactaaacaggaataacatagctcctgaagaaaacgatttcagaatttcaggctatctgaacagtataggatatagtaaaatctcatcgatcaccaaaaaatccaaataaagcaatagcagatattctcatggatagtggtaatcttggacaaatttgaagatcattacagcatgactccaagcatatatacacaaagagacatgcacagaacacagaagatccaggatattatattctaactcagaacacacatagtttgtctaactaaagaaagcatcaacggattagatagacacactagtgagaggtttctgatgtcaaagggtggttcactgaactttacaatctgcaatcaactgtagaacgaaattgctagaattaatctcttctacatttgaacatacctggcatcaagtgtgacatgtgcagtagtatagcccttcatggaatccaaatagaaaaacactaaaaaggggaagagcttagacatagtcaatcaagaggataaggccattggattgtgaatgtgattcatccatgcaaacaagatttgctatggtcagtactcagtaaacactaaacaatatggaaataatgtaggctaagcaagttgttaacattgtgaagacgtgtgacatccaaaacctgaaaaatcatgatggatttaaggcaacaggaatatatgctttacagataatctgacagcatgctttatgaacattcgaaatacaacatcaccagtggcggattcactgttggggctggttggtgtgccagccccacctctaatccctgctcttaattagtcattaacaaatctaattagtcattagtgaagaaatttcccgaatagcacaggctaccttagttcttctactgcccaaactgataaaacagaacatcctccgagtataaataacaatatattcacatatatttgtgaatattttaatatagccacaaatcaaaatagagagttttttttatcatatgcacatttggttttcattggaaaatactttagttgatatacctttatttgttttaatcatactccctccatccctaaatatttgatgccgttgacttttttaaatatgtttgaccgttcgtcttattaaaaattttaagtaattattaattcttttcctatcatttgattcattgttaaatatacttttatgtatacatatagttttatatgtttcacaaaagtttttaataagatgaacggtcaaacatgtttaaaaaagtcaacggtgtcaaatatttaaggacggagggagtattatattttttacactagcacctcctcaatttacaccctggattcgccactgaacatcactgaaactatagtcttatgttatgtccaaagcattttgtggattcaacaaacatcacatttgtgaggcatctagtcaaatattttttaaaacttcaaaatcatgtgcatagaaaatatgagttttcagatactgacagttgctgaaaggagaagcactctaatcaagaataaatttaacaatcagtctagcgctggcaaggggacaaagaaaacggaatccatgcgaggatagtaatgggactgggttcgcccagggagatggctagagagtaggcagaattttctgggagcaaagtcattaaaaagactttgttaaacgcattaaattgatggacttctgatcaaatcacgaatggccatgatgtcctgtatcatccagcaatcatatatcagaaaattttaaattgatgcctttaaagcacaaattatttgttttggggagatttggaggtaaggatccaacttcaaatatgaggtgtttgatcaaatcaagcgctagctaggactacttgtatcaacgctccatgtatagccaaactgatgctggtgctgttataataaagtatagatacacatctaaattttggtcaaaaaattggaatatccatgatggcatgatgttcatgttgctatttacacgtcaaacagtagtgttgcatggatctctccacttctggcatatcaggaagcatgtgcagtaactaaacaagttgatgaatacaaaacacagaactatttataattgcaattcccaagctgataagatcaaattggtgaaaatttccaattgcttttatttacaatcaatgaagtttactaagaacttatgtatatctgtaaggaatcagtaccacaatttctaaagtgctgcagaacagaagcaggtgaatctgaattgaacagtacgcaggtgactttcttcacctcaatattagacaaacaatcgttactttattgtctaagcaattctaagaaaattatatcgcaaaaaggtccaaatttggcatatagtaacgcagtgaaataatttcccatcctgataaagattattgattagtttccatacctgcaaaggcttcctatgcttgcagtgcatgcatttgtcaggaggcaccaacaaggacagctactgatctttgaaagagctagctacatagctacatatgtcagatggtacaagaagcaaccacaattagattgacatgcaaaattcgattaggaccaaaagagtttacaaataccaaacctgtactgcaacagatctgaaagctacaatattactccagaaaaagcagaataatataaatatctgtctccaattctccatgaaatacaaagaagtgcttgaaatgtttgcagcatatatgacatatttttattccatatataacatatttgctattccatatatgatatatttgtaattccaaacgatagataagccagctctttccatacctaatcagaaactaatacacaaaggtagttagcaaactgagtaactggttttggagaatacaatggccagccggcactgagcagccatatttctaaggcgttgttcgtttaatccccaagagagagggattggaagggaataaatctccttcaaatccacccataagagggattaaacgaacaaggcctaaaggggtttcatgtatgtaggtgtagaacccatagggcccatgagttatatatactaccgccatccttaaaaggatgacatcataaaatgcatgcggtcaaacctcaaaatgttaaacgattaatatatggaaaacatattaggatttgaatatgaaaatatatattagtagatttgctatgaaaaactattttatatagttatacttttattaagttttataaatacatagtttgaaaaattaatgatcgaacatgtgcatggaagactgacgatatccaaaatataagtaaaaaagaatggaggtaataatatggtggtataagtctcacactcttacatgatgagtttaataaataggttaaggccagagtataaaattaacagttccaaaaaaataactccggttaatgcaagtgtaagtagggtaaggcctgatagaagggctagagattagtgatcaaagtattgtctgcaaatatattgtgatagaaattgttatcaaagttatatttaggagaccatgttgatgcccaaaatgataagttttcatggctagagtataaagaatctagattacatcagtattccttactgtgggaaaatatctagtaatacattgttaactacttagtttatgcttctacctctgatgctttcacaaaagaaaccctcaccaatagccaccacatgagcatgaaccattcttgaaatgatgaaaacgactggggtcgcgcactacgatctcatggtccacaatcttggaaatgtaggtgaatgcgctatggcaatcaccacatacacgcaggttctttgtgatccttattgggcaaccagggaaagttgtgaggagaccatatgcaagagcaagtttctcactgtgctcaacaagaagattatttttctcttcctcatcaacatcatgtaatgcgaagtttgtctcaggaacatatcccatagctttgatgcgatcaattagactctccagaagagcataaatttgtggggatagtgggtgtgatcgatctccgacaaagaaagatgctgtgcccttttgaccctggacccagctgcatcctggcctcttcttaattcctgatttcttcatcaagtgcctgatcctcgctacatccttccaccgccctgcagtggcatatatgttggagataagcgtgtaagatccatcattttcagcattcatctcgaccagtttgttcagagcatgttcagcaagttcaacatttgaatgtactctacaggcactcagtaatgcaacccaaactactgcggtgggctccattggcatatccttaactgttttccatgccttatctaatcgcccaaagcgggccagcaagtcaatagcataggcatagtgctctgcccgaggtgtcaaaccataatctgcactcatgctgtcaaagtacgatagaccttgatcaaccattccacaatgactacaagcataaagaacaaccaggaaggttatatcgtcaggaacaaagcctgctttccgcatcttgtcaaatatgtccagggcctcactaccacgaccgtgcattccataccctgtcatcattgatgtccaagaaatagcactcttttgagacatgctatcgaatacatgcctagctgtatcaacatccccacactttgagtacatattaatgaggcagttcgccacaaagtatgcagatgagtcatattggtgatgacgaagcacataagcatgaatctgcttacctatacgtatggctgccaaatgtgcacaggccatcaaaatgcacgaaattgtataagcatttggggctactccatatggttccgaaatcatctccacgaaaagcttgagggcatcatttgagtccccatattgtgcatgccccccgatcatgacagtccaggtgacaacattgcgttcctccagaggtatatcatcaaatatggagcgtgcagctttgaagcttctgcactttgagtacatatctattagcgcgttgtacaccataagatcctcatcctcaccaccaaaatcattatccaaggttagaagacagttctttagggagtaggcatgaatttccataccctgagaaaatgctcccaaagaagcgcaggcagacaacacagagatgattgtgacacaatttggcaaggacccagaaaatatcatttgacgaaatacattgagtgcttcatggctgcatcccctctgagaatagcctgcaattacagcagtccatgttaccatatctaatgggatattttccttgcgcatgttcttgaaaagctcaaaggctgccttaaagttgccactttgggagtacccagccaccattgcgttccaagaaaccacatctttgaattccatcatgttgaaaacctttaccgcattttccatcaaaccacacttagcgtaagcatcaatcagggcattaccaacaaaaacatctagaaatgtgccattacgaatagcattaccatggacttctttagtttgaggtactgcctttagagaaccacatgcagggagtatgttgacaatgctaatgatgtctgacctttcatttgtaggcttctcatggacaatcaatgtcatctttgaaaacagatccaatgcagtccaagcattactacttttaacatgggctgaaacaatagagttccatgagataacatcatcaatacccctctgagttatttcatcaaagatcatgctggcttcctccaaagaaccacaacgggaatacattgccaccaacgcattacatatgaagacattggactcaaagccattgcagcatatcaatccatggaatgcactaccacaacggtatgaaggtagctctcaacatgcttttaatacatgtggtagagtaaaatggtcaagcctagttccagcacgcagcatgcggcaaaagacattaattgcactgtcaaggcggccttgtttaatgtgttctcggataagtagattccaccacacagctggtgacggtgtaacacgttccaacaccaagagagcatagtcggtagcaccacaagcaagataagaagctacgacaccagtacccagagatcttggagatataaatggttcggatggcaatgctggcagtgagactgacaataatggtgtgggcaaagaaagaagaccagaagcaattatctgttggtgaatttgatgaactgtatttgcagacttgcattccttcaatagggatgcaaagtgactaggataaacatctacaccaacgcatgctgcccttgcaccttaaaggaaccgtactccaattggttttaccgccttaggcaagttcaaaagcatagctgcagtagaataccattatgcataatgaatcctcaaagaaacagccattgcatcactgtatgaccaaaaataactgaattagcaaaagccatcatacatattacatcaatctaatgcaaaacaatgtaatgtaaaggaagaataagtcaaagatcacaaaggggaataggcatgctatccatcagggttgcagaatcaaaggtagtttgtagtatcctaccatcctgtaaaatccttcttatctggattattggggttttaacaacctaacatcatgcaagatcaattgtcaactcccagtgacaatattcatgcccaaagcttgtactatgtagcactaaagcattgcgatgcttacaaattatccacctgagcatgtgactgtaaatgtccatttcatcatttcacttcaaatgtcaatctcaggacacagtggaaatactagccctagtaggaaaattttgactatttatgtgtgataagggggtataacatgaaaataatttgagctgcaacagatgcacacatagacatgactataggtttaccaaattgtcagaacgcacgagagaatgagaaaggaagaataataacaaaggagcaactgtttgtaccttttgtattcacaaacactgcagttcaaatcaaccatgagaagcaacagtggaatgattttaaatcaaccaggaatgcaaactaaattgttctttatatcatatcaacgcctcctaaatctatgaggagtatgtggaaaaaattcgaagttcagtactacaactaataagacaaatcgaagccattgaagggtgtcaacttttctcactataccatgtcccatccattttgattcaattctttgaaaaccttacaacaaccagaacacaatggaaaaaaaaagataaaaacatgaatggttccacttcttacgatctaaatcttgaagtcctggtacaagttcccttgtttcaatttagaacaactgaaatccattttttaaggaaacctttgataattggatttgcttgtactactctctatctgtggtctgtactattgattaaccataagcatttattttgagcaataaaatctaaatctggcataataattcatagtaacagtttttcaaaattaattgacaacataaataatgatttcatttttttgttgggcttaagcggtatatggcataactatcaacactggaagcagtgggagtcggcaatgtataattgccaaagaagaaaacatgaataaaggaaagtaaccatgaaacttcatcatccttcaatttctatcagacacgattaattgccgatgctgaacccgtcccactacaatgtatagagattttctttaaatacagtaagctatatgtttcagtgacaaaaaaaaagagaagaagatcaaatggagcacatgtgggagagccaccgccacagcaccagcaccagcaccagcaccactggagttggagaggagctgggagaaggaagagctttgttattacctgtcctccaggcgtccgcgcgcaagaagaatacgtcggagccgcaggcacggaggtggcggacgacggagggcgccgacgagccgcaacaggccaaggcacaaggcagtggccggaaggcaatggcgtcgagcaagcgagggaagggccagcggagcgtcggggcggacgcgcggagaccgggggagcggagctgcagggcaatgcggcggcggcggcgtggcttgtgacggagccgcccggagtctgggttttggagcggcccaatctgtagccacacgtacggcccataatgttatcacttcctgcaactagatcgacaaatcttaattgataaagtcatcataaacacttcc

SEQ ID NO: 43139 - DNA, 1405 bp, Oryza sativa
ccatgtctcccttgtgctaattcacttgtttggttaagagggtatttggcttggattacacatacaacaccaaattattacagagatcattcttaaatttattctaaactacaaaaattcgaaaaaataaaatatttttttaaaaaatgacaaagtagaaaaccatgaaatgacaacagaaattcaaggaacttcaaaaatatggcccaaaaatctgaaaatattccaaaatgttcacaaaataattataaaattctagtaaaatatgctgagtagaattataaaattttagatggttatataattattttataattataaaacatcatttactcatgggagcaattgcgcgatgtctttgtccttaactttcgaggcacctacgaggagccgaagacacagcagcatctactaggcattcgccagaggccggggaaatcgataagggggtacatgcgtcgcttctcgcaaacccggtgtcaagtacaagacataatcgaggcgtctgtcatcaacgccgcttcgcctgagctactcgagggcgaactcacaagaaaaatcgccaacaaagagccgcagacgcttgaacacctgcttcgcatcattgacgggtatgcaaggggtgaagaggattccaagcgacggcaagcaatttaggctgagtatgataaagcctccgtcgccgctgcccatgcccaagtacaagctcaggtcgccgaaccacctcctctcgctgttcgccagcctcagccggcgaaccaaggacaaccgccaaggcaaggccaagctcccatgacttagaggaaattcagaaccgaccgtgcgggcaaggttgtgatggctgtcgaagaagttcaagccctccgcaaggagttcgatgcccagcaagcaagcaaccatcagcagcccgttcgcaagaaggtccgaaaagacctttactgcaccttccacagacgctatttgcacaccacagggggcagctgtcgaagcacctcgcgaagccgttcaagaacaagcacccccagccgaacagtgccaagatgtgcagcgcagagtaatccaagtgattataagggccgacctgacgaatcagctgtcgaaatggcaaaagaagatgcagctccgaatggtgcataacatcactttggcgggcgaaggggccccgcaatatctaagccagcaaatctctttcgggccggaagatgccgaaggagtaatgttcccgcatcaagaccctctggtgatctcggccgagttagctggcttcgaggtccggcgaatcttagtcgacggagggagttcggccgatgtcatcttcgccggagggagttcggccgatgtcatcttctccgccgaacttactgccaagataaccacgaaaccacgaaaccacgaagcgagtttt

SEQ ID NO: 43140 - DNA, 6642 bp, Oryza sativa
ttcggcggagaagcagtccaagttctaggccaagcgcaattgctggtagcttttggcacaggcgaaaacagacgcgaagagcaaatattgttcgacattgtcgacatcccgtacaactacaatgccatcttcggccgtgcgaccttgaacaagttcgaagccatttcccaccacaactatctcaaactcaagatgcctggcccgacaggagtgatcgtggtcaaggggcttcagcctttggctgcttcaaagggcgatctggccataatcaacagagcagtgcataatgttgaggccaaaccacatgaccgggcgaagcacgcgccaaagcccgcccctcacaacaaggtaatcaagatacagattgatgatgccgatcccacaaagcttgtatcgctggggggcgacataggcgaagaagaggttgagaacatcctagaggtgatcaagaaaaacattgatatcttcgcctggggccctgatgagatgggaggtgtttcgacagatctcatcatgcatcacccgacagtcaagccggataccaagccaaggaacagaagctacgcaagatgtcagttgatcaccaagaagcagcaaaagccgaagtccaaaagttgctcaaggctagggtcattcaagagatcgaccaccctgaatggctggcgaatccggtaatggtgcggaaatcaaacggcaaatggcgcatgtgtgttgatttcacagacctaaacaaggcatgtccgaaggatgatttccccttgccacagatcgaccaactcgtggactcgacagctggctgcgaactcatgagctttttggatgcgtactccggctaccaccagatccacatgaacccggccgacatccccaagacagccttcatcacaccattcggcaccttttgccacctcaggatgcctttcggcctgaggaatgccggggcaaccttcaccaggttggtgtacaaggtcctttacaagcagttggggcgaaatgtggaagcttatgtcgacgaaatcgttgtaaaaagccgcaaggctttcgaccatgcgtcctacctgcaggagaccatcgacaacttacgcgcggtgggtatgaaactaaatcctgagaagtgtgtttttggtgttcgcgcgggcaagttgttgggtttccttgtttttgaaaggggtatcgaggagaaccccgagaaaatcgatgccattcagcaaatgaagcccccgtcgagcgtacgcgaagtacaaaagctcgcaggccgaattgcggcactcagtcgattcctctcaaaggcagccgaaagaggtttgcccttcttcaaaaccctccggggcgcggaaaagtttacctggacacccgaatgccaagcagcgttcaacgagctgaagcaatatctgcaaagcccgcccgcttagatcagctctgcggcggagctatctcccttcggcttgcattttgtcgcccgcactgctatcaagtcccaagtgctagctgacttcgtggccgaatggacaccggcattcacccctgagcccgagcccgttgaataaccctgggtgatgtattccgacggttcgtggtcgcacaagggggcgggtgttgcggcagtactcacttcgccggggggtgtgccgattcggtatgccgcaaggctgcagttcaacacaaccaacaacgcggcagaatacgaagccattcttctaggcctaaaaaaggcaaaagcattgggggttcggcgcttgctcatccgaaccgacttcaagttggtagcaagtcatgttgataagtcctttgaggcaaaagaagaaggaattaagaggtatttggaggctgtttggtctatggaaaagtgcttcgccggcataacggtcgaacacttacctagaggccagaacgaggaagcagacgccttggcgaaatctgctgcttgtgtggcccacattcgcctggcatcttttttgaagtcctatacgcaccaagtgtgcccgtagagagcctggatattatggcaatcgaccaggcagaactgggcgaagatccaaaagactggcgaaccccattcgtaaggtagctcagaagcggttggcttccggaggacgaagcagaagcaaagcgcctacagctcagagccgcaaagtacaagatggtctcgggccaactatatcgctctggggtgctccaacctttgcttcgctgcatctcttttgccaaaggtgaggaaatggcgaaggaaatacactaggggctctgtggcgcacaccaggccgcaagaacagtagcctccaaagtatttcgacaaggtgtgtactggcccaccgtgctgaaagtctgtgttgagcaagtcaagaaatgtcaaagctgtcagcgccatggccgaagccaaactgcgccccaatacgagctgaagcctatcgcaccaatttggcctttcgccagatgggggttggacatcattgggctattcccggtggcgcgaaatgggtacaagtttgcaattgtggccatcgaatacttctcctgatggattgaggccgaaccacttggcgcgatcacttcggcagcagtacaaaagtttgtatggaaaaacattatttgtcgtttcggagtgccaaaatagttcatcactgacaacggcaagcaattcgactctgacaagttcagagagatgtgcgaggggctaaacctggaaatcaggttcgcgtcggtcgcgcacccacagtcaaatggggcggccgaacgcacaaatggtaagatcctataagcactaaagaaaaggcttgagggggcagcgaagggtaaatggccggatgaaatgctatctgttctctgggtccttcggacgacccccacaaggccaaccaagttcagcccattcatgcttctctatggcgacgaagcaatgaccccaacagagctaggggctaactcaccaagggtgatgttctctaggggcgaagaggggcgcgagttgtcacttgaactcttggagggggtgagagtcgaagcacttgaacacatgcgcaaatacaccacaggcacttcggcaacttacaacaaaaaagttcgaccgacggagctgttacctggccatctcatcctaagaaagaaagcgaacccagtggcggttggcaagcttgaatcgaagtgggaaggaccgtacctcatcaagcacaagtccaggacgggctcctttcgcctggcgacactggaaggtgaagagttcgaccattcctggaacactgcctctctcaagcgtttctatgtgtagaatgggtggcacccaaatcgccaacttgtaaaaatgtacatattgttatgtaagcctttcggcactatgtaagcccttcggcacaaaaatgcaaaaaaaacaggaaaatgaaaaaagacaaaaaaaaactggatgtgggctattatccatcccggaggcccgaaccagtataaaatctttgtgtcttttgccttcttatttgtatgattgataatttgtggaaaaaccctaaggcaaacgcctgatcagcaaaaatgccagggggcgaaacgaatcggccgaagcaccgttcgccgaacgttgaaaccgcaacagcttgtttcgggaaacaactaaccgaacaccgttacattcgatcaaaatgaaagcacaagtgcttccttgaacgtagaataaaacagatcgaaaacggaagccgaaagctaaaaagtcatagacctatttcgctaatacacgcaaaggggccgacacgttccgacctaacgaaagcacgagaagtgacaatgcaaaaaattgtgaaaaggaaataaagcacatctttcttgacttcgaagaaaatatatatcgaagaatacaaaccctacatcatggtacaagtaaagaaaagcgatggctctacagcccagcttacagataaattacatcttcgcccccacaaccgtccttactctctacggaatggtcggacgaactaggttcgtcatcactaccaatatcatacacaaccctgagaggagaagggggcgaaacacagactagactgtaacgacgctgggaaatcgcctcctgccgatcagacttctgatggtttcgccaaaagcaaaccatatcctccaaacattttgaatgaacactatcgtaatcttccaagctttgcccggggtgcgcccgcatccagccagcaaccttaaaaaccttatagctgtggccgttattatcatttcacgataaacgggccgaaacgggcatcgcacctttggcagacccttcaacgccacaaacttctcgtttttgcttcgccaattcccagaggggggccaaatgcacaattttcagcgaacatcctgataaacagtgcagaaagggcaaaaggcaaatttcatagtaagaatgggcgaaaaagagtaaatattaggtaatgcgaaaatggcgcaagcgcatacgccaaaggcatcgaccataaaaagtgactaagaccgagtcatacattccaaatatccaaaaggccattttcggctacaataagaagggtaaggggccatcagccaaatatacattgttcgcctttcgtggcaaacgcaaaaagaaaaactacaaaaatctaaggaaagggcggagggcctcacacctctaggtgatcctgggcatcgcctccaccccctccgaccgccgcatccttgccttcgccctggtctaccacctctgccttcgctagttgctccaaaaggcgtgccttggcagtggatcggacgtccttctgccagaactgtttccgccatgcgcggagcgcgggcgaaacgtcctgcgcactaacctcccagtcccccttcgcatagttagggaactcggcgacgtgctcacagccgaactgttgcagaacgcccatagtgaaggccgccgatacacgtgcacagcaatcactttacgtagtggcgcagtccgaaaccacaccaccagcctgctgcgtccactccgagaagtcaaaggcagaggcatctttggcggggactcctcgcaccctcgcacccatgtcgaaaagggcaaggcggagcgtttggcacgccgttttcgcggactcggtggctttcgccatctcccacaaaaaccgctgccactcctccgcaacgcttgcctcagccttgctggcctccaggcgaagagcctctatcttcggctcagtaagattgtaatagtcggtcagcgcagcggaatgggctttttccttctccagtttggccttaaggcgatcgacctcagctctagcctttcttcccttctccagttcagcttggagtcgcttgttttccccttcgcctccttgagggtgttggagagggcctccatctccaaactcttgcggcctatctcgtcatccttggcccgaatacggctcctaaatccgtcaagatgggcccgcatggttcgctctgtcgaacagtcagccgcaagaatctggatgtaaggtaaagcggacgaagagagcaaatgttagttatgggatctgtaagaagaaaataaagacaaacaaaaagagagagagcgaacagcatacctgaaccgccaagcttttaatagcagaacacccttcgtcgaactcattcagctcggtgaataggctcggggtgccgacaggtgagacaaggttgcttacccccacgacaaagggaataagttccacccaagtctcgaaatcgccaggggtgaagtggggcgccgcgagagaatactccgaggcagatgtttcgacggccgcccccttccccttcgacttgactagaggcgaaacaaccggctgacgcaaggggcttcagaaaaccctagccgcaaccttcatgacacgatcagtggaggctgaggccccggcggcggcactgccacccgctccgccagcgtcgatcgaaagaacgggggcggtcgaaagatctaagctgcgactagcgggcgaagttggggtttcgtcagaagactcatcgtcgctgaaaacacgagcaacatcaacgagtcctttcttcttggcggccttcttaaccggaccccccttcaccaccttgcccgccgaaaacacaactagcgccttcgccccctccaaatcctttcgatgaaggggggagctattcgactccacctcggtctcgttatgccctagacttggagtaggagtgtagccaggggtcttggtgcggttttcgaccgcctcgtccgcagcctttctggccgcagcctccgccccctcttcttcctccccttcctcctcgccgtcacgatcttcgacgtcgtccctgtcgtcggcgtcagaatcggaggaagcagggacccttcgcttcctaggggccagtttcacttgtccgtgcgtccgctttcgcgaaggctctgcatcgtcgtcggccttgttgtgtgagcagctggctgtactcgacgaccgacacgtcgccaatcatcttccgggcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacgtgttcgtcttggtacaaccgcgaccttgccacgaccgggagaggggaaa

SEQ ID NO: 43141 - DNA, 10434 bp, Oryza sativa
gcttcagcgtcggcctaatcaagaatcaatactgcgaaaataaaagatgtagccatattaagcgtcgaaccgggaaaaatagcgaaacaaagaagcgcatagcgaaagcggagtctcaccgttcgtcccctcaggaggaaccagcttcagcaaaccgtcgacctcttcgtcttggtcaaccgcgacttgccacgaccgggagaggggaaaaaagcgaagcatgcagaactcctccaccaagtcgcggcagctgaggcgggagcagaccttgcgcagcaaggcgaaccgtgcctccatggcgccgtccacggtgatcttgggtttccggttcggcgcaatcgccctgcgccgacaccggagggccttcgccgactcggacctagcctcgaaggggatggtgtgatagaaccacctcgccatccagtggtgatcctacttccacatggcggcattcaccggccaaagatcggagcgctcggggcgaacgttgaagttcatgctcctgaacaccgtcttcttcgttccgaccggggtaaccatcgtcttcgaattcatggtgcaaaaaatatggcaccgaagagttcggtgctaggttcaaacccggaggtccggcacgcccagtcgaagatggcgaaggatctccgacaacaacacgttgcacggaaaccgaagccccgcctcaaaaaagacggcgaacaccaccgtccggttgtcgacgagcttcggtaccacggccttccccggggcgaaagcctgcccctcaaccaacgccccagagctgaccaacttcgccagctcgccgtcatccatgagagaaatccccaaaaaggtggtggtgtcgtcgtcaatccggccgggatcgggccctttcgccgaagcggggtttggcttgcgaggagccatggtgaagggtgtgtgcagtggcgaacaaaaagaaccgacggaagatctaaggggtcaaggggcaccatgaaaggaaagaacggcggaagaaagcgcgcgcggtgaaaatgacaagtgtggcggtgaaaagggaaaagaggggagaatatatagcccacccaggcaacggttcgcctacccaccagtaataaagcgcaacgtcgcgagggtaggcgaaatggtaaattcccatcgacttagccgcacagtaataagcccatgtagggaaagcccattactgttcctttcggcccggggaaaataaaaagtaactctaccatccgcaagaggcgaaagctacaaaacaataccaaccgaaaagacacaacacactttatttgcaggaataatataggtttcggcaggagcatcggtcgaaagggggcgccacataccataccacatggcttgcacggtctcggccgaagctcctatctcacccttgcccgtgaggggcttgttggcggtatggcatgaggcccttcgaccaaacctgccgaaaccatgcgaccagtgaggattcaagcctgagacgtcaagattagtcagggcgaagcccccatggcgaagactatggaacaaggacggcgaggggcggagaatcgcgcgggtacctcgccaagccaaaggcctcttgggcgaagaatgtgaggcgaagagtgtatgtcgaaggaagacgacttcgccatagcaagttcggcctcacgaaggccgatgaggccatcctagcatatcaagcctagcggccattgggccaacaatcgcctgacggcccattaagagcccatgtacctcaattacacagtatacccatgtaaatgtccctttcataagggcaaccatgtaaattcccctgtataacctaaaccctagtagtaagaacctgtaatgaggctataaatagtctcatagggccatgtaatggggggatcccaagaaaaattctcaattcaatacactttactttctttccaaccactgttgagtaaccacgtcttccgacgtaggcagttgtcatttcgacaacaacttatataggggaggattggattaggaaaggtggagtcgtagtgggagtaggactaggagggaggggagggagaccgactcgggcaaggggagggggaggcgcgcgcgggaaggagagggggagggcgcggctggctagggagacggggaggaaaaaggaaacaagggggctaggactttcccaaaaagaaaaaaaacaatgcggtgccgttttaggaaaggaatgaaaacggtcccgtgaactgacactgatacggttcgtcatgcaaaacgaaactgcggactgagaggggagagaattaggcacaattcacaaccaaaggcaaaggaagaaaaaatctaacttgacacttttaacttagcaacattgcctctggtgatctaatatttactctttaagtcctgttagtgattttcagagcaaagagaatttggaaaaaaagtttctacctgacaattccgattattaaatgcatggttaacaggggttttctcctggttaaccaaagcaaattcttgaagtcataaaactccgggtgtgacactgtactaccatttaaaagtttactcaatatttgctgctgacaatatgtttgatttaatttatattagctgctgccatgattgtaaatgctgctaagcatttgttgctggccagctaagggcctgattagatcccttggtaaaattttttaccctgtcacatcgaacgtttgaacatatgtattaagtattaaataaaaacaaaaaaataactaattacacagcttgtatgtaaaattgcgagacaaattttctaagcctaattagtccatgatttgacaatgtggtgctaacatttgctaatgacggattaattaggcttaataaatttgtatcatagcttatagccaaaatctataatttgttgtgttattagtctatgtttaatacttcaaattagtatccgtatattcgatgtgacgcgtcaaaacttttcacccctgcatctaaaaacagcctaactctatggtgctaggcaaaagaaaataatcacgtaggttccggggcaaggaaaatcgaacttgtgatattttccttacaagataattttaccaaacaacattgtaccacaaatttttatacctcgagatactttttagtataaatttgatatctctaatataaaatttagtgccccaatatatttagtatctggaggtaaaaagaatttttgtgtgcaaaatatggtgttgatggtaaaacacgcgactgtgtactactgtaccagctcgcttttttgccatatacacacaagttgcatataagtatacaattacaatctattatattattaagacagctcgaaaagaaggcaccacgttcactgtgggggctagaaattcccacattaatcgaagaaaaagaaaaaaaataaaaaggagagttcaagtagaagtacaatttaaaaatagctgaaattcggaattaaaaataagcaatattgaaagaagtttctatataagaacccaatacgagattaatcaaaattcgaaataaaaataaaatctattatattattaagacagctcgaaaggaaccacgttcgctgtgggggctagaaattcccacattaatcagagaaaaagaaaaaaaaagaaaaaggagagtccaagtagaagtacaatttaaaaatagctgaaattcggaattaaaaataagcaatattgaaagaagttttgtcacgcccagaaattcactagtaatttccgaacttatttgtgcataaaatcctcgtctaggaatcagccgaggtacacaaactgacaatttaatatacaaatccatcataataataacgtttcacacttacaaaagaaaagaaaacagcagcggaataacggtctagcgatggcttcagctccactcccacaggcagctcaactggagtataagccaaacgtcttctccttctggatcttttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggttgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaaccatgctgtacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatttcttgaatacttccagcgcactcacgaaccttcgcaacgacgaaaacgacaagctaacacgcaaaacaaagaaaaagactaataaaaaccaaataaatagtacatataaagtaaacaaacatgtagatcataattttagatgaattatgagacttgaacggcctcattctgacttcatatgaattaaatatgaattttacaagatttaatctaattaaagcccatttaaaaagaattaaataaatttaattctatttatggataattttaatatgtagatctttattttatacaactttagagacttgaaccaactaaacccgagctaagatgaattagttatgaatttttaaagattaaatcggattaaaacacttatatggattttaattgaattatgacgcaataaagaattatttttgaaaaggaaaagaggattattgcgtcagcggctagggtttgcggtggaccgggtgcacagcggcggtctacggaacggacggccgagatctaccctatccaaaacgaacggccgagatcgatcggtccacggccggaccacgagagacgacgacgatgacgtcagcgacgacgtcaccaccagcggcggctcgggcgcgcatgctcgccggcgaacgacggcgcggcggcgcgaacggagagcacccacaggtagcggacggcacggctacctcaccggtgaccaaaacggcggtggaagatcaacggacggcgacggcgtcgaggaagaagcggcggcgaccttcggcttgacgacgacggcggtgttccggcggtcgacagcgacggcggaggggcggacgaggacggcgacgcgacggcgaccacgatggcggccttcccgagcgacggcgacgactggagcgacggcggcgcacggctggagcggcggtgacgacggcggcgcgaggtctcacggggctagggcgctaccgacggcgagaggcgaaggcaagagtggcgacgggtagcggcgggcttgggggtccttttataggggcaaggaggcggcggcgaaggcccacggcgactggcgacgagaaggaaagattagggttcggaggagagagatcgatccgaatcgaactcgaatccacggatttccaaacgaaattagccgacgattccataagagaaaagatagagtggatcgcgaggatcatttcccctctatcgattcggccggagatggaaaggagcgacggaatttggaaggagacggcggcggcacggcgctacgtttcgggcggcgggcggccggaggttgacgacgaccctgacaggtggggcccacctgtcagcgggagagagaggagagcggcggctcggttccggcccggcttgggccgaggagagagagaaaaagagagaggttttgggccgactttcggcccaaagccaaaagagacttttaaaaacctttttcaatttaaattattcatgaaatgcaattccatttattaaaaatactttcttggctcaaataaatcccggaaaaatctaggaactaaagattcaagagaagtatttaacaaaattttatctagcccaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactaaactgttctttgtatcatttaggaattgagctccgaaaaatccgagaaaatttcagagagtatacttaatcatggagaatttaataaaaattagatccatccatgctttaaatttaggaaattttatttcccacatttaacttcacttgtaaattaatgaacatttaatataaattctaataataatttattaaataatttataaatcctgaaacaaaaatcaggatgtgacaagtttccacataagaacccaatacgagaataatcaaaattcaaaataaaaataaaataaaatccaaaattagaaaaggaaaggagagtgcaagtagaaatacaatttaaaaatagctgaaatttgtaattaaaaataaggaatattgaaataagtttccatataagaacccaatacgagattaataaaaaactgaaataaaaataaaataaaatccaaaattataaaagtaaatgagagttcaagtaggaatacaatttaaaaatagctaaaattcggaattaaaaataaggaatattaaaagaagagtccatataagaaccaaatacgagattaattaaaattcagaataaaaataaataaatccgaaattagcaaaagaaaataaaataagagttcaagtaggaatacaatttaaaattagctgaaatttggaattaaaaataagcaatattaaaagaagaatccatataagaacccaatacgagattaattaaaatttagaataaaaataaaataatatctaaaattagaaaaattaaaagagagttcaagtaggaatacaattttgaaacaactgaaattgaaaaaaaaaataaaaacattaaaataacacaatacgatattaactaaatttttttaaaaaaattttgaaattagaaaaagaaaattaagatttcaattaggaataaaatttagaaataactaaaatttgtgataaaaataaagattattgaaagaaaagaccatctaaaacacatgatgagataaattaagtaacatgcctataaaggagtagagtggtggtggttgatacgagatataaaaattgttaataaaacaccaaatagaatcctactgatgattaaaaggagggacttcaggcaggccatgaagcaaacgtgtaaggcggttgtcgggacttctagaaagtaaaaaaaaacaaaccccaatgataataatatttaattttaaaaatctcaatgacaataaaaaggagaagcagtgggcggggtgtataagagtatagttgcagagccgccgacggttgatgggacttctagaaaataaaaaatgaattcctacgatagttatgttcgatggttagaatcacaatgacaataaagagttggcggcggacgggctgtagaggggcatagtggcatcgacgggatttctagaaaataaaaaatgaattccaacgatagttatgtttgatttttagaatcacaatgacaataaagagttggcggcggacaggctgtagaggggcatagtggcatcgtttgatgggacttctaaaaattataaaaaattaaactgcaagtccaatttttaaaggtttggaacttctaaaaagtaaaaaaaacaaatgataatcatatttgattttaaaatctcaatgacaataaagaagggaggcagcgggcgagctgtaaaggagtacaatggcaaagccactgacggtttggcgggacttctagaaagtaaaaatgaacccaaacgataattatgttcgatttttaaaatctcaatgacaacaaagagaagagacatctagaaattacaatggcaacgtttaacgggacatctagaaattataaaaataaaatccaacgtgacaataaactctaaaaattataaaatccaatttttaaagattccgagaagaatgaatagaaatagtggtagattgagcaagcaaataaagaaggagataacataaggggtagcaactggtgtgacttttgaaaactatataattagaaacacgaggatgataaggtttggtcttagcaactggtgtgacttttgaaaactatataattagaaacacgagtatgataaggtttggtcttttaaaatcttaagacgatgagatagctagatagctatttaataaattttaagtaaaatcatactaaaaaatatatgattttgtttgggtgctagccgcgcaattgcacgcgccacccaactagttacaatacaaataagctccaattaaatgttgcacagatactcctttatttttctgtaaacattaaatcagacgggccaacaatgtcagaggaaagggagtggagtaggaatcttggtgatcataatttcacaggctcttatttctctctttccttgactctctctcccggtctcctctctctcccccacacggcttcaccggcgacgcgagctcggctccggcgactcgagcttgactctggcggcagtggcgggcggcgtggccttgcgatttggcggcgggtgcaggctggtttgatcgtcggcgtcagcgcgggctcgatttcaactgtgcaagctcgagatcgccggtgtagtgggctccacatcggccgcgcgcgggcgcgagcttggacttcggcggcactgctaacgtacagttcctaactcctaagatcaatttgttgctctctctttagtatgcctggtcaatttttcattttccatgaattttggggtaattcattttttttaaaaaaaaaagagaaaatttgggtaactagggtgagttcaaatataaaaaacatgatatgttgacctcttattctaattcacaatgtaagttaactttccgttattgattccagagtttcatactaattgttgcaacagtagtgctgctgccattgaattagtttggtctaaaactaaatgtagttgctccttttgcaattccattcacaggggttaggcaagatactttgaaatatgagtggaatggaagctgctgtagcatctgggctgttgaaggtcgcaggacacaagttagtttcactgataggcagcgagtttgctgccatagcgcgcgtggccgaagacctatctgagctccatggtatacatggtgaaattactagctggctgtccacagttcgtgatggatcaatagagtgtgatccacagttccgttgggtgattaaattgaaggatgttgcttatgatattgatgatctactccatgaagtccaactagaatatgagaaacacaagatacacagcaatggtgacaagcatgctatatttgacacgttacgtgaaaaaccaaagtgatttatgttccgtcgcaagatggcccgtaagatcaaggatatcaaggtgaaatataatgagattgtgcgacaaagaagggatgccaatactatacgcagtagtttacaagtggatcaacctattcctagcagtaacatgataatcggggagttgtccttgttgagtaatgttgaagaatcaaaaatacctatcagggaccaggagatggatacaattgtatctatgcttgtagactctaatgagggagagaattgttggatagtttccgttgttgggctaggcgggtccggca
